United States Patent 8,952,217 (PROCESS FOR DECREASING VERBASCOSE IN A PLANT BY EXPRESSION OF A CHLOROPLAST-TARGETED FIMD PROTEIN) - sequence listing, part 11

SEQ ID NO: 49663 - protein, 301 aa, Pseudomonas syringae pv. tomato str. DC3000
MKILLLGKNGQVGWELQRSLAVLGEVVALDRHTASTVYGDLSGDLSSLDGLRNTIRCVKPQVIVNAAAYTAVDKAETEQELAHTVNALASQVLAEEARQLDALLVHYSTDYVFDGTGTSAWKESDAVSPVNYYGATKLEGEQLIVASGCKHLIFRTSWVYAARGNNFAKTMLRLAKDRPALNVIADQIGAPTGAELLADIATAALQQTLARPELCGIYHLAPAGEVSWHAYAQYVIDFARAHGEPLAVETINPIGTIEYPTPAQRPLNSRLNTEKLRHNFSLHLPDWQSGVARMLMEALNK

SEQ ID NO: 49664 - DNA, 855 bp, Streptococcus pyogenes SSI-1
  CDS (1)..(855): transl_table=11
atgattttaattacaggaagcaatggtcaattagggacagaacttcgatacttattagatgaacgaggtgttgattatgtagccgttgatgtcgcagaaatggacatcacaaatgaagacaaagtcgaagctgtttttgcgcaggtcaagccaacattggtctatcattgtgctgcttatacggcagttgatgcagcagaagacgaaggaaaagccttgaatgaggctattaatgtaacaggctcagaaaatattgccaaggcttgtggaaaatatggggctacccttgtttacatttcaacagactacgtatttgatggcaataaaccagtcggtcaagaatgggtagaaacagatcgtccagaccctaagacagaatatggccgtacaaaacgtttaggagaactagctgttgaacgatacgcagagcatttttatattatccgtactgcttgggtatttggaaattatggtaaaaactttgtctttaccatggaacagttagcggaaaatcactcccgtttgactgttgtcaatgaccaacacggtcggccaacgtggacaagaaccttggcagaattcatgtgttatttgacagagaatcaaaaagcctttggttactatcacttgtcaaatgatgctaaggaagacaccacttggtatgattttgccaaagaaatcttaaaagacaaggctgttgaagtcgtgccagttgattcatcagctttcccagcaaaagccaaacgtcctttaaattcaaccatgaatcttgataaggcaaaagcaacagggtttgttattccaacatggaaagaagccttgaaggcattttaccaacaaggactgaaaaagtaa

SEQ ID NO: 49665 - protein, 284 aa, Streptococcus pyogenes SSI-1
MILITGSNGQLGTELRYLLDERGVDYVAVDVAEMDITNEDKVEAVFAQVKPTLVYHCAAYTAVDAAEDEGKALNEAINVTGSENIAKACGKYGATLVYISTDYVFDGNKPVGQEWVETDRPDPKTEYGRTKRLGELAVERYAEHFYIIRTAWVFGNYGKNFVFTMEQLAENHSRLTVVNDQHGRPTWTRTLAEFMCYLTENQKAFGYYHLSNDAKEDTTWYDFAKEILKDKAVEVVPVDSSAFPAKAKRPLNSTMNLDKAKATGFVIPTWKEALKAFYQQGLKK

SEQ ID NO: 49666 - DNA, 855 bp, Bacteroides thetaiotaomicron VPI-5482
  CDS (1)..(855): transl_table=11
atgaatattctagtaactggagctaatgggcagcttggtaatgaaatgcgatgcatagcagctacaagtttgaataattatatatttactgatgttgcagagttggatattacagatttagatgctattcgtaatatgatacatttggataatataaaggtaattgttaactgtgctgcttatacgaatgtagataaagcagaagatgattatgatatggcagacttattgaataataaagctgtagagaatttggctattgctgcaaaagaagttaatgctactttaattcatatttcgactgattatgtatttcaaggtgataagaatatgccatgtggagaagactgtgaaactaatcctttaggtatttatggtaaaacaaaaagagcaggagaacaaagcatccaacgtgtgggctgtaattatttgatttttcgtacagcttggctgtattctcaatttggtaagaattttgttaagactatgcgacagttaaccgctgataaagataaattgagagttgtttttgatcagattggtacacctacatatgcaaaagatttggctgatattatttatagagtgattgagggggatcaatatcacaaacaaggtatctatcatttcagtaatgagggtgtttgttcatggtatgattttgctaaagaaatctgtgaattgagtggaaatagttgtgatattcaaccttgccatagtgatgaatttcctagtaaagtaaaacgtcctcatttctcagtattagataaaacaaaattgaagctggcttttggtgtagagattccttattggaaagattctcttgtgaaatgtattaataaagaaaataattaa

SEQ ID NO: 49667 - protein, 284 aa, Bacteroides thetaiotaomicron VPI-5482
MNILVTGANGQLGNEMRCIAATSLNNYIFTDVAELDITDLDAIRNMIHLDNIKVIVNCAAYTNVDKAEDDYDMADLLNNKAVENLAIAAKEVNATLIHISTDYVFQGDKNMPCGEDCETNPLGIYGKTKRAGEQSIQRVGCNYLIFRTAWLYSQFGKNFVKTMRQLTADKDKLRVVFDQIGTPTYAKDLADIIYRVIEGDQYHKQGIYHFSNEGVCSWYDFAKEICELSGNSCDIQPCHSDEFPSKVKRPHFSVLDKTKLKLAFGVEIPYWKDSLVKCINKENN

SEQ ID NO: 49668 - DNA, 909 bp, Bacteroides thetaiotaomicron VPI-5482
  CDS (1)..(909): transl_table=11
atgaagaatataataattatcggtgccaatggattcaccggacgccaaatactgaatgacctgtcgagcaaggcacaatataaggtaacaggatgttccctgcatccggatatccttccgaagaatggaggcaactatcatttcatcaccacagatatacgggatgaagcagtcgtaaagcaactttttaaagacgtacaacccgatgtagtcatcaactgttccgccttatccgtccccgattattgcgaaacgcatcacgaagaagcctggctaacaaatgttacggcagtagaacaattggcacatctttgcgaaagttacaaaagccggttcattcatttatctacagacttcgtctttgacggaaagatagacgagaagtccggacagctttatacagaaaaaagtctccctgctcccgtcaactattacggtttcaccaaatggaaaggagaagagaaagtgactgaaatctgtagtaactatgctattgcccgcgtagagattgtctacggaaaagcattgccgggacaacatggaaacatcgtgcaactggtgatgaatcgtttgaatgcaggacaagaaatccgtgtcgtatcagatcaatggcgcacgcccacctatgtaggtgacgtatcagccggagtacaacacctggtagaaaatgccgcaaacggaatttttcatatctgtggcgaggaatgcctgaccatcgcagaaattgcttttcaggtagcagactacatgaagctggaccgttcgctcgttcaccctgccacaacagaagaaatgcaagaagctactccccgtccccgtttcagtgggatgagtatagcaaaagcccggactatacttggttaccagccacgaaagctgaaagacatcctcatggagtggaaacattaa

SEQ ID NO: 49669 - protein, 302 aa, Bacteroides thetaiotaomicron VPI-5482
MKNIIIIGANGFTGRQILNDLSSKAQYKVTGCSLHPDILPKNGGNYHFITTDIRDEAVVKQLFKDVQPDVVINCSALSVPDYCETHHEEAWLTNVTAVEQLAHLCESYKSRFIHLSTDFVFDGKIDEKSGQLYTEKSLPAPVNYYGFTKWKGEEKVTEICSNYAIARVEIVYGKALPGQHGNIVQLVMNRLNAGQEIRVVSDQWRTPTYVGDVSAGVQHLVENAANGIFHICGEECLTIAEIAFQVADYMKLDRSLVHPATTEEMQEATPRPRFSGMSIAKARTILGYQPRKLKDILMEWKH

SEQ ID NO: 49670 - DNA, 849 bp, Bacteroides thetaiotaomicron VPI-5482
  CDS (1)..(849): transl_table=11
atgagaattttagtgacgggtgccaatggtcagcttggcaatgaaatgcaagttcttgcaaaagagaatccgcaacatacgtattatttcacagatgtgcaggagctggacatctgtaataaggacgctgtttgggcatatattgctgaaaagcggattgagcttattgttaattgtgcggcatatacagcagtagataaagcggaagatgattcggaactggcttacaagctgaacagtgaagctcctaaaacgctggcatgtgcagcgcagtttaatggtgcggcgatgattcaggtgtctaccgactatgtttttgacggcaccgctcatattccttatacagaagaatgcgatccatgtccgaattcggtatatggaacaacgaaacttgaaggagaatatgaggtactgaatcattgcgaaaagtcagtcgttatccgtaccgcatggctttattccacttttggcaacaacttcgtgaagacgatgatccgtctgggcaaagagcgtgatagtctgggagtcattttcgatcaggtaggaactcctacttacgccaatgacctggcacaggccatctttgctattattaataaaggcatcgttcgtggagtctatcatttcagcaacgaaggagtctgctcctggtatgactttacggtagctattcatcgtttggcaggaatcacttcatgcaaagtgaaaccgctgcatacggcggaatatcctacaagagcgaaccgccctgcatattccgtactcgataaaacaaaaataaaaacaacgttcggcatcgaaatacctcattgggaggaaagcctgaaaagatgcatcgatactttataa

SEQ ID NO: 49671 - protein, 282 aa, Bacteroides thetaiotaomicron VPI-5482
MRILVTGANGQLGNEMQVLAKENPQHTYYFTDVQELDICNKDAVWAYIAEKRIELIVNCAAYTAVDKAEDDSELAYKLNSEAPKTLACAAQFNGAAMIQVSTDYVFDGTAHIPYTEECDPCPNSVYGTTKLEGEYEVLNHCEKSVVIRTAWLYSTFGNNFVKTMIRLGKERDSLGVIFDQVGTPTYANDLAQAIFAIINKGIVRGVYHFSNEGVCSWYDFTVAIHRLAGITSCKVKPLHTAEYPTRANRPAYSVLDKTKIKTTFGIEIPHWEESLKRCIDTL

SEQ ID NO: 49672 - DNA, 900 bp, Enterococcus faecalis V583
  CDS (1)..(900): transl_table=11
atggcaaagtacaaaagctactttgccctgcctttttttcaagaaggagcgaaaaaaatgattttaattactggtggaaatggccaattgggcacagaattacgtcacctattagacgaacaaggaattgagtatgtttcaacggattccacagaattagatattactgatgcggatagtacgttggcaaaagtgaaagaaattcaaccaagcgtcatttatcattgtgctgcttatacagctgttgataaagcagaagacgaaggcaaggaattagatgaaaaagtgaatgtagatggcacacgtcatgttgcagaagctgctaaagcagtgggggcgacacttgtttacgtaagtacagattatatttttgatggaactaaaaaagaaggcgtctatgcgattgatgatcaaccgaatcctttaaatgagtatggtcggacgaagttattaggtgaacaagcggtccaagaaatcctggacgactattatattattcgaacatcatgggtatttggtcaatacggtcataactttgtctttaccatgcaaaaattagcggaaacaagagaccaactaaaggtagtggacgatcagtttggccgcccaacttggacaagaacgttagccgaatttatggcatttgttattgcagaaaaagcgccatttggtgtttatcatttgtctaatgaaaacagctgtagctggtatcagtttgctaaagaaattttaaaagatactgaagtggaagtattgccagtggattcaactcaatttccacaaaaggcgcaaagaccacaatattctgtcatggatttaagtaaaacagaagcgttaggctttaaaattcctacttggcaagaagccttagcacaaatgttagaaaatgttcaacaataa

SEQ ID NO: 49673 - protein, 299 aa, Enterococcus faecalis V583
MAKYKSYFALPFFQEGAKKMILITGGNGQLGTELRHLLDEQGIEYVSTDSTELDITDADSTLAKVKEIQPSVIYHCAAYTAVDKAEDEGKELDEKVNVDGTRHVAEAAKAVGATLVYVSTDYIFDGTKKEGVYAIDDQPNPLNEYGRTKLLGEQAVQEILDDYYIIRTSWVFGQYGHNFVFTMQKLAETRDQLKVVDDQFGRPTWTRTLAEFMAFVIAEKAPFGVYHLSNENSCSWYQFAKEILKDTEVEVLPVDSTQFPQKAQRPQYSVMDLSKTEALGFKIPTWQEALAQMLENVQQ

SEQ ID NO: 49674 - DNA, 855 bp, Bacillus cereus ATCC 14579
  CDS (1)..(855): transl_table=11
atgaaagagagggttatcataacaggagcaaacggtcaattaggaaagcaactatttgaagagttagactctgaagaatatgatatatatccatttgataaaaagttattagatgtgacaaatatatcccgaatacaacaagtggtacaagaaataaaaccacatataattattcattgtgctgcctatacgaaagtagatcatgcggagaaagaacaggatcttgcatatagaataaatgcaatcggagctcgaaatgtagcggttgcttcacaattagtaggggcgaagctagtttatattagtactgattatgtatttcaaggcgccagaccagatggatacgacgaatttcatagtccagcgccgataaatatatatggggcctctaagtatgcgggggagcagttcgtcaaagagttacataataaatattttatcgttcgcacatcgtggctatatggtaaatatgggaataatttcgtgaaaacgatgatgcgattaggaaaagaaagagatgaaatatctgttgtagcggatcaagttggctctcctacgtatgtggcggatttgaatatggttattaataagctcattcatacttctttatacggtacataccacgtatcaaacagaggctcatgctcttggtttgaatttgcacaaaagatattttcgtacgccaatatgaaagtgaatgtattacctgtttcaacggaagaattcggggctgcggctgcgaggcccaaatattctatttttcaacataacatgctaagattaaatggtttttcacaaatgccgtcttgggaagaaggattagagcggttttttatagaaaccaaaagtcattaa

SEQ ID NO: 49675 - protein, 284 aa, Bacillus cereus ATCC 14579
MKERVIITGANGQLGKQLFEELDSEEYDIYPFDKKLLDVTNISRIQQVVQEIKPHIIIHCAAYTKVDHAEKEQDLAYRINAIGARNVAVASQLVGAKLVYISTDYVFQGARPDGYDEFHSPAPINIYGASKYAGEQFVKELHNKYFIVRTSWLYGKYGNNFVKTMMRLGKERDEISVVADQVGSPTYVADLNMVINKLIHTSLYGTYHVSNRGSCSWFEFAQKIFSYANMKVNVLPVSTEEFGAAAARPKYSIFQHNMLRLNGFSQMPSWEEGLERFFIETKSH

SEQ ID NO: 49676 - DNA, 915 bp, Nitrosomonas europaea ATCC 19718
  CDS (1)..(915): transl_table=11
atgccagatcggacgaccccaataaaaattctgctctttggcaagaacggtcaggttggctgggagctgcagcgcagtctggctccgctaggggagttgattgctccggacaaacaggacttgcgctattgtggtgatctggcagacttagcagggattactcatacactgcaaaccatccgtcctgacatcattgtcaatgcagcagcatataccgcagttgaccaggcagaaagtgaaccggagctggcctttcgtatcaatgccgaggcacccgaattactggcgcagcaggctgaacaaattggagcctggttgattcattactctaccgattacgtattcaacggcaatggtaattgtccctggcaggaaacagaccttacttcacctatcaatatttatggcctgagtaaattacggggagaagaacagatccgaaaatcaaactgcaaatatatgatcctgcgtaccagttgggtctatgccgctcgcggaaagaatttcatcaaaactattttgcgacttgcccgggaaaaagaacaactgacgatcatcgatgatcagatcggggcgcctaccggagcagaactactggctgatataacagctcaggccattccacaactattggaataccctgataaatcaggcgtttatcatgttgctgccagcgaggaagtctcctggtacagctatgcccggtttttactggactttgcccgtgaacacgatattccgatcaaggtccacccggatgcagtcatcccggttcacagcgaagcttttgtcacggcagccaggcgtcccttgaactcacgtctgaatacagagaaattctgtaatacgttccagctttgtcttcctcactggcaaaccggagtaactcgggtgctcgaagaaatttacctgtga

SEQ ID NO: 49677 - protein, 304 aa, Nitrosomonas europaea ATCC 19718
MPDRTTPIKILLFGKNGQVGWELQRSLAPLGELIAPDKQDLRYCGDLADLAGITHTLQTIRPDIIVNAAAYTAVDQAESEPELAFRINAEAPELLAQQAEQIGAWLIHYSTDYVFNGNGNCPWQETDLTSPINIYGLSKLRGEEQIRKSNCKYMILRTSWVYAARGKNFIKTILRLAREKEQLTIIDDQIGAPTGAELLADITAQAIPQLLEYPDKSGVYHVAASEEVSWYSYARFLLDFAREHDIPIKVHPDAVIPVHSEAFVTAARRPLNSRLNTEKFCNTFQLCLPHWQTGVTRVLEEIYL

SEQ ID NO: 49678 - DNA, 855 bp, Bacillus anthracis str. Ames
  CDS (1)..(855): transl_table=11
atgaaagagcgggttatcataacaggagcaaatggtcaattaggaaagcaactacaagaagagttaaatcctgaagaatatgacatatatccatttgataaaaagttgttagatataacaaatatatcccaagtgcagcaagtggtacaagaaataaggccacatatcattattcattgtgcagcgtatacgaaggttgatcaagctgagaaagagcgagatcttgcttatgtaataaatgcaataggggctcgaaatgtagcggttgcttcacaattagttggggcgaagttagtttatattagtacggattatgtatttcaaggcgacagaccggaggggtacgatgaatttcataatccggcaccgatcaatatatacggggcttctaaatatgcgggagagcagttcgtcaaagagttacataataaatactttatcgttcgtacatcgtggttatatggtaagtatggaaataattttgtgaaaacgatgatacgattagggaaagaaagagaagaaatatctgttgtagcggatcaaatcggttctcctacgtatgtggcggatttaaatgtgatgattaataagctcattcatacttctttatacggtacgtatcacgtatccaatacaggatcatgttcttggtttgaatttgcaaagaaaatattttcgtatgcaaatatgaaggtgaatgtgttacctgtttcaaccgaagaatttggggctgcagcagcaaggccgaaatattctattttccaacataacatgctacgattaaatggttttttgcaaatgccttcttgggaagaaggattagagcgtttttttatagaaaccaaaagtcattaa

SEQ ID NO: 49679 - protein, 284 aa, Bacillus anthracis str. Ames
MKERVIITGANGQLGKQLQEELNPEEYDIYPFDKKLLDITNISQVQQVVQEIRPHIIIHCAAYTKVDQAEKERDLAYVINAIGARNVAVASQLVGAKLVYISTDYVFQGDRPEGYDEFHNPAPINIYGASKYAGEQFVKELHNKYFIVRTSWLYGKYGNNFVKTMIRLGKEREEISVVADQIGSPTYVADLNVMINKLIHTSLYGTYHVSNTGSCSWFEFAKKIFSYANMKVNVLPVSTEEFGAAAARPKYSIFQHNMLRLNGFLQMPSWEEGLERFFIETKSH

SEQ ID NO: 49680 - DNA, 849 bp, Ruegeria sp. PR1b
  CDS (1)..(849): transl_table=11
atgagcattcttgtgtttggcgcaaccggccaggtggcgcgggaactggcaacgcatgacggggtggtctgccttggccgcgatcaggcggatctgtcggatcccggcgcctgcgctgcggccattcgcgcccatgctccgcgggcggtgatcaatgccgccgcctatacggcggtggacaaggccgagggtgaggaagagctggcccggatcatcaatggggcggcgcccggtgcgatggcggcggcctgcgtgcagctgggcgtgcctttggtgcagatttccaccgattatgtctttgccggcagcggcgagatgccctggcgtcccgaggatccggtggcgccgcccaatgcctatgggcgcagcaagcgcgcgggcgaagaggcggtgattgcggcgggcgggacttatgcgatcctgcgcacctcctgggtggtctcgtgccatgggcataattttgtcaagaccatgctcaggctgggggccgagcgggaccagctgaccattgtcggggatcagatcggcgcgccgaccccggcccgtgacattgccgccgcctgcatcagcatggcagagcagctgatcgcggatcccggcaaatcggggatctatcactttcagggcgcgccctgtgtgagctgggcggattttgcccgcgagatctttgcccaggcggggctgagctgcgcggtggcggatatcccgacctccgactacccgacgcccgcggcgcgcccgctgaactcaaggctcgattgcgccttgttagacactgtttttggcatcccgcagccggattggcgcgttgggctccgcgagatattgaaggacttggaaacggcatga

SEQ ID NO: 49681 - protein, 282 aa, Ruegeria sp. PR1b
MSILVFGATGQVARELATHDGVVCLGRDQADLSDPGACAAAIRAHAPRAVINAAAYTAVDKAEGEEELARIINGAAPGAMAAACVQLGVPLVQISTDYVFAGSGEMPWRPEDPVAPPNAYGRSKRAGEEAVIAAGGTYAILRTSWVVSCHGHNFVKTMLRLGAERDQLTIVGDQIGAPTPARDIAAACISMAEQLIADPGKSGIYHFQGAPCVSWADFAREIFAQAGLSCAVADIPTSDYPTPAARPLNSRLDCALLDTVFGIPQPDWRVGLREILKDLETA

SEQ ID NO: 49682 - DNA, 897 bp, Bordetella pertussis Tohama I
  CDS (1)..(897): transl_table=11
atgaacatcctgctgctgggccgcaccggacagatcggcgatgcgctgctggcgcacccgccggcatgggcgcggctggccgcgctggaccgccgccaggccgacctgcgcgacctgggccggctggccgccgtgctcgatgcctacgcgccgcgcatactgatcaacgccgccgcctataccgaagtcgaccgcgccgaggccgagccggagctggcgctgcgcatcaatgcccaggcggtggcggtcatggcggactatgcgcgccgcaacaatgcattgctggtgcactattccaccgactacgtgttcgacggcaagcgcgcccgcgcctaccgggaaaccgacgccgcacatccgctgaacgcctacggccgctccaagctggccggcgaacaggccatcgcggccagcggctgcccgcacctgatactgcgcaccagctgggtctacgccagccatggcgccaatttcgtcaagaccatcctgcgcctggcgcgcacccgcgccgagctgtccgtggtcgccgaccagcacggcgccccgatctgggcgggccgtatcgccgccgtcacctggcaggcgatcgatgcgcaccggcgccgccgcctgcccgacggcctgtggcacctgagcgcgggcggccatgtcagctggcacgggctggcctgccacatcgtggcgcgggcccggcgcgccgggctggcgctgagcctggacccggcgcacatccggcccgtcacggcggcgcaatacccgctgccggcgccacggccggccaattcgcggctggactgcggcgcgctacgcgatgccctggagcccgagctgcccgactggcaagtcgacctggatgcggtcgtggatgccctggccgcgcgggcgcataccctgtag

SEQ ID NO: 49683 - protein, 298 aa, Bordetella pertussis Tohama I
MNILLLGRTGQIGDALLAHPPAWARLAALDRRQADLRDLGRLAAVLDAYAPRILINAAAYTEVDRAEAEPELALRINAQAVAVMADYARRNNALLVHYSTDYVFDGKRARAYRETDAAHPLNAYGRSKLAGEQAIAASGCPHLILRTSWVYASHGANFVKTILRLARTRAELSVVADQHGAPIWAGRIAAVTWQAIDAHRRRRLPDGLWHLSAGGHVSWHGLACHIVARARRAGLALSLDPAHIRPVTAAQYPLPAPRPANSRLDCGALRDALEPELPDWQVDLDAVVDALAARAHTL

SEQ ID NO: 49684 - DNA, 906 bp, Prochlorococcus marinus str. MIT 9313
  CDS (1)..(906): transl_table=11
atgacgatcaaggtcttgctcaccggtgctgccggtcagcttggtcaggccttgcaagcgtcctgtccgtcgtctgttgagttggtctccaccagtcgaatgggtgatggtttgttgcagcccttggatttggccgatgctcaggcatgtcgggcagcagtgttccagcaccgtcctgactgggttctcaatgcaggggcttacaccgcagtcgatcatgcggagcaggagcccgatctggcattagctgttaatgcaagtgcaccgcgtgctttggcggaaggtttattggagacgggcgggcggatgttgcaggtaagtacggattttgtgtttaacggcgctcaagggcacccttaccgtcctaatcagcctcgagatcctttgggggtctatggcgcgactaaagccgccggggaagaggcagtggaacaaattctcggtgcgcaaggacgagcggtaactttgcgcaccagctgggtttatggccctgtgggtaggaattttttgctcaccatgctgaggttgcatcgcgaacgtgaacagctgaatgtggttgtcgatcaagtgggttgccccacaagcacaattacactagccactgcatgttgggcgttgatgaaagaacctcaacagccgtatcttccgccagtattgcactggtgtgatgctggagcggcatcttggtatgacttcgcagtggctattggtgaattgggcgttgccaagggcttgttgcagcgggcagccgtcgtgaacccgataatcacggcggaataccccacgcccgcccagcgtcccagctactcccttcttgactgctcagagactcgtcaacttcttggcttgcacgcatgccattggcgagttgcattggaacaggtgattgctgatgtagagagttag

SEQ ID NO: 49685 - protein, 301 aa, Prochlorococcus marinus str. MIT 9313
MTIKVLLTGAAGQLGQALQASCPSSVELVSTSRMGDGLLQPLDLADAQACRAAVFQHRPDWVLNAGAYTAVDHAEQEPDLALAVNASAPRALAEGLLETGGRMLQVSTDFVFNGAQGHPYRPNQPRDPLGVYGATKAAGEEAVEQILGAQGRAVTLRTSWVYGPVGRNFLLTMLRLHREREQLNVVVDQVGCPTSTITLATACWALMKEPQQPYLPPVLHWCDAGAASWYDFAVAIGELGVAKGLLQRAAVVNPIITAEYPTPAQRPSYSLLDCSETRQLLGLHACHWRVALEQVIADVES

SEQ ID NO: 49686 - DNA, 909 bp, Synechococcus sp. WH 8102
  CDS (1)..(909): transl_table=11
atgaaggtgttgctcaccggtgcagcggggcagcttgggcaggccttgattggaaggatgcctgatggcattgaactggtggcgagcagccgcagcggcggcaatggcttggtggcactcgacctggctgatgcaacggcatgccggcaggtggtggaggagcaccgccccgattgggtgctgaatgccggggcttacaccgcagtggacaaggcagaagcggaaccggagctggcccatgccgtgaatggaggcgcaccgcgcgcttttgcagaagcgatccaggcgcacggcggccgaatgctgcagctgagcaccgactttgtgttcaacggtcagcagggctccccttaccgggtggatcaaagccgagatcccctgggggtctacggcgccagcaaggccagcggagagaaggcggtggaagagctgcttgggaccagtggccaaggtgtggtgctgcgcaccagctgggtgatgggtccggtgggcaaaaactttgcactcacgatgctgcgactgcatcgtgagaaagagcaattgggggtggtggccgatcaggtgggctgcccgagcagcacgttgaacctggcgacggcgtgctgggcggtgatcaccagcagccgcgatgaggtggaactcccccctgtgctgcactggtgtgatggcggtgccgccagctggtacgacgtgtccgtcgcggtgggcgagctggcgatggaccttggcctgctgcagcgcgccgccacggtgaatccgatcagcacagctgactatccaaccccagccactcgtcccggctattcgttgctggattgccaggccagccgacaagtactgcaactggaggcccagccctggcgggcagccctcaaggatgtgctgcaggccatccccacgaacccttga

SEQ ID NO: 49687 - protein, 302 aa, Synechococcus sp. WH 8102
MKVLLTGAAGQLGQALIGRMPDGIELVASSRSGGNGLVALDLADATACRQVVEEHRPDWVLNAGAYTAVDKAEAEPELAHAVNGGAPRAFAEAIQAHGGRMLQLSTDFVFNGQQGSPYRVDQSRDPLGVYGASKASGEKAVEELLGTSGQGVVLRTSWVMGPVGKNFALTMLRLHREKEQLGVVADQVGCPSSTLNLATACWAVITSSRDEVELPPVLHWCDGGAASWYDVSVAVGELAMDLGLLQRAATVNPISTADYPTPATRPGYSLLDCQASRQVLQLEAQPWRAALKDVLQAIPTNP

SEQ ID NO: 49688 - DNA, 933 bp, Chromobacterium violaceum ATCC 12472
  CDS (1)..(933): transl_table=11
atgatgaccatgccccgcatactgataaccggcaaaaacggccaggtcggccacgaattgctgcgcgcgctggcgccgctgggcgagctgatcgccaccgacaggcgggagctggacctcacgtgggacgacgcgcgcatcgagcaggcgctggaccagcatgggcccgacatcatcgtcaacccggccgcctataccgcggtcgacaaggcggaaagcgacgaggcaacggcgcacgccgtcaacgcctgcgcggtcggcgtcatcgcgcgctggaccgcccgccatggcgcgttgcttgtccactactccaccgactacgtgttcagcggagacggcgaacgcccctggcgggaagacgacgcaaccggcccgcaatcggtatatggacgcagcaagctggcgggcgaagaagccatccggcatgccgcgcctcgccacctgatactccgcaccagctgggttttcggcgcgcatggcgccaatttcctgaaaaccatgctgaagctgggacaggaacgggattcgctcaaggtcgtcaacgaccagatcggcgcgccagcctccgccgccatgatcgccgacgtcagcgccgaactgattcgccgctacctggccgccccctccggcttcgcctttggaacctaccatctggcgccccggggggaaaccagctggcacggctatgcaagctatctgctgcagcgagccgcgtcctacggactaccactgaaaatcgatcccgcaaacatccagggcattcccagcagcgactatccgctgccagccaagcgcccagccaactccaggctgagttgcgacaagctgaaaagcgctttcggcatcgagctgccggaatggagaagcggcgtggaccaggtgctggctcaattgctccccacctacgacagcggtgccccagcccgggaatga

SEQ ID NO: 49689 - protein, 310 aa, Chromobacterium violaceum ATCC 12472
MMTMPRILITGKNGQVGHELLRALAPLGELIATDRRELDLTWDDARIEQALDQHGPDIIVNPAAYTAVDKAESDEATAHAVNACAVGVIARWTARHGALLVHYSTDYVFSGDGERPWREDDATGPQSVYGRSKLAGEEAIRHAAPRHLILRTSWVFGAHGANFLKTMLKLGQERDSLKVVNDQIGAPASAAMIADVSAELIRRYLAAPSGFAFGTYHLAPRGETSWHGYASYLLQRAASYGLPLKIDPANIQGIPSSDYPLPAKRPANSRLSCDKLKSAFGIELPEWRSGVDQVLAQLLPTYDSGAPARE

SEQ ID NO: 49690 - DNA, 858 bp, Porphyromonas gingivalis W83
  CDS (1)..(858): transl_table=11
atgaaccgaatactggtaaccggagccgatggtcagttgggtagtgaacttcggttgttggcttcggctgacagccgttttgttttcaccgacttagcggaactggatattagagataaagatgctgtcctccgttttatggaggaatatagcatcgggatcattatcaactgtgccgcatatacagctgtggacaaagctgaggacgatgaagcctctgccgagaaagtcaatcaccaagctgcggctcatctggcagcggctgctgcgaagtatgatgccctgctgatacatatttctacggattatgtatttgatggtacggctaatatcccctatagggaagacatcccgacagctcctctcggtgcgtatggccgtaccaagctaaaaggagaacaggctgtgctggcagccgactgccgatacatgatactgcgcacatcgtggctgtactcatcgttcggcaataattttgtgaaaacgatgcttcggctgacagctgaacgcgatacattaaacgtagtcttcgatcaggtcggtactcctacctatgctgcggacttggctgctttcatacaccgtctggctataggacaactgcccgttaagacggggctgtatcactttagcaacgaaggtgtatgctcctggttcgactttgcagtggccattgcccgaatgagtggtcatacagcatgcaggatcagcccttgccatagcgatgaatatccgacaagagtaagacggccgcattattccgtcttggataagacgcttattaaaaacactttcgacatcagcatccctcactggcaggattctttggctgcgtgtctgaatctgctaaaacattga

SEQ ID NO: 49691 - protein, 285 aa, Porphyromonas gingivalis W83
MNRILVTGADGQLGSELRLLASADSRFVFTDLAELDIRDKDAVLRFMEEYSIGIIINCAAYTAVDKAEDDEASAEKVNHQAAAHLAAAAAKYDALLIHISTDYVFDGTANIPYREDIPTAPLGAYGRTKLKGEQAVLAADCRYMILRTSWLYSSFGNNFVKTMLRLTAERDTLNVVFDQVGTPTYAADLAAFIHRLAIGQLPVKTGLYHFSNEGVCSWFDFAVAIARMSGHTACRISPCHSDEYPTRVRRPHYSVLDKTLIKNTFDISIPHWQDSLAACLNLLKH

SEQ ID NO: 49692 - DNA, 903 bp, Gloeobacter violaceus PCC 7421
  CDS (1)..(903): transl_table=11
gtgcgcttttcccgaccgatacagaagtgttttatgtatttgattaccggcgcgggcggacaactgggcaaggagctgtgcgcgctgcttgaagcgcgggaagagcctttcgtcgcctatgggcgggcacagctcgatatcgccgattccggagccgtccggcaggcccttgagcagagcggtgcagcggtgcttttcaactgcgccgcttatacccgcgtcgacaaggccgaatcggaagctgaagaagcgcaccgggtcaacgccaccggagcaagggttcttgcggaagcttgcagcgcggcgggcagccggttggtccacgtttctaccgactatgtctttgatggaagtgcgtgtcggccttacccggaagacgctccaacccaaccgctcgggatctacggccagagtaagcgcgatggcgaagtggcggtgctcgaaggggacggggagcatctggtggtccgcactgcctgggtctacggcgtcggcgggccgaattttgtgcgcacgatcttgcgcctggcgggcgaacgcgaacagttgcgcgtggtggccgatcaggtgggctctcctacctggaccttcgacctggccgcagcgctcgtgggattgacaaaggcccaggccgaaggcggcatctaccacgtgaccaatagcggggtgaccagctggtacgacttcgcggtcgcaattgtcgaggaggcgcaggcgctcggtcgtgccctcaagctgcaaagcgtggtaccgatcaccaccgccgagtacccgacacccgcagcgcggcctgcctattcggtgctctccaacacccgggctctgcgggtgctgggtggtcccctgccgcagtggcgccaatcgctgcggcgcatgctccaacagctcgacaaggaggggtga

SEQ ID NO: 49693 - protein, 300 aa, Gloeobacter violaceus PCC 7421
MRFSRPIQKCFMYLITGAGGQLGKELCALLEAREEPFVAYGRAQLDIADSGAVRQALEQSGAAVLFNCAAYTRVDKAESEAEEAHRVNATGARVLAEACSAAGSRLVHVSTDYVFDGSACRPYPEDAPTQPLGIYGQSKRDGEVAVLEGDGEHLVVRTAWVYGVGGPNFVRTILRLAGEREQLRVVADQVGSPTWTFDLAAALVGLTKAQAEGGIYHVTNSGVTSWYDFAVAIVEEAQALGRALKLQSVVPITTAEYPTPAARPAYSVLSNTRALRVLGGPLPQWRQSLRRMLQQLDKEG

SEQ ID NO: 49694 - DNA, 882 bp, Vibrio vulnificus YJ016
  CDS (1)..(882): transl_table=11
atgagagtgttgattgttggatcaagtggacaactgggccactgtttggtgagatctctgcagactgagcatgacattttggcgctggatcgccagcagctggatatttgtgaagagcaagctgtggaaaaggtatttgcaacctttcagccccagtttgtgattaacgcggctgcttatacggcggttgataaagcggaaagtgagccagagatggcttatcgggttaatgaggaaggccccaaattattggctcaagaatgccatcatcatggctgtcctctggtacatatctctacagactatgtctttgatggcgataaaaatggcctttactgcgaagatgatcgtcctgcgccaggtaatatttacgggatgagtaaactcgccggagagcatgcggtacaacacgcttgttcacagtactatattttgcgtacctcttgggtgttttctgagtttggcaataacttcgtcaaaaccatgttaaggcaaggggctgaaagaacacaattgggtattgtttctgatcaagtcggtgggccaacctacgctggagatatcgcgcgtgtgatcggaaggttacttgaacgctttcagtttggcgagcccgttgagtatggtctgtaccatttttcgggcatgccacacgtgagttggtttgagtttgctcaagcgatttttgggttggcgcacgagcaaggagtgttgaaaaggaaggttgagttaaaaccactgagcacacgagagtacccgaccgccgcaataaggccgatgaactcaaggttagattcaacaaaacttaagagccaactgcagcttgaagcgagtgattggaaagcggcacttaaccaactcgatcgctatgtggagcaaaaataa

SEQ ID NO: 49695 - protein, 293 aa, Vibrio vulnificus YJ016
MRVLIVGSSGQLGHCLVRSLQTEHDILALDRQQLDICEEQAVEKVFATFQPQFVINAAAYTAVDKAESEPEMAYRVNEEGPKLLAQECHHHGCPLVHISTDYVFDGDKNGLYCEDDRPAPGNIYGMSKLAGEHAVQHACSQYYILRTSWVFSEFGNNFVKTMLRQGAERTQLGIVSDQVGGPTYAGDIARVIGRLLERFQFGEPVEYGLYHFSGMPHVSWFEFAQAIFGLAHEQGVLKRKVELKPLSTREYPTAAIRPMNSRLDSTKLKSQLQLEASDWKAALNQLDRYVEQK

SEQ ID NO: 49696 - DNA, 1347 bp, Corynebacterium diphtheriae NCTC 13129
  CDS (1)..(1347): transl_table=11
atgcaggttcgccccactgccattgccggtgttgttattgtcgacctcgatctccacggcgataatcgtggatggtttaaggagaactggcagcgggagaaaatggtggcggcgggcttgccggatttccaaccagtacaaaacaacatttctttcaatgctgaacgtggcgtaacgcgtggtttacatgctgagccgtgggacaagtttgtttcggtggctcatggtgaggtgtttggtgcgtggtgtgacctgcgcgagggttctgacaccttcggcgaggtagttacctgcaccattacccctcatactgcggtgtttgtgccgcgtggggtggccaatggttttcaggcactggtagacaacacaagttacacctacttggtcaacgaccattggtcgccggacgctacttatactgcggtgaatctggacatgattgattggccgcttcctcccacggagatttcggaaaaggatcgttgccacccccagcttgccgaggccaccccgatgccaccacgtcgcattctcatcaccggcgcccatggccagttggggcgtgcgctagccgagttgttgccggatgccgagttgtgttcgcatgtggatttcgatgtggttcatcccccgcagcgctcgtggcgccagtatgaggcgattattaactgcgcggcctataacaatgtggatgcggcagaagatgatcgtgctcgcgcatgggaggtcaatgctgttgccccagcaaggctggcccagattgctacggagaataatctgacgttggtgcatgtgtcgacggatttcattttcgacggcaccacgtccgtgcatgaggagacggaagcgccgtcgccgttgtcggtgtatggggcgtcgaaggcggcgggtgatattgcggctgctgtgacaccgaaacactatgtggtgcgtacgtcgtgggtctttggccaaggtggcaactttgtggaaaccatgcgttcgttggcgcagcgcgggattcgccccaatgtgattagcgaccagcgtggtcgtccaacccatgcagcggatttggcggccggtattgtgcatttgctgcgcagcagcgcagattatggtgtgtacaacctttctaattctggcgatgtggtcggccgcgatgatcttgcccgcgcagtatttgaacactgtggggtatccggtgaggcggtcacatctgttaccacagccgagtacgaggtccacagaggcccgttggccaagcgccccgcggagtcgacgttcaacttggacaagattgtggccacgggttttcaaccgcgcccatggcgggatgctgtgcgggattacttgggcaccaagtag

SEQ ID NO: 49697 - protein, 448 aa, Corynebacterium diphtheriae NCTC 13129
MQVRPTAIAGVVIVDLDLHGDNRGWFKENWQREKMVAAGLPDFQPVQNNISFNAERGVTRGLHAEPWDKFVSVAHGEVFGAWCDLREGSDTFGEVVTCTITPHTAVFVPRGVANGFQALVDNTSYTYLVNDHWSPDATYTAVNLDMIDWPLPPTEISEKDRCHPQLAEATPMPPRRILITGAHGQLGRALAELLPDAELCSHVDFDVVHPPQRSWRQYEAIINCAAYNNVDAAEDDRARAWEVNAVAPARLAQIATENNLTLVHVSTDFIFDGTTSVHEETEAPSPLSVYGASKAAGDIAAAVTPKHYVVRTSWVFGQGGNFVETMRSLAQRGIRPNVISDQRGRPTHAADLAAGIVHLLRSSADYGVYNLSNSGDVVGRDDLARAVFEHCGVSGEAVTSVTTAEYEVHRGPLAKRPAESTFNLDKIVATGFQPRPWRDAVRDYLGTK

SEQ ID NO: 49698 - DNA, 894 bp, Rhodopseudomonas palustris CGA009
  CDS (1)..(894): transl_table=11
gtgcggatcgtcgtcaccggtcgtcacgggcaggtcgcgcaggcgctctacgagcgcgccgccggaaccaatgccgagatcgtcctgctgtcccggccggagattgacctgacgcgccagagcgacatcgaaacagcattgagcgcagtcaagccggacgcggtcgtcaatgctgcggcctacacggccgttgatcaggccgagagtgagcccgacctcgcttatgcgatcaacgccgagggtgcgggcgccgtggctcgcgcggccgcgaagctcggtgtgccgatggtgcagctgtcgaccgactacgtgttcgacggcaccgccgagcagccgtatcgcgagaccgatccgaccaacccgctcagcgtctatggcgccagcaagctggccggcgagcgggcggtggcgaaagccacacccgatcatgcggtgttgcggacctcctgggtgtatagcccgttcggcaagaatttcgtccgcaccatgctggccctggcccggcagcgcgatgaggtgcgggtggtctgggatcaggtcggctccccgaccagcgcgctcgatatcgccgacggtgtgctgggcgtcgtccggaatctgctggcggagccaacacgttccgatctgcggggcatcttccacatgactgcggacgggaccgccacatgggcagcgttcgccgaagcgattttcgccgcatcacgagcagccggcggaccatccgcgaaagtgatcccgattccgaccaccgagtacccgacccccgccaagcggccgacgaattccaggctcgacagctcggcgctcgccgccgctcacggcattcgcctgccgcactggcggcaatcgctgcagccgtgtatcgagcggctgctagcgcaggacgcgaactga

SEQ ID NO: 49699 - protein, 297 aa, Rhodopseudomonas palustris CGA009
MRIVVTGRHGQVAQALYERAAGTNAEIVLLSRPEIDLTRQSDIETALSAVKPDAVVNAAAYTAVDQAESEPDLAYAINAEGAGAVARAAAKLGVPMVQLSTDYVFDGTAEQPYRETDPTNPLSVYGASKLAGERAVAKATPDHAVLRTSWVYSPFGKNFVRTMLALARQRDEVRVVWDQVGSPTSALDIADGVLGVVRNLLAEPTRSDLRGIFHMTADGTATWAAFAEAIFAASRAAGGPSAKVIPIPTTEYPTPAKRPTNSRLDSSALAAAHGIRLPHWRQSLQPCIERLLAQDAN

SEQ ID NO: 49700 - DNA, 843 bp, Geobacter sulfurreducens PCA
  CDS (1)..(843): transl_table=11
atgatcctggtggtcggtgccaagggaatgctcggccgcgacctcatgcgggtgctgccgggggacgtgcggggggtcgatatcgaagagatcgacattacctcgccggaatcggtacggcgggtcattctgaccctgaagccgcgggtggtggtgaactgtgccgcctacaccgatgtggacggctgcgagaccaacgcggaccttgccatggcggtgaacggcgagggggtggggcacctggccgccgtgacccgcgagatcggggcgctgctcgttcagatgagcaccgattacgtgttcgacggcgtcaaggagagcccgtttctggaggatgatccgcccaatcccctgagcgtgtacggcagatcgaagcttatgggcgaggaacaggcccgtgaaacccccgatcacctcatcgtccggacccagtggctctatgggctcggcggcaagaacttcgtggaaaccatgctgcgcctgtcgacggagcggagcgaaatcgccgtggtggacgaccagatcggctcccccacctggacagtggaccttgccctggccatcagcgaactgatagagaacaactgccgcggcacctatcatgcggccaacagggggatctgttcctggttcgatttcgcccgcgccatttttgccgaagcaggagtggagatgaccgtccggccccagaccaccgcccaactgggccggccggccccgcgtcccctctattcggctctctgctgcgacaagttgacccgggacacggggctcgaactggaaggctggcgcgaggcacttgccacctatttggaaaagcggcgcgaagccggattgtcctga

SEQ ID NO: 49701 - protein, 280 aa, Geobacter sulfurreducens PCA
MILVVGAKGMLGRDLMRVLPGDVRGVDIEEIDITSPESVRRVILTLKPRVVVNCAAYTDVDGCETNADLAMAVNGEGVGHLAAVTREIGALLVQMSTDYVFDGVKESPFLEDDPPNPLSVYGRSKLMGEEQARETPDHLIVRTQWLYGLGGKNFVETMLRLSTERSEIAVVDDQIGSPTWTVDLALAISELIENNCRGTYHAANRGICSWFDFARAIFAEAGVEMTVRPQTTAQLGRPAPRPLYSALCCDKLTRDTGLELEGWREALATYLEKRREAGLS

SEQ ID NO: 49702 - DNA, 924 bp, Mycobacterium avium subsp. paratuberculosis K-10
  CDS (1)..(924): transl_table=11
atgtcaggcaggatcgtgatcgccggcgccggtgggcagctgggcggctatttgagcgcgctggcggctggtcagggccgtgacgtggtggcgctgacgtccgcgcagtgggacatcaccgacccggcggcggccgaacacatcgtgcggcccggcgacgtggtgatcaactgcgcggcctacaccgacgtcgacggcgccgagagcgacgaggcgggcgccttcgcggtcaacgaggccggccccgggcatatcgcgcgggcctgcgcgcgcgccggcgcccggctgctccacgtctccaccgactacgtgttcggcggcgagtccccggccggtgccccggaccggccgcgcccctacgagcccggcgaccccgtcgccccgcagggcgtgtacgcccgcagcaaggtcgcgggggagcgggcagtgctggcggcgctgccggatcccgcgcagggcgtcgtggtgcgcaccgcctgggtctacaccggcggcaccggcaaggacttcgtcgccgtcatgcgccggctggccgcgggggagggcccggtgcaggtggtcgacgaccagatcgggtcgccgacctacgtcggcgacctggcggccgcgttgctgcagatcgtcgacgaccgggtgcccgggccggtcctgcacgccgccaatgagggcgcggtgtcccgcttcgagcaggcccgcgcggtcttcgaggaatgcggcgccgacccggcgcgggtgcggccggtgggcaccgagcactttccccggccggcgccgcggccgacctactcggcgctgggcagccgcgagtccgccgcggccgggctgcgcccgctaaggccctggcgccctgcgcttgtcgccgcgctcaccaacgctggtagcccggccgcggcggatcgaccgttaccctctacgcgtgactga

SEQ ID NO: 49703 - protein, 307 aa, Mycobacterium avium subsp. paratuberculosis K-10
MSGRIVIAGAGGQLGGYLSALAAGQGRDVVALTSAQWDITDPAAAEHIVRPGDVVINCAAYTDVDGAESDEAGAFAVNEAGPGHIARACARAGARLLHVSTDYVFGGESPAGAPDRPRPYEPGDPVAPQGVYARSKVAGERAVLAALPDPAQGVVVRTAWVYTGGTGKDFVAVMRRLAAGEGPVQVVDDQIGSPTYVGDLAAALLQIVDDRVPGPVLHAANEGAVSRFEQARAVFEECGADPARVRPVGTEHFPRPAPRPTYSALGSRESAAAGLRPLRPWRPALVAALTNAGSPAAADRPLPSTRD

SEQ ID NO: 49704 - DNA, 987 bp, Lactobacillus johnsonii NCC 533
  CDS (1)..(987): transl_table=11
atgaaagtttttgtaactggcgttaatggtcaacttggccatgacgtaatgaatgaacttgctaaacgtggctatgaaggtgtgggatcagacttagcacctgaatatgccggtgtagctgacggcaccgctgtgactaaggctccatacgtttccttagatattactgatgcagacgcagtagacaaggttatttctgaagtaaagccagatgttattgttcactgtgctgcttggactgcagttgacatggctgaagatgatgataaggtagctgctgttcgtaaagttaacgttgatggaactcaaaacatcgctaatgttgctaaaaagctagatgctccaatggtttacttatcaactgactacgtctttgatggtcaaggaactactccttgggaacctgactttaagggttacaagccattaaatgtttacggtgaaactaagcttggtggagaagaagctgttgctaataccttggacaagtacttcatcgttcgtattgcttgggtatttggtgtaaatggttctaactttattaagacaatgcttaaagttggttcaaaccatgaggaagttaaggttgttagcgaccaagtaggtacaccaacctatacttttgatttagctcgtttattggtagacatgattgaaactgataagtacggctactaccatgcaactaatgcggaattgccagcaagtgaaggcgaccatgacgaaaatggtactaagactggctatatttcttggtacgatttcactaaagaaatctatcgtcaagcaggctacaagactagggtaactcctgtaactacggaagaatacggcttatcaaaggctgttcgtccatttaactcacgccttgacaagagtaagttagaagaaaacggctttaagccacttccaacttggccagatgctatcagtcgctacttagatattttaaaggccgacggcttctttgatgagttagggaagtaa

SEQ ID NO: 49705 - protein, 328 aa, Lactobacillus johnsonii NCC 533
MKVFVTGVNGQLGHDVMNELAKRGYEGVGSDLAPEYAGVADGTAVTKAPYVSLDITDADAVDKVISEVKPDVIVHCAAWTAVDMAEDDDKVAAVRKVNVDGTQNIANVAKKLDAPMVYLSTDYVFDGQGTTPWEPDFKGYKPLNVYGETKLGGEEAVANTLDKYFIVRIAWVFGVNGSNFIKTMLKVGSNHEEVKVVSDQVGTPTYTFDLARLLVDMIETDKYGYYHATNAELPASEGDHDENGTKTGYISWYDFTKEIYRQAGYKTRVTPVTTEEYGLSKAVRPFNSRLDKSKLEENGFKPLPTWPDAISRYLDILKADGFFDELGK

SEQ ID NO: 49706 - DNA, 921 bp, Leptospira interrogans serovar Copenhageni str. Fiocruz L1-130
  CDS (1)..(921): transl_table=11
atgatttattatactggaaaaaacggtcagttaggttgggaattggccgaaagatttaaatctaatggattggaagcagtaggatttggtagggaagaatgggatcttgcagatcttgattctgccgcacgaattttgaaggattctcctcggattttagttcattgtggagcttatactgcggtagataaggcagagtccgactcagagaacgcttacaaaatcaattcgttatctgtaaaaaaaatttcggaagaatgtctaaaaagaaaaatccatttaatttatatatccactgattttgtgtttgatgcaaattcggaaacgatcggtgatacgattcgtttttggaaaccggattctacactttctccgaaaggaatctacggattgtcaaaggcggaaggggaaaagtggattcgaaatacgtttgcgaattctaaacaagcaaatatagttcgtaccagttgggtatattcctctcatggaaataattttccaaaaacaattgtgaaacttttacaagattccaatcgtcatgaattaagagtgatcgaagatcaattgggaagacctacttgggctggtaggcttgcggattttataatattcttaatttatggaattctaaaaggagaatcttatcctgagattctacatttttctaactcaggagttgcgagctggtacgattttgcacttgcggttcgggatttttcacattctttttcattgatagaaaatttgaagccgatttatccaattcctacggaaggttatccaacacctgcacctaggcctagatattcaattttagatttagaagaaactcgaaaaatttttggcgttgttccgcattggagagaggatttaaccctttgtctgaaagaacttgccgaagtttccggaaaaaaagtatga

SEQ ID NO: 49707 - protein, 306 aa, Leptospira interrogans serovar Copenhageni str. Fiocruz L1-130
MIYYTGKNGQLGWELAERFKSNGLEAVGFGREEWDLADLDSAARILKDSPRILVHCGAYTAVDKAESDSENAYKINSLSVKKISEECLKRKIHLIYISTDFVFDANSETIGDTIRFWKPDSTLSPKGIYGLSKAEGEKWIRNTFANSKQANIVRTSWVYSSHGNNFPKTIVKLLQDSNRHELRVIEDQLGRPTWAGRLADFIIFLIYGILKGESYPEILHFSNSGVASWYDFALAVRDFSHSFSLIENLKPIYPIPTEGYPTPAPRPRYSILDLEETRKIFGVVPHWREDLTLCLKELAEVSGKKV

SEQ ID NO: 49708 - DNA, 885 bp, Parachlamydia sp. UWE25
  CDS (1)..(885): transl_table=11
atgaaaaagatttgggtatgtggcgcatcgggtatgcttggttctcatttcaaacgtttattaaacaaacggcaactgtcttttgttgccaatgatgataaaaaaattgatattaccaatttagaagccgttttagattttgtaagaacagaacaaatcactcatatcatcaattgtgcggcttacacaaaagttgataaagctgaaacagatctcaaacaagcttatctcgtcaatgcctgtggaccacaccatcttggaattgcagctcggcaccagaatgcgcatgtcattcatttctcgactgattatgtgtttgatggaaaagagaacttgccttataccgaagaacatgcttgcgctcccattggagcttatgggataagtaaattagctggagaaatcaaactcttagatgaatttgatcgctcttgtgtcattcgcacatcttggttatttggcttaccaggcaaaaattttgttgaaacaatgttaagattgatgaatgaaaaagcacagatcaagattgtttgcgatcagatgggaagaccgacttatgcgcaagatttagctgaagttgctttacaatttttggataagtcgggaatttatcactttgctaactcttctgaaactaactggtatgagtttgctaaagagatttatagacaaggaaaggaatttcaattgattcaaagggattgtcaaatagaacctattatgactcatgaatatccgacacaggccaaacgacctgcttattctactttaaatactcaaaaaatagagtctgtgcttagatggaaaccacgtccctggcaagaggcattaaaagattatttgacgatatataaaaatttccaagataggcaacaggtgagctaa

SEQ ID NO: 49709 - protein, 294 aa, Parachlamydia sp. UWE25
MKKIWVCGASGMLGSHFKRLLNKRQLSFVANDDKKIDITNLEAVLDFVRTEQITHIINCAAYTKVDKAETDLKQAYLVNACGPHHLGIAARHQNAHVIHFSTDYVFDGKENLPYTEEHACAPIGAYGISKLAGEIKLLDEFDRSCVIRTSWLFGLPGKNFVETMLRLMNEKAQIKIVCDQMGRPTYAQDLAEVALQFLDKSGIYHFANSSETNWYEFAKEIYRQGKEFQLIQRDCQIEPIMTHEYPTQAKRPAYSTLNTQKIESVLRWKPRPWQEALKDYLTIYKNFQDRQQVS

SEQ ID NO: 49710 - DNA, 876 bp, Desulfovibrio vulgaris subsp. vulgaris str. Hildenborough
  CDS (1)..(876): transl_table=11
atgaccgcgcggccgcgtgcggtcgtactggggggacgcaccgggcttctggggcagtccctcgtgcttgcgttgcgaaacggcggctgggatgccgtgcccgtcggacgcgacgatgtcgacgtccttgacgcagaacgcctggccgacttcatcgacaaggcttcgccacaagcggtcttcaacaccgtggcgtggacgcaggtcgaccttgcagaagagcatgagcaggaagccgcccaactgaaccgggcgctgcccgcctctcttggacgcatcgttcgtggtaccggcatgcaccttgtgcatctgagcaccgacttcgtgttcaacggacgcaagacgacgccctactccaccgacgacacccccgacccggcttcagtctacggggcgaccaaactggctggcgaaaccgccctcctgtccatcgcccccgacaactgctgcgtcgtccgcaccgcatggctgttcggtcccggcagacgcaacttcgttcagaccattctgggactgtgcgccgccaaggacgacatacaggtggtgcacgaccagacggggtcgccgacctacacggtggaccttgccgccggttgtgtacgccttgccgaattgcgggcaacgggtcttttccatgtggtcaacgcagggcaggcaagctggtgcgaactggcctccgaagccgtgcatctggcgggcctgcactgcaaggtgcacgccatcacttccaaggactggcctcagaaggccgcccgccctgcctactccgtactcgacacgtcacgtttcacagaagtcaccggcatcgtcccccgcccatggccacaggccttgcgggactacatctacaaggattgcatcccctccgggaactga

SEQ ID NO: 49711 - protein, 291 aa, Desulfovibrio vulgaris subsp. vulgaris str. Hildenborough
MTARPRAVVLGGRTGLLGQSLVLALRNGGWDAVPVGRDDVDVLDAERLADFIDKASPQAVFNTVAWTQVDLAEEHEQEAAQLNRALPASLGRIVRGTGMHLVHLSTDFVFNGRKTTPYSTDDTPDPASVYGATKLAGETALLSIAPDNCCVVRTAWLFGPGRRNFVQTILGLCAAKDDIQVVHDQTGSPTYTVDLAAGCVRLAELRATGLFHVVNAGQASWCELASEAVHLAGLHCKVHAITSKDWPQKAARPAYSVLDTSRFTEVTGIVPRPWPQALRDYIYKDCIPSGN

SEQ ID NO: 49712 - DNA, 810 bp, Picrophilus torridus DSM 9790
  CDS (1)..(810): transl_table=11
atgaaaaaaatattgatatttggatcatccggtcagctgggatcgcaattaataaatttattaaaagatgattatgaattaattaaaatatcacacaaagaccttgacttcaataaattctatttaatagaggatataatattaaaaaacaatcctgatattataataaactgtgcagcattaacagacgttgatagatgcgaaatatataagaatgaggcatataatgtaaatgccggggcagtaaggcatataataagaccgttaaaagtaacagagtcatattttataaatatttcaacagattatgtttttaatggcataacaggaaattacagggaagatgatctacctgatccggttaattattatggccttacaaagctccttggtgatatatacgcaaattcttatgataatactttaataataaggacttccggggtatttcttaacaagggatttccggtatttgtttacaaaaatttaatggagaataaaagggtaacagcaattcctggatattattctccaatatcggcgtttaatctggctatggcaataaaagatattataccattgaatagaacaggaatattgaacatagcaggaaataaaatatcaagatatgatcttgctttaagaatatcagagatgtacaatttaaataaaaatatagatgagaataatattgaattgaaagcaaaaagaccatttgattcatctttgaatatagaaagggcaaaaaaattgattaatttcaatttttatgatatagatataaatttaaaacacatggtaataaaatga

SEQ ID NO: 49713 - protein, 269 aa, Picrophilus torridus DSM 9790
MKKILIFGSSGQLGSQLINLLKDDYELIKISHKDLDFNKFYLIEDIILKNNPDIIINCAALTDVDRCEIYKNEAYNVNAGAVRHIIRPLKVTESYFINISTDYVFNGITGNYREDDLPDPVNYYGLTKLLGDIYANSYDNTLIIRTSGVFLNKGFPVFVYKNLMENKRVTAIPGYYSPISAFNLAMAIKDIIPLNRTGILNIAGNKISRYDLALRISEMYNLNKNIDENNIELKAKRPFDSSLNIERAKKLINFNFYDIDINLKHMVIK

SEQ ID NO: 49714 - DNA, 909 bp, Acinetobacter sp. ADP1
  CDS (1)..(909): transl_table=11
atgaaaatactgatattgggcaaaaatggacaagtcggctgggaattacaacgatcgcttcagcccttaggtgaagttattgctttagatcgatatgaagatgttgagcatggctttagtggtgatatcacaaattttgaagccattgaaaaagtgatacaaacattccaacctgatattgtgctcaatgcaactgcatatacggcggttgataaagcagagtcagaggttgaacaggccgatttggtcaatcatattgctgtgaagcatttggccgagcaatgcaaagcaatagatgctttactcatacattattctacagattatgtatttaatgggcagggcacagcagcttggcaggaagatgatacgacagaacctcaaaatgcgtatggaaaaaccaaacgaaatggtgagattgcgcttgaacaaagtcaggtaaagtttatcaatttacgtacaagctgggtgtatgcttcacgtggtcataactttataaaaaccatgcttaagctggctcaaagtaaagatgaacttagcattattgatgatcagattggtgcacctactggcgcagctttaattgcagatgtgacagcacaaattgttcgttattatgctttgcagccacaacttcagcaaaagcatttgctcggtcattatcatttggccgctcagggtgagacatcttggtatgcttatgcaaattatatctttgatgttgccaaagcacatggattagcacttcagcttaaaacagtgaagccaatatcgacagttgattatcctacaccagcagttcgaccgctcaactcaagattaaatactcagaaactccaacaaatgtttgctttacaccttcctcaatggcagcaaggtgttgagcatatgattaaagagaccctataa

SEQ ID NO: 49715 - protein, 302 aa, Acinetobacter sp. ADP1
MKILILGKNGQVGWELQRSLQPLGEVIALDRYEDVEHGFSGDITNFEAIEKVIQTFQPDIVLNATAYTAVDKAESEVEQADLVNHIAVKHLAEQCKAIDALLIHYSTDYVFNGQGTAAWQEDDTTEPQNAYGKTKRNGEIALEQSQVKFINLRTSWVYASRGHNFIKTMLKLAQSKDELSIIDDQIGAPTGAALIADVTAQIVRYYALQPQLQQKHLLGHYHLAAQGETSWYAYANYIFDVAKAHGLALQLKTVKPISTVDYPTPAVRPLNSRLNTQKLQQMFALHLPQWQQGVEHMIKETL

SEQ ID NO: 49716 - DNA, 852 bp, Erwinia carotovora subsp. atroseptica SCRI1043
  CDS (1)..(852): transl_table=11
atgaaaatattactgacgggtgcaaatgggcaattgggtcgctgttttcaggatcgtcttcccacccactggcaaatatggtcaacggatgctaacgaacttgatatcactgatttaacgcagattgaagcggctatagcacgctatcaaccagacgcgattgttaatgcggcagcctatacagccgttgataaagcagaatcagaatcagtattagcagaaaagataaatgttaccggtccccataatttggctaccgtagcacatcaaaagggaatccgattagtccacgtttcaacggattatgtctttgatggaaatgccacgacgccttatcttgaatccagtaccactaatcccttaagcgtatacggtaaaacaaagttagctggcgagcaggccgtaacgaaagcagcccccgacgccatcatcgttcgtacagcttgggtgttcagtgaatacggtaataatttcgttaagacgatgctgaggctggcaaaagaacgtgacgcattaagtatcgttgccgatcaaaagggatgcccaacttatgcaggggatttagcgcaggcgattatttctcttattgagaaaaatgcggaatgcggaatttatcactattgcggtgataaagaagttagctggtatgaatttgcaaaaaccatttttgaaatggcaaaacagcaagacattatcgataaacagccacagttaactgcaataacaactgagcagtaccctaccccggcccatcggcctcaatactcgtcattatcgtgtgaaaaaatcgcgagattgacaataaaaccatcagactggactgacgcattgtcacaagtcttggcacgttga

SEQ ID NO: 49717 - protein, 283 aa, Erwinia carotovora subsp. atroseptica SCRI1043
MKILLTGANGQLGRCFQDRLPTHWQIWSTDANELDITDLTQIEAAIARYQPDAIVNAAAYTAVDKAESESVLAEKINVTGPHNLATVAHQKGIRLVHVSTDYVFDGNATTPYLESSTTNPLSVYGKTKLAGEQAVTKAAPDAIIVRTAWVFSEYGNNFVKTMLRLAKERDALSIVADQKGCPTYAGDLAQAIISLIEKNAECGIYHYCGDKEVSWYEFAKTIFEMAKQQDIIDKQPQLTAITTEQYPTPAHRPQYSSLSCEKIARLTIKPSDWTDALSQVLAR

SEQ ID NO: 49718 - DNA, 855 bp, Streptococcus pyogenes MGAS10394
  CDS (1)..(855): transl_table=11
atgattttaattacaggaagcaatggtcaattagggacagaacttcgatacttattagatgaacgaggtgttgattatgtagccgttgatgtcgcagaaatggacatcacaaatgaagacaaagtcgaagctgtttttgcgcaggtcaagccaacattggtctatcattgtgctgcttatacggcagttgatgcagcagaagacgaaggaaaagccttgaatgaggctattaatgtaacaggctcagaaaatattgccaaggcttgtggaaaatatggggctacccttgtttacatttcaacagactacgtatttgatggcaataaaccagtcggtcaagaatgggtagaaacagatcgtccagaccctaagacagaatatggccgtacaaaacgtttaggagaactagctgttgaacgatacgcagagcatttttatattatccgtactgcttgggtatttggaaattatggtaaaaactttgtctttaccatggagcagttagcggaaaatcactcccgtttgactgttgtcaatgaccaacacggtcggccaacgtggacaagaaccttggcagaattcatgtgttatttgacagagaatcaaaaagcctttggttactatcacttgtcaaatgatgctaaggaagacaccacttggtatgattttgccaaagaaatcttaaaagacaaggctgttgaagtggtgccagttgattcatcagctttcccagcaaaagccaaacgtcctttaaattcaaccatgaatcttgataaggcaaaagcgacagggtttgttattccaacatggcaagaagccttgaaggcattttaccaacaaggactgaaaaagtaa

SEQ ID NO: 49719 - protein, 284 aa, Streptococcus pyogenes MGAS10394
MILITGSNGQLGTELRYLLDERGVDYVAVDVAEMDITNEDKVEAVFAQVKPTLVYHCAAYTAVDAAEDEGKALNEAINVTGSENIAKACGKYGATLVYISTDYVFDGNKPVGQEWVETDRPDPKTEYGRTKRLGELAVERYAEHFYIIRTAWVFGNYGKNFVFTMEQLAENHSRLTVVNDQHGRPTWTRTLAEFMCYLTENQKAFGYYHLSNDAKEDTTWYDFAKEILKDKAVEVVPVDSSAFPAKAKRPLNSTMNLDKAKATGFVIPTWQEALKAFYQQGLKK

SEQ ID NO: 49720 - DNA, 888 bp, Leifsonia xyli subsp. xyli str. CTCB07
  CDS (1)..(888): transl_table=11
atggcgcgctatctgatcgccggagcccacggccagctcggccaggacctccagcgtgcgctggccggccgagaggtgaccgccctcggccgcgccgatctcgacgtcacggaccgtgacaccgttctggccgccgtcgcgggccacgacgtggtcatcaacgcctccgcctacacgaaggtggatgacgccgagacccacgaggacgacgcctacgcgatcaacgcgaccggcaccgagaacctcgccgtggccgcggcgcaacacggcgcgacgtttgtgacggtctccaccgactacgtcttcgacgggtctggcgccgagccctacgccgaggacgccccgcgcgacccgatcaacgcctacggccgaaccaaagccgccggcgaagagctcgcgctggccacgcatcccggcggcacctacatcgtccgcaccgcgtggctgtacggcgcgggcggcgcgaacttcgccaagacgatggtgagactcgccgagagccacgaaacggtgagcgtcgtggccgaccagatcggccagccgacctggaccggcgacctggccgagcggatcgtgacgctcctcgactcggacgcgccccccggggtgtaccacggcacgaactccggccaggcgagctggttcgcgttcgccaaggcggtcttcagcgccgccgggctggaccctgatagggtccttccgaccgacagcgccgcgttcacccgaccggctccccggccgtcctactcagtgctgggtcacgagggctggaggcgcgccggcctgaaacccatgcggccgtgggaagaagcgctggccgacgcagcacaacatggagtcctggatcaggagcggaatgacgacgacactcagggtggtggtcgatga

SEQ ID NO: 49721 - protein, 295 aa, Leifsonia xyli subsp. xyli str. CTCB07
MARYLIAGAHGQLGQDLQRALAGREVTALGRADLDVTDRDTVLAAVAGHDVVINASAYTKVDDAETHEDDAYAINATGTENLAVAAAQHGATFVTVSTDYVFDGSGAEPYAEDAPRDPINAYGRTKAAGEELALATHPGGTYIVRTAWLYGAGGANFAKTMVRLAESHETVSVVADQIGQPTWTGDLAERIVTLLDSDAPPGVYHGTNSGQASWFAFAKAVFSAAGLDPDRVLPTDSAAFTRPAPRPSYSVLGHEGWRRAGLKPMRPWEEALADAAQHGVLDQERNDDDTQGGGR

SEQ ID NO: 49722 - DNA, 855 bp, Bacillus cereus E33L
  CDS (1)..(855): transl_table=11
atgaaagaacggattatcataacaggagcaaatggtcaattaggaaagcagctacaagaagagttaaatcctgaagaatatgacatatatccatttgataaaaagttgttagatataacaaatatatcccgagtgcagcaagtggtacaagaaataaggccacatatcattattcattgtgcagcgtatacgaaggttgatcaagctgagaaagagcgagatcttgcttatgtaataaatgcaataggggctcgaaatgtagcggttgcttcacaattagttggggcgaagttagtttatattagtacggattatgtatttcaaggcgacagaccggaggggtacgatgaatttcataatccggcgccgatcaatatatacggggcttctaaatatgcgggagagcagttcgtcaaagagttacataataaatactttatcgttcgtacatcgtggttatatggtaagtatggaaataattttgtgaaaacgatgatacgattagggaaagaaagagaagaaatatctgttgtagcggatcaaatcggttctcctacgtatgtggcggatttaaatgtgatgattaataagctcattcatacttctttatacggtacgtatcacgtatccaatacaggatcatgttcttggtttggatttgcaaagaaaatattttcgtatgcaaatatgaaggtgaatgtgttacctgtttcaaccgaagaatttggggctgtagcagcaaggccgaaatattctattttccaacataacatgctacgattaaatggttttttgcaaatgccttcttgggaagaaggattagagcgtttttttatagaaaccaaaagtcattaa

SEQ ID NO: 49723 - protein, 284 aa, Bacillus cereus E33L
MKERIIITGANGQLGKQLQEELNPEEYDIYPFDKKLLDITNISRVQQVVQEIRPHIIIHCAAYTKVDQAEKERDLAYVINAIGARNVAVASQLVGAKLVYISTDYVFQGDRPEGYDEFHNPAPINIYGASKYAGEQFVKELHNKYFIVRTSWLYGKYGNNFVKTMIRLGKEREEISVVADQIGSPTYVADLNVMINKLIHTSLYGTYHVSNTGSCSWFGFAKKIFSYANMKVNVLPVSTEEFGAVAARPKYSIFQHNMLRLNGFLQMPSWEEGLERFFIETKSH

SEQ ID NO: 49724 - DNA, 885 bp, Legionella pneumophila subsp. pneumophila str. Philadelphia 1
  CDS (1)..(885): transl_table=11
atgaaaatattggttacaggtgctaatgggcaagttggtaccgagattatcaagcgattttcttcctctgagcatgaagtatatgcttgtaccagagatattctagattgttccaaactcgaacgggttcatgatgtgttatcggaaatcaagccggatcttatcattaatgcagcagcctatacggctgtagataaggcagaggatgaacctgatttggctcatattgtgaacgccgaatttgtctgtcgcctggtgaattattgtaccttgaaaaacgtccccttgatccatctttcaactgattatgtatttgatggagaaaaggagggagcctatcatgaaaccgatattccgcatccagtaagtacctatgggcgcacgaaatgggaaggagaacaggctattttatcccaacttaaaaagtatattattttgcgagttagctgggtatttggtgaacaagggaaaaattttgtaaaaacgattttaaatttggcttccagcagaaaagaattgaatattgtttcagatcaatcgggaaggcctacttcagctcgcgatatagcaagagtactatttgaaatagtacagaaaatcagacattcttcctttgactattgggggctttaccattatgcagggcagggtgttaccaattggcatgaatttgcaaacgtatttcttaatatggcaaaagagaaacagcttctcttaactttaaccgatttaaatccaattaagtcacaagaatatcctactagggcaacaaggcctaaaaattcggtactggatacaacaaagatagaaacaatattgggtataaaaagctgtagttggaaaaatgatttgccagatgttatcgaccattttacaaaaaagtaa

SEQ ID NO: 49725 - protein, 294 aa, Legionella pneumophila subsp. pneumophila str. Philadelphia 1
MKILVTGANGQVGTEIIKRFSSSEHEVYACTRDILDCSKLERVHDVLSEIKPDLIINAAAYTAVDKAEDEPDLAHIVNAEFVCRLVNYCTLKNVPLIHLSTDYVFDGEKEGAYHETDIPHPVSTYGRTKWEGEQAILSQLKKYIILRVSWVFGEQGKNFVKTILNLASSRKELNIVSDQSGRPTSARDIARVLFEIVQKIRHSSFDYWGLYHYAGQGVTNWHEFANVFLNMAKEKQLLLTLTDLNPIKSQEYPTRATRPKNSVLDTTKIETILGIKSCSWKNDLPDVIDHFTKK

SEQ ID NO: 49726 - DNA, 891 bp, Bacteroides fragilis YCH46
  CDS (1)..(891): transl_table=11
atgaaaaacatattgattatcggtgccaatggatttacggggcgccggatactgaatgacttatcggttaaccctatataccacgtcacaggatgctcgctgagagatgacatttgtcccggcaaagattatcgcttcgtacgtaccgatatccgagacgaaaatgaagtacggaaattatttaaagaatgccggccggatatcgtaatcaacacctctgccctttcggtaccggactattgcgaaacccatcatgcagaagctgaagctacaaatgttacagcagtcgaaacgatagcacatgtttgcgaacagtatggcagccgtttcatccatctttccacggactttgtatttgacggtaaaagtacccggctctacaaggaagaagatgaagcgattccggtgaattattacggtgttacgaaactgaaagccgaaaagattatagccagcatttgtagtaattatgccatagtacgtgtagtcgtcgtttatggaaaagcccttccgggacagcatggcaacatccttcagctagtagccaaccggttgagaaacggagaaacgatccgtgtcgtatccgatcaatggcgtacaccgacctttgttggagatatttcagtaggagtagaaaagctgatgtttcatacagccaacggcatctatcatatttgcggcagcgaatgcctcacaattgccgaaatcgcctaccgggtggctgattttctgaaactggatcgttcattgatcgaacccgtcactaccgaggaaatgaaagagactactccccgcccgcgtttcagcggattaagtatcgaaaaggctaaagccgaaatcgggtacactccgcgcacattggaagaaggtatggaggcttctttgttctaa

SEQ ID NO: 49727 - protein, 296 aa, Bacteroides fragilis YCH46
MKNILIIGANGFTGRRILNDLSVNPIYHVTGCSLRDDICPGKDYRFVRTDIRDENEVRKLFKECRPDIVINTSALSVPDYCETHHAEAEATNVTAVETIAHVCEQYGSRFIHLSTDFVFDGKSTRLYKEEDEAIPVNYYGVTKLKAEKIIASICSNYAIVRVVVVYGKALPGQHGNILQLVANRLRNGETIRVVSDQWRTPTFVGDISVGVEKLMFHTANGIYHICGSECLTIAEIAYRVADFLKLDRSLIEPVTTEEMKETTPRPRFSGLSIEKAKAEIGYTPRTLEEGMEASLF

SEQ ID NO: 49728 - DNA, 897 bp, Burkholderia mallei ATCC 23344
  CDS (1)..(897): transl_table=11
atgaagattttggtgacgggggcaaacggccaagtgggctgggaactcgctcggagtctggcggtattggggcaagttgtcccgctcacgcgtgagcaggccgatctcggccgccccgaaacgcttgctcgaattgttgaggacgcgaagccggatgtcgtcgtcaatgctgcggcatatacggcggtcgatgctgcggaaaccgatggtgctgcagcgaatgtgatcaacggtgaggcggtaggtgtgctggccgccgcgacgaagcgtgtcggcggcttgttcgttcattactcgacggactacgtttttgacggcaccaagccgtcgccatacatcgagacggatccgacgtgtcccgtcaatgcctacggcgccagcaagttgctgggagagttggcggttgcggagaccggcggcgactggctgacgtttcgcaccacgtgggtgttcgccgcacgcggcaagaacttcctgcgaacgatgcttcgtcttgccaaggagcgcgaagagatgaagatcgtggccgatcagttcggcgcgccgacctgggcgcgatcgattgctgacggcacggcccacgcgctcacgaccgcgatgcgtgaacgcgcggcaggcgcgttcacgtccggcgtctatcacatgacatccgcggggcagacttcatggcacggtttcgcggacgcgatcatcgcatcctggcgagcggctccgggggcggcaccgctcgccgtcagccggatcgtgccgattccggcgagcgcctatcccgtgccggcacagcgcccggcaaactcggtactgtcgaacaaggcgctgaaagagcgtttcggtatcgaactgcctgattggcggtatgcagtagggctgtgcgtcaacgatctgctttcccaatga

SEQ ID NO: 49729 - protein, 298 aa, Burkholderia mallei ATCC 23344
MKILVTGANGQVGWELARSLAVLGQVVPLTREQADLGRPETLARIVEDAKPDVVVNAAAYTAVDAAETDGAAANVINGEAVGVLAAATKRVGGLFVHYSTDYVFDGTKPSPYIETDPTCPVNAYGASKLLGELAVAETGGDWLTFRTTWVFAARGKNFLRTMLRLAKEREEMKIVADQFGAPTWARSIADGTAHALTTAMRERAAGAFTSGVYHMTSAGQTSWHGFADAIIASWRAAPGAAPLAVSRIVPIPASAYPVPAQRPANSVLSNKALKERFGIELPDWRYAVGLCVNDLLSQ

SEQ ID NO: 49730 - DNA, 906 bp, Methylococcus capsulatus str. Bath
  CDS (1)..(906): transl_table=11
atgaagatcctcgtcgtcggcaggagcgggcaactggcctgggaactgcggcgcacgctggcctgtttcggcgaggtcgtcgcgctcgatcgccagtcggaaccggcgatcgatctggccgagcccggtgccgttgccgccttggtgcgcgccgtcaggcccgatctgatcgtcaacgcggcagcctataccgcggtcgatcgggccgagcaggagccggatttggcctggaaggtgaacgccgaggcgccggctgtgctggcagcggaagcgacgcgtctgggcataggcctgatccattattcgaccgactacgtttttcccggtgacggcgctgtgccgtaccgggaggacgacccggttggtccgcggaacgtgtatggccgcagcaaactggccggggagcaggccatcgctgcatccggcgccgctcacctcattctccgcaccgcctgggtctatggggtgcgcggccagaacttcctgaggaccatgttgcggctcatggccgagcgcgaggtggtgcgggtcatcgacgatcagttcggagctcccacctgggttcggatgatcgccgaggcgacggcgattctggtggcgagctcactgcgttccggcacggccgatttggcgggggcgagcggtgtctaccatctcacctgcagcggccagaccagctggtacggcttcgcctgcgccatccgggagcatgccgtggccgccggattgctccccgacactgcggcccgggtcgaggccatcccgacttcggaatatcccactccggccaagcggccggctcattcggtgctggatttgggcaagctcgaggcgcgcttcggcatcgtgctccccgtttgggaccaggcgctggagctttgtttggccgatctggccggtcggtga

SEQ ID NO: 49731 - protein, 301 aa, Methylococcus capsulatus str. Bath
MKILVVGRSGQLAWELRRTLACFGEVVALDRQSEPAIDLAEPGAVAALVRAVRPDLIVNAAAYTAVDRAEQEPDLAWKVNAEAPAVLAAEATRLGIGLIHYSTDYVFPGDGAVPYREDDPVGPRNVYGRSKLAGEQAIAASGAAHLILRTAWVYGVRGQNFLRTMLRLMAEREVVRVIDDQFGAPTWVRMIAEATAILVASSLRSGTADLAGASGVYHLTCSGQTSWYGFACAIREHAVAAGLLPDTAARVEAIPTSEYPTPAKRPAHSVLDLGKLEARFGIVLPVWDQALELCLADLAGR

SEQ ID NO: 49732 - DNA, 858 bp, Nocardia farcinica IFM 10152
  CDS (1)..(858): transl_table=11
gtgaccgacgccgtaccgcaccgttcgcccgcccgtctcgtcgtcaccggcgcggccgggcaggtcggccgccacctgatgcgcctggccccgcacgcgcgcggatacgaccgcgcgcacctcgacatcaccgacgccgacgccgtccgcgccgtcgtccacccgggggatgtggtgatcaactgcgccgcctacaccgccgtcgacaaggccgagaccgaacccgacgccgccttcgccgtcaacgggaccggtccggccgtgctggcgtcggcctgcgcacgcgcgggcgcccgactcatccatctgtccaccgactacgtcttcgggggtacccacaccgacccgtacgaacccacggatccgaccgccccggcctcggcgtacgggcgctccaagctggcgggggagcgggcggtgctcgacctggcccccgccgcgcacgtggtgcgcaccgcctgggtctacaccggcgaccggggcgatttcgtcgccaccatgcgccgcttcgccgccgaacgccccaccgtcgacgtggtcgacgaccagatcggatcgcccacctacgccgccgacctggccgcgggcctgctcgaactcgccgccaccccggcggcgccgccgctgctgcacgccaccaacgccgggacggcgagctggttcgagctggcgcgggcggtgttcgccgagatcggcgccgatcccgagcgggtgcggccgtgcgcgtcctcggccttcccgcggcccgcgccgcggccggcctactcggtgctgtcgaaccgggcctgggtcgcggccggtctgaccccgctgcgaccctggcgggcggcactgcacgaggcgttgggcaaccgctga

SEQ ID NO: 49733 - protein, 285 aa, Nocardia farcinica IFM 10152
MTDAVPHRSPARLVVTGAAGQVGRHLMRLAPHARGYDRAHLDITDADAVRAVVHPGDVVINCAAYTAVDKAETEPDAAFAVNGTGPAVLASACARAGARLIHLSTDYVFGGTHTDPYEPTDPTAPASAYGRSKLAGERAVLDLAPAAHVVRTAWVYTGDRGDFVATMRRFAAERPTVDVVDDQIGSPTYAADLAAGLLELAATPAAPPLLHATNAGTASWFELARAVFAEIGADPERVRPCASSAFPRPAPRPAYSVLSNRAWVAAGLTPLRPWRAALHEALGNR

SEQ ID NO: 49734 - DNA, 885 bp, Legionella pneumophila str. Lens
  CDS (1)..(885): transl_table=11
atgaaaatattggttacaggtgctaatgggcaagttggtaccgagattatcaagcggttttcttcttctgagcatgaagtatctccttgtaccagagatattctagattgtttcaaactcgaacgggttcaagatgtgttatcggaaatcaaaccggatcttatcattaatgcagcggcctatacggctgtagataaggcagaggatgaacctgatttagctcatattgtgaacgccgaatttgtctgtcgcctggtcaattattgtagcttcaaaaacatccccttgatccatctttcaactgattatgtatttgatggagaaaaagagggagcctatcatgaaaccgatattccgcatccagtaagtacctatgggcgtacgaaatgggaaggagaacaagctattttatcccaacttaaaaagtatattattttgcgagttagctgggtatttggtgaacaagggaaaaattttgtaaaaacgattttaaatttggcttccagcagaaaagaattgaatattgtttcagatcaatggggaaggcctacttcagctcgcgatatagcaagagtactatttgaaatagtacagaaaatcagccattcttcctttgactattgggggctttaccattatgcagggcagggggttaccaattggcatgaatttgcaaacgtatttcttaatatggcaaaagagaaacagcttctcttgactttaaccgatttaaatccaattaaatccgaagaatatcctactagggcaacaaggcctaaaaattcggtacttgatacaacaaagatagaaacaatattgggtataaaaagctgtagttggaaaaatgatttgccagatgttatcgaccattttacaaaaaagtaa

SEQ ID NO: 49735 - protein, 294 aa, Legionella pneumophila str. Lens
MKILVTGANGQVGTEIIKRFSSSEHEVSPCTRDILDCFKLERVQDVLSEIKPDLIINAAAYTAVDKAEDEPDLAHIVNAEFVCRLVNYCSFKNIPLIHLSTDYVFDGEKEGAYHETDIPHPVSTYGRTKWEGEQAILSQLKKYIILRVSWVFGEQGKNFVKTILNLASSRKELNIVSDQWGRPTSARDIARVLFEIVQKISHSSFDYWGLYHYAGQGVTNWHEFANVFLNMAKEKQLLLTLTDLNPIKSEEYPTRATRPKNSVLDTTKIETILGIKSCSWKNDLPDVIDHFTKK

SEQ ID NO: 49736 - DNA, 873 bp, Streptococcus thermophilus LMG 18311
  CDS (1)..(873): transl_table=11
ttgaattacgaggagaaaaatatgattctagtaacaggtgcaaatggtcaactcggaactgaacttcgtcaccttcttgacgagcgtaacgaagagtatgtagcagtagatgtggcagaaatggacatcactgatgctgacaaagtagatgaagtgtttgcggaagtaaaaccaaccctggtctatcactgtgctgcctacacagctgttgatgctgctgaagatgaaggcaaagaacttgactatgctattaacgtgactggtactgaaaatgtcgctaaggctgcagaaaaacatggtgcaacgcttgtttatatttcaacggactacgtttttaatggtgaaaaaccagtcggtcaagagtgggaagttgatgataaaccagatccacagacagagtatggtcgtacaaaacgcatgggtgaagagctagttgaaaaacatgtgactaactactacattatccgtacttcctgggtgttcggtaactatggtaaaaattttgtcttcactatgcaaaaccttgctaaaactcacaagacgctgacagtcgttaatgaccaacatggccgtccaacttggacacgtactttggcagagtttatgacttatttagctgaaaaccgtaaggaatacggttactatcacttgtcaaatgatgcagcagaagatacaacttggtatgactttgcggtcgaaatcctcaaagatactgatgttgaagtgaaacctgttgattcaagccaattcccagctaaagctaaacgtcctcttaactcaacaatgagtttggctaaggctaaggcaacaggatttgtcatcccaacatggcaagatgctttgaaagagttttacaaacaagaagtgaaataa

SEQ ID NO: 49737 - protein, 290 aa, Streptococcus thermophilus LMG 18311
MNYEEKNMILVTGANGQLGTELRHLLDERNEEYVAVDVAEMDITDADKVDEVFAEVKPTLVYHCAAYTAVDAAEDEGKELDYAINVTGTENVAKAAEKHGATLVYISTDYVFNGEKPVGQEWEVDDKPDPQTEYGRTKRMGEELVEKHVTNYYIIRTSWVFGNYGKNFVFTMQNLAKTHKTLTVVNDQHGRPTWTRTLAEFMTYLAENRKEYGYYHLSNDAAEDTTWYDFAVEILKDTDVEVKPVDSSQFPAKAKRPLNSTMSLAKAKATGFVIPTWQDALKEFYKQEVK

SEQ ID NO: 49738 - DNA, 897 bp, Azoarcus sp. EbN1
  CDS (1)..(897): transl_table=11
gtgaagctgctggtgaccggcgcgaacggccaggtcgggtgggagctcgcgcgcagcctgatgccgctcggcgacgtaatcgcgctcgaccgcagccgctgcgacctgtcgcggccggctgcgctcgcagcgctggtggacgaactcgagccggacgtcatcatcaacgccgcagcctacaccgcagtcgaccgcgccgagagcgacgaagctgcggcgacgctgatcaacggcgtcgcgccgggcgaactcgcgcgcgtcgcgaagcgcaggggcgcgctgctggtgcattactcgaccgactacgtgttcgacggcacgaaatccgcgccgtacgacgaggacgacccggttgcgccgatcaacgcctatggccgcagcaagctcgccggcgaactggcgatcggcgaaagcggctgtgaccacctgattttccgcacgacctgggtgttcgcggcgcgcgggggcaatttcgtgcgcacgatgctgcgcctgggcgccgagcgcgacagcctgcacgtcgtcgccgatcagatcggcgctccgacctgggcgcgcaacattgccgatgcaacggcgcttgcgctcgcccgggcgcaggcggagcggcagcagcgcagcttctcgtcgggcgtgttcaatctcgcgtcccgcggagagaccagctggcacggttttgccgaggcgattttcgccggcgcgcgagcgcagctgcccggcatcggcctgaaagtcgccgccgtggcgccgattccgtcatccgcctatccgacgccggccgcgcgacccgccaactcgcgcctcgctgcgggcaagctgcaggcgcggttcggcatcgtcatgccgcgatgggacgaggcgctcgcgcgctgcctcgatgaactcgcggggcggtga

SEQ ID NO: 49739 - protein, 298 aa, Azoarcus sp. EbN1
MKLLVTGANGQVGWELARSLMPLGDVIALDRSRCDLSRPAALAALVDELEPDVIINAAAYTAVDRAESDEAAATLINGVAPGELARVAKRRGALLVHYSTDYVFDGTKSAPYDEDDPVAPINAYGRSKLAGELAIGESGCDHLIFRTTWVFAARGGNFVRTMLRLGAERDSLHVVADQIGAPTWARNIADATALALARAQAERQQRSFSSGVFNLASRGETSWHGFAEAIFAGARAQLPGIGLKVAAVAPIPSSAYPTPAARPANSRLAAGKLQARFGIVMPRWDEALARCLDELAGR

SEQ ID NO: 49740 - DNA, 870 bp, Synechococcus elongatus PCC 6301
  CDS (1)..(870): transl_table=11
atgaaggttttactgacaggggctgctggacaggtcgggcaagccctccagcgatcgcatcctgatggggtcgatctgattgcctgcggtcgccagcaactcgatctcagtgacgagtctgcgatccgcgcagccattcagacccttcgtcctgactgggtaattaatgccggtgcttataccactgtcgatcgagcagaatctgagccagccctggcgatagcaatcaacagcaattcagtcagaattctggccgaaagtttggctgaaacgggtggaaatttactgcaaatctcgacagattttgtttttaatggcgatcgcaatcggccttatccaaccgatgctgaacgccagcccttgagcgtctatggcacaaccaaagctgccgctgaagaagcaatcctacagtttctgcccgagcgatcgctgattgtacgcacagcttgggtttatggactaggtggccgcaactttgtcaccacgatgctgcgcttgatggcagaacgcgatcacctcactgtcgtctgggatcaggttgggacacccacctggactgatagtttggccgctgctctttggcaagcgatcgcccagaacctcatgggaattcaccactgcaccgatgccggtgtagccagttggtatgactttgccgtagccattcaagaccttgccctagagctgggattacttcagcaggcagtcccgatcgctgccattcccagcagtgactacccgaccccagccacccgcccggcctatagcgtgctggattgtgccgactttaatcgagcgattggccacgatcccctacactggcgccatgccttggctcaaatgctgacgcaagttgcaaagaaccaatga

SEQ ID NO: 49741 - protein, 289 aa, Synechococcus elongatus PCC 6301
MKVLLTGAAGQVGQALQRSHPDGVDLIACGRQQLDLSDESAIRAAIQTLRPDWVINAGAYTTVDRAESEPALAIAINSNSVRILAESLAETGGNLLQISTDFVFNGDRNRPYPTDAERQPLSVYGTTKAAAEEAILQFLPERSLIVRTAWVYGLGGRNFVTTMLRLMAERDHLTVVWDQVGTPTWTDSLAAALWQAIAQNLMGIHHCTDAGVASWYDFAVAIQDLALELGLLQQAVPIAAIPSSDYPTPATRPAYSVLDCADFNRAIGHDPLHWRHALAQMLTQVAKNQ

SEQ ID NO: 49742 - DNA, 894 bp, Gluconobacter oxydans 621H
  CDS (1)..(894): transl_table=11
atgtccagcacaggtcccattctcgtcacgggcggcaacggccagcttgcgacgtctcttcagaatctcggcaacgagcgcatcatccgcgtcggccgtccggaattcgatttcgaccgcccggaaaccattgccgccacgatcgagaagtacaagccgtcagttgtcgtgaacgcagccgcctggacggccgtcgatctggccgaaacggaaaaggacggtgccgaacgcgccaacaattccggcccggcagcgctcgccgcagcctgcgccaaggcggatatcccgttcatccatgtctcgacagactacgttttttccggtgataagggcacgccctataccgaagaggatgccacctctcccgagacggtctatggcagcaccaaggccgaaggcgaacaggccgtcctgaccgccaacatcaagagcatcatcctgcgcacgtcctgggtctattcggcccacggcaaaaacttcgtgcgcacgatgatcaatgcgggcgccaaaaaccccgtgctcaaggtcgtcggtgaccagaagggcaacccgaccagttcggacgatctggccgaagccattctcgccatcatcgccctgatcgagcgcgatggctggaagccggaatatcgcggcattttccatgccagcggaacgggtgagaccacatggcacggcctggccgtcgccgcgctggaagaggccgcaaagcatggccagaccatgccgcaggtcaacgccatccgcaccgaagactggcctacgccggccaagcgtccgcaggactcccggatggacaattcgaagctccatcgcgtcttcggcgtaaaaatgccggactggcgccacagcgtgacgcatatcgtccacaagctgttttctcctgaagcctga

SEQ ID NO: 49743 - protein, 297 aa, Gluconobacter oxydans 621H
MSSTGPILVTGGNGQLATSLQNLGNERIIRVGRPEFDFDRPETIAATIEKYKPSVVVNAAAWTAVDLAETEKDGAERANNSGPAALAAACAKADIPFIHVSTDYVFSGDKGTPYTEEDATSPETVYGSTKAEGEQAVLTANIKSIILRTSWVYSAHGKNFVRTMINAGAKNPVLKVVGDQKGNPTSSDDLAEAILAIIALIERDGWKPEYRGIFHASGTGETTWHGLAVAALEEAAKHGQTMPQVNAIRTEDWPTPAKRPQDSRMDNSKLHRVFGVKMPDWRHSVTHIVHKLFSPEA

SEQ ID NO: 49744 - DNA, 909 bp, Xanthomonas oryzae pv. oryzae KACC10331
  CDS (1)..(909): transl_table=11
gtgaccacgctggtttttggcgcaaatgggcaggtgggtacggaattgctgcgtgcgctggcagtcgatggcgccgtacaggccaccacgcgtagtggccagttgcccgacggcagcgcgtgtgaaacagcagacttcgatgcgcctgagacgctgaccgcattgctggatcgaatcaagccgtcgcgtgtggtcaatgccgccgcttacacggcggtagatcgtgccgagcaggatcgggaaggtgcgacccgtgccaatgcgacggcacccggcgtcgtcgcagcctggtgcgcgtccaatcgtgtgccgcttgtgcattactccaccgattacgtcttcgacgggcagggtaaagcgccatatcgcgaggacgcgcagacgtcgccactcggcgtgtacggcgaaaccaagcttgccggcgagcaggccatccgtgcctccggcgcccagcatctgatcctgcggactgcttgggtctacgcctcgcatggcgcgaacttcctgcgcacgatgttgcgggtaggggcggagcgggacgagttgcgtgtggtggccgatcagatcggaacaccgacgtcggcggcattgattgccgatgtcactgcacaactgctgcgtcagcgcacgcccgatacatcggggacctggcatctcaccgcggctggccagaccagctggcatggatttgccgaggcaatcttcgaagaggcggtcagtgccgggttgctggagcgtgcaccgcgcgtggtgccgatcacgacggccgattatccgacgccagccaggcgtccggcatattcgcggttgtccatcgatacactgcagggcgatttcggtatcgagctgcctgagtggcgcgttggcctgcagcgtgtgattgccgagctgtctgcgacgaagaagtag

SEQ ID NO: 49745 - protein, 302 aa, Xanthomonas oryzae pv. oryzae KACC10331
MTTLVFGANGQVGTELLRALAVDGAVQATTRSGQLPDGSACETADFDAPETLTALLDRIKPSRVVNAAAYTAVDRAEQDREGATRANATAPGVVAAWCASNRVPLVHYSTDYVFDGQGKAPYREDAQTSPLGVYGETKLAGEQAIRASGAQHLILRTAWVYASHGANFLRTMLRVGAERDELRVVADQIGTPTSAALIADVTAQLLRQRTPDTSGTWHLTAAGQTSWHGFAEAIFEEAVSAGLLERAPRVVPITTADYPTPARRPAYSRLSIDTLQGDFGIELPEWRVGLQRVIAELSATKK

SEQ ID NO: 49746 - DNA, 864 bp, Neisseria gonorrhoeae FA 1090
  CDS (1)..(864): transl_table=11
atgagaatcctattgacaggctcgaaaagccaactggcacactgcctgcgcgaccgtcttcctgaagactgggaaaccattgcgacggattccgcatccctagacattaccgatgccgatgccgtctgcaacatggtcaaaagtttccaacccgacgctattgtcaacacggctgcctatactgccgtcgacaaagcggaaggcgatgcggcagcggcatttgccgtcaatgcttccgccgtttacaaccttgccttggcagcacatcgcgcccatgcccgattcatccacatctcaaccgactatgtctttgacggaaaagggaaaataccctatcaggaaagcgactttaccaacccttccaatgtatacggacaatccaaaaccgccggcgaactgctcgcactgtctgccaatcccgacagccttatcctgcggacttcttggctgtttagcgaatacggggacaactttgtccgcacgatgctgaaccttgcgcgggaacgttccccgctgtccgccgtccacaaccaaatcggctgcccgacctatgccggcgacttgtccgccgccatcatccgcctgttgcagcagtccaatcccgttcgcggcatttaccactacgccggcggcaaatccgtatcctggtacgaatttgcccggcacatctttcagacggcattgcaacaggatgcctcttttcccgttcccgaactgaaagccgtttcggatgaaggctctgcggctgccgcccccaggcccgcatacagcattttggactgccgcaaaatcgaaaacgacttcggcatcaaaccgtcagactggcaaaaagcccttgcacaggtcgtttccaagctgctctga

SEQ ID NO: 49747 - protein, 287 aa, Neisseria gonorrhoeae FA 1090
MRILLTGSKSQLAHCLRDRLPEDWETIATDSASLDITDADAVCNMVKSFQPDAIVNTAAYTAVDKAEGDAAAAFAVNASAVYNLALAAHRAHARFIHISTDYVFDGKGKIPYQESDFTNPSNVYGQSKTAGELLALSANPDSLILRTSWLFSEYGDNFVRTMLNLARERSPLSAVHNQIGCPTYAGDLSAAIIRLLQQSNPVRGIYHYAGGKSVSWYEFARHIFQTALQQDASFPVPELKAVSDEGSAAAAPRPAYSILDCRKIENDFGIKPSDWQKALAQVVSKLL

SEQ ID NO: 49748 - DNA, 864 bp, Bacteroides fragilis NCTC 9343
  CDS (1)..(864): transl_table=11
atgaatatattggtcaccggagccaacgggcaacttggcaatgaaatgcaggtacttgccagagaaaacctgcagcatacgtatttttttacggatgtacaggagttggacatttgtgatgaacaggctgtttatgcctatgtgagtgaacataagattgacatcatcgtgaactgcgctgcttatacagcggtagacaaggctgaggataatgtcgaactttgcgacaaactgaataatatagcaccgggatatctggcacgggcggctcaggctaatggcgctgcaatgattcaagtttctaccgattatgtgtttgacggtacagcgcatattccttatacggaagaggaacctacttgtccggcttcggtttatggctctaccaagctggcgggcgaacagaacgtgatggatcattgcgagaaagctatggtaattcgtacggcatggttgtactccatctatggcaataattttgtaaagacaatgattcgtctcgggcaggagcgtgattctttgggagtcattttcgatcagatcggtacaccgacttatgctaatgatttggcccaggctatttttgcagcgatcaataaaggcgttgtccgcggcatttaccatttcagtgacgaaggagtttgttcctggtatgactttaccatagccatccatcgcctggcgggcattgcttcgtgtaaggtaaaaccgttgcataccgccgattatccggcaaaggcaccccgtccacactattccgtactcgataaaacaaagataaaagatacatttggcattgagatcccgcattgggaggagagcctgaagcgttgcattaatcaattaagaatggagacactttga

SEQ ID NO: 49749 - protein, 287 aa, Bacteroides fragilis NCTC 9343
MNILVTGANGQLGNEMQVLARENLQHTYFFTDVQELDICDEQAVYAYVSEHKIDIIVNCAAYTAVDKAEDNVELCDKLNNIAPGYLARAAQANGAAMIQVSTDYVFDGTAHIPYTEEEPTCPASVYGSTKLAGEQNVMDHCEKAMVIRTAWLYSIYGNNFVKTMIRLGQERDSLGVIFDQIGTPTYANDLAQAIFAAINKGVVRGIYHFSDEGVCSWYDFTIAIHRLAGIASCKVKPLHTADYPAKAPRPHYSVLDKTKIKDTFGIEIPHWEESLKRCINQLRMETL

SEQ ID NO: 49750 - DNA, 891 bp, Bacteroides fragilis NCTC 9343
  CDS (1)..(891): transl_table=11
atgaaaaacatattgattatcggtgccaatggatttacggggcgccggatactgaatgacttatcggttaaccctatataccacgtcacaggatgctcgctgagagatgacatttgtcccggcaaagattatcgcttcgtacgtaccgatatccgggacgaaaatgaagtacggaaattatttaaagaatgccggccggatatcgtaatcaacacctctgccctttcggtaccggactattgcgaaacccatcatgcagaagctgaagctacaaatgttacagcagtcgaaacgatagcacatgtttgcgaacagtatggcagccgtttcatccatctttccacggactttgtatttgacggtaaaagcacccggctctacaaggaagaagatgaagcgattccggtgaattattacggtgttacgaaactgaaagccgaaaagattatagccagcatttgtagtaattatgccatagtacgtgtagtcgtcgtttatggaaaagcccttccgggacagcatggcaacatccttcagctagtagccaaccggttgagaaacggagaaacgatccgtgtcgtatccgatcaatggcgtacaccgacctttgttggagatatttcagtaggagtagaaaagctgatgtttcatacagccaacggcatctatcatatttgcggcagcgaatgcctcacaattgccgaaatcgcctaccgggtggctgattttctgaaactggatcgttcattgatcgaacctgtcactaccgaagaaatgaaagaggttactccccgcccgcgtttcagcggattaagtatcgaaaaggctaaagccgaaatcgggtacaccccgcgcacattggaagaaggtatggaggcttctttgttctaa

SEQ ID NO: 49751 - protein, 296 aa, Bacteroides fragilis NCTC 9343
MKNILIIGANGFTGRRILNDLSVNPIYHVTGCSLRDDICPGKDYRFVRTDIRDENEVRKLFKECRPDIVINTSALSVPDYCETHHAEAEATNVTAVETIAHVCEQYGSRFIHLSTDFVFDGKSTRLYKEEDEAIPVNYYGVTKLKAEKIIASICSNYAIVRVVVVYGKALPGQHGNILQLVANRLRNGETIRVVSDQWRTPTFVGDISVGVEKLMFHTANGIYHICGSECLTIAEIAYRVADFLKLDRSLIEPVTTEEMKEVTPRPRFSGLSIEKAKAEIGYTPRTLEEGMEASLF

SEQ ID NO: 49752 - DNA, 849 bp, Sulfolobus acidocaldarius DSM 639
  CDS (1)..(849): transl_table=11
atggtgactctaataatcggtggctctggacaactaggtcaggaacttggaaagttaataaaggacagtatactcacctttagctcaagaccaattgaaggtggtatttacttagatacacgggactacataagggtagaagacttgatcatgaagactaaacctgaagttatcataaacacatctgcaattacagatgtggacaagtgcgaagtggatagaatcaatgcgcatagtgtaaattctttggctgtgaagcacatggtaagagcggcttcaataactaagtcatacttcgttcaaatatctacagattatgtatttgacggaaacagggggaactataatgaagacgatttaccaaaccctttgaattactatgggctcactaagttacttggagagacgtattctttatcttacgactactcacttgtaataaggacttctgggatctatgggagtaacaaggagaattttcctctttatgtcttgaagtcactggagaaggggagtaaggtaagggcagtttgggatatgtattactctcctattaatgttaaacaactagctgaggctatagtacagctgttacctttaaggaaaacgggtattttgaatattgctggggataggatatcaagatatgacttagccctaaaaattgctaaaatgtcctctctaaatgaaaacttgatagaagctgctagttacgaagaaatgtcgtggagggcaaaaagacccaaggactcttccctggactcgtcaactgttaagaaatatgtgagtgtcaatctgtccttagaggagggattaaggaggttgataaacgatgttcagaataaatga

SEQ ID NO: 49753 - protein, 282 aa, Sulfolobus acidocaldarius DSM 639
MVTLIIGGSGQLGQELGKLIKDSILTFSSRPIEGGIYLDTRDYIRVEDLIMKTKPEVIINTSAITDVDKCEVDRINAHSVNSLAVKHMVRAASITKSYFVQISTDYVFDGNRGNYNEDDLPNPLNYYGLTKLLGETYSLSYDYSLVIRTSGIYGSNKENFPLYVLKSLEKGSKVRAVWDMYYSPINVKQLAEAIVQLLPLRKTGILNIAGDRISRYDLALKIAKMSSLNENLIEAASYEEMSWRAKRPKDSSLDSSTVKKYVSVNLSLEEGLRRLINDVQNK

SEQ ID NO: 49754 - DNA, 852 bp, Rhodobacter sphaeroides 2.4.1
  CDS (1)..(852)
atgatcctcgtcttcggccgcaccgggcaggtggcgcgcgaactggcgcggcaggctccggacgcccgcttcctcggccgcgacgaggcggatctcgccgatcccgaggcctgtgcccgcgcgatccgcgaggcaaagcctgacgcggtgatcaatgccgccgcctggaccgccgtcgaccgggccgaggaggaggaggccccggccacagtggtgaacggggaggcccccggcgccatggcgcgggcctgcgccgagctcggcatccccttcgtgcagatctcgaccgactatgtcttcgacggctcgggcacccgcccctggcagcccggcgatccggtggggccgctcggcgcctacggccgctcgaagctcgcgggcgaagaggcggtgcgcgcggccggcggaccccatgcgatcctgcgcacctcctgggtcttctcggcccatggcgcgaatttcgtgaagaccatgctgcgcctcggggccacgcgcgaccggctcaccgtcgtctgcgatcaggtgggcgggcccacgcccgcggccgacatcgccgcggcctgcctcgcgatggcgcgcggccttgcggcccggcccgatctgtcgggcacctaccatctctcgggcggcccggacgtgagctgggccgacttcgcccgcgagatcttccgtcaggcggagctcgactgcctcgtggccgacatcgcgtccgcggactatccgcagaaggcccaccggccggccaattcccggatggactgttccgacctcgcccgcttcggcctctcccgccccgactggcggcagggtctcgcccgtgttctcgccgatctccaggaggtttccgaatga

SEQ ID NO: 49755 - protein, 283 aa, Rhodobacter sphaeroides 2.4.1
MILVFGRTGQVARELARQAPDARFLGRDEADLADPEACARAIREAKPDAVINAAAWTAVDRAEEEEAPATVVNGEAPGAMARACAELGIPFVQISTDYVFDGSGTRPWQPGDPVGPLGAYGRSKLAGEEAVRAAGGPHAILRTSWVFSAHGANFVKTMLRLGATRDRLTVVCDQVGGPTPAADIAAACLAMARGLAARPDLSGTYHLSGGPDVSWADFAREIFRQAELDCLVADIASADYPQKAHRPANSRMDCSDLARFGLSRPDWRQGLARVLADLQEVSE

SEQ ID NO: 49756 - DNA, 891 bp, Nostoc punctiforme PCC 73102
  CDS (1)..(891)
atgagtaaatcaattttgctgattggtagcaacggtcaagtaggtaaagaactgcaacaaatactcccatcctatggcgatattatctcagtagcacgcccaacagtagaccttgcccaacccgataccctccgcagcatcatcagatccaagcaaccacaaatcatcattaacgccgctgcttatactgctgtggacaaagcagaaagcgaacccgaacttgctagcgctattaatgctactgcgcccctaattattgcccaagaaagccaaaaattaggagcttttctaattcatatttcgacagattatgtttttgatggtaatgggtatcgcccttaccaggaaaccgatgcgactaatcccttgagtgtttatggtaaaaccaaacttgctggagaagaagcaattcgggaaacttgcgcccatcacctaatcctccgtactgcttgggtttatggaacctttggcaaaagtaactttgtcaaaaccatgctgcgactaggtgcagaacgtcaagaactccgtgttgtcgccgatcaaattggtagcccgacttgggcgcaagatatagccacagtcatagcccagacgattccccagttaaccccaaaaattggcggcacttatcactacactaatagcggtgttgctagctggtatgactttgcagttgccatttttgaagaagcccaacagctaggcttccctttaaaagttgaacatattgtccctattacaactgccgaatatccgacaccagcccgtcgccctgcttattccgtccttgcttgtggaaaaatttccgcaattgtagggacttatccttcccattggcgacaaagacttcggcaaatgcttgcagatttgaaaattgggtatgcggaatag

SEQ ID NO: 49757 - protein, 296 aa, Nostoc punctiforme PCC 73102
MSKSILLIGSNGQVGKELQQILPSYGDIISVARPTVDLAQPDTLRSIIRSKQPQIIINAAAYTAVDKAESEPELASAINATAPLIIAQESQKLGAFLIHISTDYVFDGNGYRPYQETDATNPLSVYGKTKLAGEEAIRETCAHHLILRTAWVYGTFGKSNFVKTMLRLGAERQELRVVADQIGSPTWAQDIATVIAQTIPQLTPKIGGTYHYTNSGVASWYDFAVAIFEEAQQLGFPLKVEHIVPITTAEYPTPARRPAYSVLACGKISAIVGTYPSHWRQRLRQMLADLKIGYAE

SEQ ID NO: 49758 - DNA, 1452 bp, Bifidobacterium longum DJO10A
  CDS (1)..(1452)
atggcatttgaattcgagaaggaactgaaggtcgagaagacgaacatcccgggccttctggtgttcgacctgccggtgcatggcgacaaccgtggctggttcaaggagaactggcagcgcgccaagatgatgggtctgggactgccggacttcggcccggtgcagaacaacatcagctacaacgcgaccaagggcgtcacccgtggcatccacgcggagccgtgggacaagtacatcagcatcgctgccggcgagatcttcggcgcgtgggttgacctgcgcccgggcgagagcttcggccaggtgtacacgacccgtttggatccgtccaaggcaatctacgtgcctcgcggcgtgggcaacagcttccaggcgctgcaggacggcacggtgtacacgtatctggtgaacgcgcactggtcgctcgagcagaagaagacctacacgttcgtgaaccttgcggatccggaactgaacatccagtggccgattccgctggaggagtccgagcgctccgaggccgatctgcaccacccgatgctcaaggacgccaagcccatggctcccaagcgcaccctggtgacgggctgcaacggccagctgggccacgcgattcgcgcctacgcggaagcgcatggtctggagggcttcgagtacacggacatcgacgagttcgacttctccgacccgaaggcatacgaggcatacgattggagcctgtacggcacgatcatcaacgccggtgcctacacggccgtcgacaaggccgagaccgccgaaggccgtccgatcgcgtggaaggcgaacgcccagggtccggctctgctggccaaggtggccaaggaccaccacatcaccctcgtgcacgtgagttcggattatgtgttcgacggcaccgccaaggaacacacggagacggaggcgttcgccccgctcggtgtgtacggccagaccaaggccgctggcgacatcgccgtggccaacgcacccgagcattacatcctgcgttccagctgggtgatcggcgaggggcacaacttcgtgaagaccatgatgatgctgtccaacaaggtcgccgacccggccgacaagctggaacaggtcaccgtggtggatgaccagtacggtcgcctgaccttcacccgcgacatggccgaggcgatcttccacctgcttgacagccatgccccctacggcacctacaacttgaccggttccggcgcagtgaagtcctgggctgacatcgcggccgaggtgttcgacctgacgaacggcaacggcagcaaggtcaagcccatcagcactgccgagtacttcgcgaacgcgaccaacccggtatctccgcgtccggtcaactccgcactggatcttgctaagatcggtgaagccggatacgtgcccgctgactgggaagagaccctcaagacctacgtgcagaaggaactcggctga

SEQ ID NO: 49759 - protein, 483 aa, Bifidobacterium longum DJO10A
MAFEFEKELKVEKTNIPGLLVFDLPVHGDNRGWFKENWQRAKMMGLGLPDFGPVQNNISYNATKGVTRGIHAEPWDKYISIAAGEIFGAWVDLRPGESFGQVYTTRLDPSKAIYVPRGVGNSFQALQDGTVYTYLVNAHWSLEQKKTYTFVNLADPELNIQWPIPLEESERSEADLHHPMLKDAKPMAPKRTLVTGCNGQLGHAIRAYAEAHGLEGFEYTDIDEFDFSDPKAYEAYDWSLYGTIINAGAYTAVDKAETAEGRPIAWKANAQGPALLAKVAKDHHITLVHVSSDYVFDGTAKEHTETEAFAPLGVYGQTKAAGDIAVANAPEHYILRSSWVIGEGHNFVKTMMMLSNKVADPADKLEQVTVVDDQYGRLTFTRDMAEAIFHLLDSHAPYGTYNLTGSGAVKSWADIAAEVFDLTNGNGSKVKPISTAEYFANATNPVSPRPVNSALDLAKIGEAGYVPADWEETLKTYVQKELG

SEQ ID NO: 49760 - DNA, 909 bp, Pseudomonas aeruginosa UCBPP-PA14
  CDS (1)..(909)
atgaaccggatccttctcctcggcgccaacggccaggtcggctgggagctgcagcgcgccctggcgccgctgggcgaactgctggtctgcgaccgccggcgcgccgatctcgccgaccccgaaggcctggcgcgactggttcgcgccgagcggccgcagttcatcgtcaacgccggcgcctacaccgcggtggacaaggccgagagcgatgccgacaacgcccgcctgatcaatgcccgcgccgtcgcggtactggccgaggaggccgcggcctgcggcgcctggctggtgcattactccaccgactacgtgttcgacggcgcgggcagcgcgcctttcgccgaggacgcgccgaccggcccgctgagcgtctacgggcagaccaagctggaaggcgagcaggccatccgcgccagcggctgccgccacctgatcttccgcaccagttgggtctacgccgcgcgcggcgggaacttcgccaagaccatgctgcgcctggccgggcaacgcgacgaactcaaggtcgtggccgaccagttcggcgcgccgaccagcgccgagctgatcgccgacgtcaccgcccaggccctgcagcgtctgcgctgggatgccgagctggcagcacgggccagcggcacctaccacctggtcgccagcggcgagacgtcctggcacctctatgcgcgcttcgtcatcgaacaggcgctggagcggggctgggaattgcaggcgacgccgcagcgggtcctgccgattgccaccgaggattacccggtgccggcgaagcgcccggccaattcgcgcctcgacaaccacaagctgcaacaggtcttcggcctggtactgcccgactggcgctaccatgccggacgcatgatccaggaactgagcgagcagggaccactatga

SEQ ID NO: 49761 - protein, 302 aa, Pseudomonas aeruginosa UCBPP-PA14
MNRILLLGANGQVGWELQRALAPLGELLVCDRRRADLADPEGLARLVRAERPQFIVNAGAYTAVDKAESDADNARLINARAVAVLAEEAAACGAWLVHYSTDYVFDGAGSAPFAEDAPTGPLSVYGQTKLEGEQAIRASGCRHLIFRTSWVYAARGGNFAKTMLRLAGQRDELKVVADQFGAPTSAELIADVTAQALQRLRWDAELAARASGTYHLVASGETSWHLYARFVIEQALERGWELQATPQRVLPIATEDYPVPAKRPANSRLDNHKLQQVFGLVLPDWRYHAGRMIQELSEQGPL

SEQ ID NO: 49762 - DNA, 894 bp, Fusobacterium nucleatum subsp. vincentii ATCC 49256
  CDS (1)..(894): transl_table=11
atgaaactaatatttggagctaatggtcaattaggaacagattttaaggaattatttgattctattggtgaaaagtatattgctactgataaagatgaagtagatataactaatggagattttttaagagcatatattaaaactatgcatcaaaattacaagatagacacaatcattaattgtgctgcatataatgatgtagataaagctgaaaccgaaaaagaattatgttataaattaaatgcagaagctcctgctaatttagcaatgatagcttcagaaataggagcaacatttataacatattcaacagattttgtttttaatggtcttatagaaggttacctatataatgaaagtacaggatatacagaagaagatgaacctcatccattatcgacctatgcaaaaacaaagtatgaaggagaattactagtatcacaagtaatagaaaatccagaaaatacttcaaagatatatatagtaaggacatcttgggtatttggaaagggaaatatcaattttgttgataagataattgaatggtcaaaacaaaaaaatgaattaaaagtggtagatgatcaagtttcttctccaacttattcaaaagatttagcttatttcagttgggaacttattaaaaaaggatgtgaaagtggcatttaccattttacaaatgatgatatagcttcaaaatatgatcaagctaaatatattttagaaaaaatttcttggaaaggaaatctaataagagctaaaagtgaagactttaatttattagcagaaagacctaaatttagcaaattgagttgtaaaaaaataaaagaaaagttgggtgtttctattcctaattggaaagatgcaatagatagatattttaaggaaaataagtaa

SEQ ID NO: 49763 - protein, 297 aa, Fusobacterium nucleatum subsp. vincentii ATCC 49256
MKLIFGANGQLGTDFKELFDSIGEKYIATDKDEVDITNGDFLRAYIKTMHQNYKIDTIINCAAYNDVDKAETEKELCYKLNAEAPANLAMIASEIGATFITYSTDFVFNGLIEGYLYNESTGYTEEDEPHPLSTYAKTKYEGELLVSQVIENPENTSKIYIVRTSWVFGKGNINFVDKIIEWSKQKNELKVVDDQVSSPTYSKDLAYFSWELIKKGCESGIYHFTNDDIASKYDQAKYILEKISWKGNLIRAKSEDFNLLAERPKFSKLSCKKIKEKLGVSIPNWKDAIDRYFKENK

SEQ ID NO: 49764 - DNA, 891 bp, Anabaena variabilis ATCC 29413
  CDS (1)..(891)
atgaatgaatcgatcctactaataggtggtaacggtcaagtaggtcaagaaatccaccaaatccttgcacctaaatacaaagttatctcagccgcacgacccaggatagacctaactcaagctgatagtctgcgtcaaatcatccaagaagtccaaccgcagataatcattaacgctgccgcttacactgctgtagacaaagccgaaactgaacccgaaatagccacagctatcaacgctacagcaccccaaattatcgccgaagaaagccaaaaactcggctcattcttaattcatatctccacagattacgtttttgatggacagcaaagtcacccttaccaagaaacagaccctactaatcccttaagtgtttacggtaaaaccaaactagccggagaaatagccattcaacaaacccacccccagcacctcattctccgtacagcttgggtttatggcagttttggtaaaagtaactttgtcaaaaccatgctacggttgggtgcagaacgccaagaaattcgggtagttaaagatcaaattggctcccctacttgggcgcaagatatcgctgacaccatagcccaggtgataccccaaataccggaaatttctgggacttaccactacacaaacactggggtaattagctggtatgactttgccgtggctatttttgccgaatcccaaaagctaggctttccgctcacagtccaacaaattattcctatcaccaccgccgaatatccgactttagctccccgccctgcctattctgtcctagcttgtgagaaaatgtcacaagttttgggaactgctcccccccattggcaagaaagactgcggttgatgcttcaagactggctctccaaatattcttcattatga

SEQ ID NO: 49765 - protein, 296 aa, Anabaena variabilis ATCC 29413
MNESILLIGGNGQVGQEIHQILAPKYKVISAARPRIDLTQADSLRQIIQEVQPQIIINAAAYTAVDKAETEPEIATAINATAPQIIAEESQKLGSFLIHISTDYVFDGQQSHPYQETDPTNPLSVYGKTKLAGEIAIQQTHPQHLILRTAWVYGSFGKSNFVKTMLRLGAERQEIRVVKDQIGSPTWAQDIADTIAQVIPQIPEISGTYHYTNTGVISWYDFAVAIFAESQKLGFPLTVQQIIPITTAEYPTLAPRPAYSVLACEKMSQVLGTAPPHWQERLRLMLQDWLSKYSSL

SEQ ID NO: 49766 - DNA, 915 bp, Ralstonia eutropha JMP134
  CDS (1)..(915)
atgcagcgtaagcgtacggtgccgactctactcgtaacaggatgcaacggccaggtcggattcgaactgcgtcgcagcctggccccgctgggcaatgtggtcgcgctggatcgctccgcctgtgacctggcaaatcccgatgcgctgcgccgcgtggtgcgccagtgccggcccgacgtcatcgtcaatccggcggcctatacggctgtagataaagcggaaaccgatgcagaggtcgcattcgccatcaatgccactgcggccggtatcctggccgaagaggcgaaggcccttggcagccttctggtgcactattcgagcgactacgtattcgacggcaccaaggacggcgcttacgtcgagaccgatgcggtcaatccgcaatccgtctacggtaaaagcaagctcgcaggcgaacaggccattgccgctacaggcgtccagtccgttgtgctgcgcacgtgctgggtagccggtgcgcatggcggcaactttgcaaagaccatgctgcgccttggcaaggagcgcgatagcttgcgtgtcatcgccgaccagtttggcgccccgacgaccgcatcgctgattgcagatgtcaccgctcagattgtggctcgtcactggctggcgggcgatcgtcaggcgtttgccaacggcatttatcaccttgcagcagcgggcgagacgacctggcacggctacgccaccgaagttcttcgttatgcgaaagcgcatggtgtggaactcaaggccgatcctgagcaaatcgaagccatccctgcaacggcatatccgcttccggcaccgcgtccgtccaattcgagactggataccacgcgcctgcaggaaaccttcggcatccatctaccggactggaagcagggcgtgcagttcctgctcgatcagattcttccctaa

SEQ ID NO: 49767 - protein, 304 aa, Ralstonia eutropha JMP134
MQRKRTVPTLLVTGCNGQVGFELRRSLAPLGNVVALDRSACDLANPDALRRVVRQCRPDVIVNPAAYTAVDKAETDAEVAFAINATAAGILAEEAKALGSLLVHYSSDYVFDGTKDGAYVETDAVNPQSVYGKSKLAGEQAIAATGVQSVVLRTCWVAGAHGGNFAKTMLRLGKERDSLRVIADQFGAPTTASLIADVTAQIVARHWLAGDRQAFANGIYHLAAAGETTWHGYATEVLRYAKAHGVELKADPEQIEAIPATAYPLPAPRPSNSRLDTTRLQETFGIHLPDWKQGVQFLLDQILP

SEQ ID NO: 49768 - DNA, 897 bp, Rubrivivax gelatinosus PM1
  CDS (1)..(897)
atgaggatcctgctgctcggcaagaacggccaggtgggctgggagctccagcgcgcgctcgcccccctcggcgaactgctcgcgctggcgcgcgacagcgcgccactcgcggccgatctcggctgccccgaggccttggtggcgacggtgcgccacgtgcgcccggacatcatcgtgaatgcagcggcctacaccgccgtcgaccgggccgagcgcgagccggcgctcgcgcgagccgtcaacgccatcgcgcccgcggtgctggcccgcgaggccgcaatgctgggcgccaccttggtgcacttcagcaccgactacgtgttcgacggctcgggcagcgcgccgcgagacgaaagcgcccggaccgccccgatcaacgtctatggtgagagcaagctcgagggagaaatggcgatccgcgccagcggctgccgccacctgatcctgcgctccagctgggttcatgcggcgcgcggcagcaacttcgcgaagaccgtgctgtgcctggccgccgaacgcgagcacctcgagatcgtcgacgaccagatcggagctcccaccggcgccgagctgctggccgacgtcaccgcgcacgccctgtggtcggttcgacaggaaccttcgctcgccgggacttaccacgtgaccgctggcggcgaaaccagtcggcatgcctatgcccttttcgtcatcgagcgggcgcgcgcccacggtcatccgctgaatgtggcagccgacgccgtccgtccggtccccaccagcgtcttcccgacacgcgctcggcgaccgctcaattcgcgcctcgacaccggcaggctgcaatcgcgcttcggcctgcgtcttccgccctggcaggagggcgtcgagcgcctgctgatcgaagtgctggggcactga

SEQ ID NO: 49769 - protein, 298 aa, Rubrivivax gelatinosus PM1
MRILLLGKNGQVGWELQRALAPLGELLALARDSAPLAADLGCPEALVATVRHVRPDIIVNAAAYTAVDRAEREPALARAVNAIAPAVLAREAAMLGATLVHFSTDYVFDGSGSAPRDESARTAPINVYGESKLEGEMAIRASGCRHLILRSSWVHAARGSNFAKTVLCLAAEREHLEIVDDQIGAPTGAELLADVTAHALWSVRQEPSLAGTYHVTAGGETSRHAYALFVIERARAHGHPLNVAADAVRPVPTSVFPTRARRPLNSRLDTGRLQSRFGLRLPPWQEGVERLLIEVLGH

SEQ ID NO: 49770 - DNA, 837 bp, Burkholderia fungorum LB400
  CDS (1)..(837)
ttggcttcgctcggcaacgtggtagcgctcgaccgttcggtctgcgatctgaggagtcccgactccatccgtagcgtggtgcgagaagtgcagccggacgtgattgtgaacccggccgcgtacacggccgttgacgcagcggaaaacgacgcggaactcgcatacgccataaacggcgtggccgccggcgtgctggctgaagaagcaaagtcgcttggcggcctcctggtgcactattcgaccgactatgttttcgatggtcggaaggatggtccatacgtcgagaccgacgttgtcaatccccaatctgtctatggcaaaagtaagcttgccggcgagcaggctattgcggaaagaggtgcaacggcaatcgtgctgcgcacttgttgggtagctggtgcgcatggcagcaacttcgccaagactatgctgaggctcggtcgcgaacgcgacagcctgcgcgtgatcgctgaccaatacggagcgccgacgacagcggcgttgatcgccgacgtgaccgcgcagatcgtcgcgcgccactggcttcacggggatcgcgcggcattcgcgtcgggtgtctaccatcttgctgcggccggccaaacatcgtggcatggctacgcaaccgaggtgctgcaatttgctgcggcgcgcggcgtcgaactgaaagtcgatctcgcccgtatcgagcccattgctacagctgactatccgctacccgctccgcgtccggccaattcccgtctcgatacgcacaagctgcgccaaaccttcggtatcaatctccccgattggcgcgacggtgtgcaccacctgctagaacagattcttccgtga

SEQ ID NO: 49771 - protein, 278 aa, Burkholderia fungorum LB400
MASLGNVVALDRSVCDLRSPDSIRSVVREVQPDVIVNPAAYTAVDAAENDAELAYAINGVAAGVLAEEAKSLGGLLVHYSTDYVFDGRKDGPYVETDVVNPQSVYGKSKLAGEQAIAERGATAIVLRTCWVAGAHGSNFAKTMLRLGRERDSLRVIADQYGAPTTAALIADVTAQIVARHWLHGDRAAFASGVYHLAAAGQTSWHGYATEVLQFAAARGVELKVDLARIEPIATADYPLPAPRPANSRLDTHKLRQTFGINLPDWRDGVHHLLEQILP

SEQ ID NO: 49772 - DNA, 906 bp, Psychrobacter sp. 273-4
  CDS (1)..(906)
atgaaaattgtattactgggtaaaaatggtcaagttggctgggagttacagcgtgctctgcaaccgttaggacacgttatttcactagatcgtcaaatgaatgataatgggttgtgtggtgatataaccaactttaccgctatagaacagctctatgctaccatagagcctgatgtagttatcaacgcagccgcttataccactgtagataaagctgaaagtgattataaacaggctgatttaataaaccatttagctgttaaacatttagctgatatgtctaagcattttaatagcttgctgattaattactctagtgattatgtgtttgatggtacgctagacacgccttggtcagaaacagatgatagaatgcccataaataattatggcaggactaagtatgatggagaaatggctttagagaaaagtggtgcaagatttattaactttcgcaccagttgggtatatggcacccatggtaataactttattaaaaccatgctaaagcttgctcaaagcaaagaagagcttaacatcatcgctgaccaaattggcgcgccaactggagccgctttgattgctgatattactgcacaagcactacgttactatttactaaacaaacaacccagtagtctacatggacactataacttagcagcaaaaggtgaatgttcatggtttgattatgctgagtttatctttgcgaccgcacaaaaaaatatcggtacagaactactcataaagcagctgaatcctattccaacatcacaataccctacccctgcaaaacgtccgctcaactcacgtttaaatactgaaaaactacaaacccacttccaactgcacttgccacattggcaacaaggtgttgctcaagtattaggagagctattgctatga

SEQ ID NO: 49773 - protein, 301 aa, Psychrobacter sp. 273-4
MKIVLLGKNGQVGWELQRALQPLGHVISLDRQMNDNGLCGDITNFTAIEQLYATIEPDVVINAAAYTTVDKAESDYKQADLINHLAVKHLADMSKHFNSLLINYSSDYVFDGTLDTPWSETDDRMPINNYGRTKYDGEMALEKSGARFINFRTSWVYGTHGNNFIKTMLKLAQSKEELNIIADQIGAPTGAALIADITAQALRYYLLNKQPSSLHGHYNLAAKGECSWFDYAEFIFATAQKNIGTELLIKQLNPIPTSQYPTPAKRPLNSRLNTEKLQTHFQLHLPHWQQGVAQVLGELLL

SEQ ID NO: 49774 - DNA, 900 bp, Azotobacter vinelandii AvOP
  CDS (1)..(900): transl_table=11
atgaaaatcctgctactgggagccaacggtcaggttggctgggaactgcaacgggccctggcgccgttggggcggctggagatctgcgatcgtctccgggccgatctggacaggccggaaagcctggccgcgctggtcgagcgaattcagccgcaggtcatcgtcaatgccgccgcctataccgccgtggacaaggccgaatccgacgcggctcgctcgcgtcgggtgaacgccgaatcggtggaagtgctggcggatgccgcgcgaagttgcgatgcctggctggtgcattactcgaccgactatgtgttcgatggctgcaaagccgcggcctatacggaagatgaccccgtggggccgctgagcgtctacgggcagacgaagctggagggcgaacaagctattcaggcttccgggtgcaagcacctgatcctgagaaccagttgggtgtacgccgcacgcggcagcaacttcatcaagaccatgctgcgcctggccgccgagcgcgaagaactgcgtgtgatcgccgatcagatcggagcaccgaccagcgccgaactgatcgccgatgtgagcgctctgcttttgtatcggttgaggcatgatcgggcattggccgagcaggcaacgggggtctatcacctgactgccgccggcgaaaccagttggcatggctacgcgcgtttcgtcgtggccaaggctgccgcattggatatgtcactcaaggcggggcccgacgacatccatgcgatcggtaccgccgattacccgctgccggcccggcgcccggccaactcccggctcgataccggcaaactccgacgtaccttcgatctgcatcttccacagtgggaatatcacgtcgaacgcatgctgcacgagctcctcgccaaaccatag

SEQ ID NO: 49775 - protein, 299 aa, Azotobacter vinelandii AvOP
MKILLLGANGQVGWELQRALAPLGRLEICDRLRADLDRPESLAALVERIQPQVIVNAAAYTAVDKAESDAARSRRVNAESVEVLADAARSCDAWLVHYSTDYVFDGCKAAAYTEDDPVGPLSVYGQTKLEGEQAIQASGCKHLILRTSWVYAARGSNFIKTMLRLAAEREELRVIADQIGAPTSAELIADVSALLLYRLRHDRALAEQATGVYHLTAAGETSWHGYARFVVAKAAALDMSLKAGPDDIHAIGTADYPLPARRPANSRLDTGKLRRTFDLHLPQWEYHVERMLHELLAKP

SEQ ID NO: 49776 - DNA, 885 bp, Burkholderia vietnamiensis G4
  CDS (1)..(885): transl_table=11
atgaattcagagtcgacgatcctcgtaaccggtgtcacgggtcaggtaggctttgaactgctgcgctcgctacaggggctcggccgtgtcgtggcgtgcgaccgctcgatgctcgatctgtctgatcttgaccggatccgcgctgtcgtgcgggcgttggagccggccttcatcgtgaatccggctgcctatacggccgttgacaatgccgaggacgacgtcgatgcggcaagacgcataaatgccgatgtgccgcgggtcctggcggaagaggctgcgcgcagcggtgcggtgctgattcactactcgaccgattacgtgttcgacggagccaaggcgggcgcgtataccgagaccgatgcagtgaatccgctgaacgtgtacgggacgaccaagctcgagggcgagcgtgcgatcgagaacgcagggtgcgcgtacctaaccttgcgaaccagctgggtatacgggcgacgtggcaggaatttcttgcgcacgatgctcaagctgggcgcggagcgacccgaattgcgtgtggttgccgatcaggtcggcgcgccgacctggtcgaaaacaattgcagccgcgactgcgcacatcctctccaaagggctggcggcccatgatgaggcctggtggcaggcgcgctccggaacctatcatctgagtgcggccggcgagacgtcctggcacggtttcgccaaggcgattctcggcatcgcgatgggtgacgacgcacccgctgtggtgccgattgccgcgagcgagtttccggtgcgcgcaagtcgccccgcgaattcgcgcttgtcccacggcaaactcgccgagacattcggcttgcacctgcccgattgggaatatgcgctgggcctctgcatggccgactga

SEQ ID NO: 49777 - protein, 294 aa, Burkholderia vietnamiensis G4
MNSESTILVTGVTGQVGFELLRSLQGLGRVVACDRSMLDLSDLDRIRAVVRALEPAFIVNPAAYTAVDNAEDDVDAARRINADVPRVLAEEAARSGAVLIHYSTDYVFDGAKAGAYTETDAVNPLNVYGTTKLEGERAIENAGCAYLTLRTSWVYGRRGRNFLRTMLKLGAERPELRVVADQVGAPTWSKTIAAATAHILSKGLAAHDEAWWQARSGTYHLSAAGETSWHGFAKAILGIAMGDDAPAVVPIAASEFPVRASRPANSRLSHGKLAETFGLHLPDWEYALGLCMAD

SEQ ID NO: 49778 - DNA, 900 bp, Burkholderia cenocepacia AU 1054
  CDS (1)..(900): transl_table=11
atgcgtgaggtgggtgtgactcctgagccgacgattctcgtgacgggtgtgaatggccaggtcgggttcgaactgctgcgctcgctgcaaggactcggccgcgtggtcgcatgcgaccgctcgatgctcgacctgtccgacctcgatcgggtgcgcagcgtcgtgcgcgagctgaagccgtcgatcatcgtgaacccggccgcgtacacggccgtcgacaaggccgagacggacgtcgacgctgcgcgccggctgaatgtcgaagtcccgcgtgctttcgcagaggaggcggcgcgcctcggtgcagcgctggttcattactcaaccgactatgtgttcgacggcaccaaagagggtgcctatgtcgaaacggacgcgaccaacccgcagaacgtctacgggctgaccaagctggagggcgagcaggccatcgcggcgacaggttgcgcacacttgatcctgcggacgagctgggtgtacggccgccgcggcaagaacttcctgctgacgatgctgaagctcgggagcgagcgtcctgagctgcgtgtcgtcgcggatcaggttggcgcgccgacatggtcgaagacgatcgccaccgcgaccgcgcacattgtcgcgcaggcgttggcggccgatgacgcggactggtgggcgcagcgttccggcgtctatcacttcacgtccgcgggcgccacgtcgtggcacgggtttgccgaggcaatcttcgcccaggcgatgggcgagcgtgcgccgagggtgttgccgattccggcgagcgactacccggttcccgccaagcgcccgtccaattcgcgactgtcgcacgacaagctgaccgaagcattcgggttgcggttgccggactgggccgatgcgctgacgctgtgcctgagtgagtaa

SEQ ID NO: 49779 - protein, 299 aa, Burkholderia cenocepacia AU 1054
MREVGVTPEPTILVTGVNGQVGFELLRSLQGLGRVVACDRSMLDLSDLDRVRSVVRELKPSIIVNPAAYTAVDKAETDVDAARRLNVEVPRAFAEEAARLGAALVHYSTDYVFDGTKEGAYVETDATNPQNVYGLTKLEGEQAIAATGCAHLILRTSWVYGRRGKNFLLTMLKLGSERPELRVVADQVGAPTWSKTIATATAHIVAQALAADDADWWAQRSGVYHFTSAGATSWHGFAEAIFAQAMGERAPRVLPIPASDYPVPAKRPSNSRLSHDKLTEAFGLRLPDWADALTLCLSE

SEQ ID NO: 49780 - DNA, 975 bp, Polaromonas sp. JS666
  CDS (1)..(975): transl_table=11
gtggacggccaaacagtacgagtacggacaaacccaaaaggctgcagcttgaaaatcctgcttttcggcaaaaacggccaggtcggctgggaactacagcgcagcctggctcctttgggtgaactcacggcgctcgaccgtcacagcacagacctgtgcggcgacctcggcaatctgcagggcctggctgccacggtgcaacaactccggcccgacgtcatcgtcaatgccgccgcccacaccgccgtagacaaggctgaaagtgagccagcacttgcgcgcacactcaatgcgctggcccccagcgtgctggcgcaggaggcggccagactcggttccctgctggttcactacagtaccgactacgtatttgacggcagcggcacccgcccatggacagaggccgacaccccggcgccgctcagcgtttacggccagtccaagcttgagggcgagcagctcatccaggcggccagcccgcgccacctgatctttcgcaccagctgggtctatgccgcgcgcggtggcaatttcgccaagaccatgctgcgcctggcgcaggagcgggagcgcctcatcgtgattgacgaccagtttggcgcacccaccggcgccgagttgctggccgatgtgagcgcccacgccatccgccaggtactccagcgccccgctgatgccggcctttaccatctggtggccagtggcgaaaccagctggcatggttatgcgaaatacgtcctcgcccaggcagaacggagccaggaacaagggcgtgtcgctataaaaataatagccaaagcggtagaccccgttcccaccagtgcgtttccaacacccgccaaacggccccacaactcccggctggacaccaccaggctgcaaaccacctttggcctgactctgccgccgtggcagcagggtgtggaccgcatgttggaggaggtgctggggagtagggagttgcatgccctataa

SEQ ID NO: 49781 - protein, 324 aa, Polaromonas sp. JS666
MDGQTVRVRTNPKGCSLKILLFGKNGQVGWELQRSLAPLGELTALDRHSTDLCGDLGNLQGLAATVQQLRPDVIVNAAAHTAVDKAESEPALARTLNALAPSVLAQEAARLGSLLVHYSTDYVFDGSGTRPWTEADTPAPLSVYGQSKLEGEQLIQAASPRHLIFRTSWVYAARGGNFAKTMLRLAQERERLIVIDDQFGAPTGAELLADVSAHAIRQVLQRPADAGLYHLVASGETSWHGYAKYVLAQAERSQEQGRVAIKIIAKAVDPVPTSAFPTPAKRPHNSRLDTTRLQTTFGLTLPPWQQGVDRMLEEVLGSRELHAL

SEQ ID NO: 49782 - DNA, 897 bp, Frankia sp. CcI3
  CDS (1)..(897): transl_table=11
gtgaccggtgccgccggtcagctcggggccgacctctgccggctgctcgaggcccgagccgcggaaccgggctccccggtgtccggctgggccggtctgactcgggcggaattcgacatcaccgatccggcccgggtgcgcgccgtcctgcgcgaccaggcgcgtcctgcgaagatccagggtgggctggtcgtcttcaacacggcggcctggacaaacgtcgacgcggcggagtcggacgaggccggcgcctatgcggtcaacgccacggggccggcgcacctcgccgcggcctgcgccgaggtcggcgcgaccctgatccatatttcgactgactacgtcttcgacgggcgggccgccaagccctacgaggtcaacgatcctaccggtcccgtctcggcgtacggccggacgaaactggccggggaggaggctgtccgagccctgctgcccgatgcctcgtatgtggtgcgcaccgcatgggtctatggccggaccggcagcaacttcgtgaagacgatctcacgcctggcccgtgagcgggacacgctgtccgttgtggacgatcaggtgggctcgccgacctggtcggccgatctcgcgtcggggctgctcgaactcgcttcctcgacggcaccgaccggcgtctaccactgcacgaacgccggcgagaccacgtggttcggcttcgcccgcgagattgtcgccgctctgggccaggacccggccaaggtgacgccgacgacgacggaggcatttccccgtccggcccggcgcccggcctacgcggtgctctccgggcggtcatgggtggacgcgggactcactcctccgcgggcctgggacgccgcgctgtccgcggccttcgccgcggcgggcgacgcgctgcgcggctga

SEQ ID NO: 49783 - protein, 298 aa, Frankia sp. CcI3
MTGAAGQLGADLCRLLEARAAEPGSPVSGWAGLTRAEFDITDPARVRAVLRDQARPAKIQGGLVVFNTAAWTNVDAAESDEAGAYAVNATGPAHLAAACAEVGATLIHISTDYVFDGRAAKPYEVNDPTGPVSAYGRTKLAGEEAVRALLPDASYVVRTAWVYGRTGSNFVKTISRLARERDTLSVVDDQVGSPTWSADLASGLLELASSTAPTGVYHCTNAGETTWFGFAREIVAALGQDPAKVTPTTTEAFPRPARRPAYAVLSGRSWVDAGLTPPRAWDAALSAAFAAAGDALRG

SEQ ID NO: 49784 - DNA, 810 bp, Methanococcoides burtonii DSM 6242
  CDS (1)..(810): transl_table=11
atggtggtgggaaccattaaaacagtgataatcggtgcaagtggaatgctgggttcagacctgtccagagcattccccgatgctgtaaaattcacacaccacgacctggacatcaccaacaagcaacaggtcctcaagaaaattgaggaaataaaaccctatgttgtgatcaacgctgccgcttacacaaacgtagacggatgcgaagacgagcaggatattgctttcaaggtcaacggacacgcacccggctatatcgcacaggcatgttccgatatcggtgcaattctggtccattttagtaccgattatgtctttgatggctcaaaaaaagaatacgtggaatctaatatcaccaaacccatcaatgtctacggccagtccaaactgatgggtgagcaggagatcatcaaaaacacggacaactacaggatcatacgcacctcctggctttttgggaaaaacggaaagaacttcgtagatacgatgttaaggctctcaaaagagatggaaaacgtaaaagtcgtcaacgaccagttcggcaaacccacccacacagcggatatagcccgcaagaccgccgagatcatcaaccttaatcctggcatctaccacataactaatgaaggcccatgcacctggtacgaattcgcatccgagatcatcaataacacagttccatgctccagtgaagagtttcccacaaaagcaaaacgtccgacctactccgtcctcacgaacacaaaaacaactcccatgagacactggaagaatgcacttaacgaatacctgaaggagaatcaatcatga

SEQ ID NO: 49785 - protein, 269 aa, Methanococcoides burtonii DSM 6242
MVVGTIKTVIIGASGMLGSDLSRAFPDAVKFTHHDLDITNKQQVLKKIEEIKPYVVINAAAYTNVDGCEDEQDIAFKVNGHAPGYIAQACSDIGAILVHFSTDYVFDGSKKEYVESNITKPINVYGQSKLMGEQEIIKNTDNYRIIRTSWLFGKNGKNFVDTMLRLSKEMENVKVVNDQFGKPTHTADIARKTAEIINLNPGIYHITNEGPCTWYEFASEIINNTVPCSSEEFPTKAKRPTYSVLTNTKTTPMRHWKNALNEYLKENQS

SEQ ID NO: 49786 - DNA, 876 bp, Shewanella baltica OS155
  CDS (1)..(876): transl_table=11
atgaaaatattagtcaccggtagtaatggccaagtgggtagttgcctcgttaaacaattgagccagatgccagagattgaattttgggcggttgatcgtactcaattagatataacagatgctgctgctgtcgccaagttagtcaatgactttaaacctcatgcgatcatcaatgcggctgcgcacactgcagtagataaagcagaagatgaagttgcgctttcctatgcgatcaaccgtgatggccctcaatggctagccgaagcagcaaatagtgccggcgcagttatgttgcatatttccactgactatgtttttgcgggagataaacagggcgaatatcgagagactgatgcgattgatccccaaggagtctatggtaaaagcaaactggctggtgagttagccgttgcagccgcttgcccccgacatataattttacggactgcttgggtattttgcgaaactggcaataattttgttaaaaccatgcttcgtctttcgcaatctcgggacgaattaggcgtggtagcagatcagttcggtggccccacttatgctggtgatattgctaatgcgttaattaccatggctaaagccattagtaatggcaatcaatcatttggcatctatcattactctggcttacctcatgtaaattggcacttatttgcttgtgagattttcaagcaagctaaatcacaaggtttacttgataaagaaatgaatgttaaagccattactagcgaacagtacccaacaccagctaagcggccgaaaaactctaaattggattgtaataagattctacaacactttggtattcaagcgagtgattggcgagcggcattgaataagttgaatggctatttatga

SEQ ID NO: 49787 - protein, 291 aa, Shewanella baltica OS155
MKILVTGSNGQVGSCLVKQLSQMPEIEFWAVDRTQLDITDAAAVAKLVNDFKPHAIINAAAHTAVDKAEDEVALSYAINRDGPQWLAEAANSAGAVMLHISTDYVFAGDKQGEYRETDAIDPQGVYGKSKLAGELAVAAACPRHIILRTAWVFCETGNNFVKTMLRLSQSRDELGVVADQFGGPTYAGDIANALITMAKAISNGNQSFGIYHYSGLPHVNWHLFACEIFKQAKSQGLLDKEMNVKAITSEQYPTPAKRPKNSKLDCNKILQHFGIQASDWRAALNKLNGYL

SEQ ID NO: 49788 - DNA, 906 bp, Shewanella amazonensis SB2B
  CDS (1)..(906): transl_table=11
atgagagtgttgttgctgggctccagcggccaggtcggcagagcgttgctggccttcaagcctgcaggttacaagttactggtcccaggcagaagcgaagtggattatttgcaacctgaatccatcactgattatgtgttatttcataagccgcaattggtcatcaactgcgcggcgtatactgctgtggataaggctgaagcagagacagcactgtgtacgcgaatcaatagcggggcttgcgagcatctcgccaaggcagcagcagcggctgacgccgtcctgctacatctctctaccgattatgtgtttgatggtctcctcgaccgtccatacaacgaagaagactcgccagcccctttgtctgtgtatggacattccaagtggttgggagagcaaaccatagtcgccaactgtgccaagcatcttatcgtcagaacatcctggatttttgatgctgacagtaacaacttcgtcaataccatgctgcgtttggcggcatccaggtcagagctacgggttgtggcagaccaagttgggggaccgacgcccgcatctgaactggcccgggcgatttggcaacttgccaggcaatcggtggagagaaatggcccttggggcgtctatcacttttccggccaaccctttgtcagttggtacgagtttgccaggagcattttgactgaggcatacaggctttgcgtcatccaccaactaccaacaataacatctatcagcgccagtgagttcggctcccctgcgcagaggcctgcaaactcgaggcttgatggcagtaaaatcaaagcattatatggggttgctgccgcagactggcagagtgagttagttaacattctgaaagccaaggccagggccgtgacctcagttacaaaccctggttgttag

SEQ ID NO: 49789 - protein, 301 aa, Shewanella amazonensis SB2B
MRVLLLGSSGQVGRALLAFKPAGYKLLVPGRSEVDYLQPESITDYVLFHKPQLVINCAAYTAVDKAEAETALCTRINSGACEHLAKAAAAADAVLLHLSTDYVFDGLLDRPYNEEDSPAPLSVYGHSKWLGEQTIVANCAKHLIVRTSWIFDADSNNFVNTMLRLAASRSELRVVADQVGGPTPASELARAIWQLARQSVERNGPWGVYHFSGQPFVSWYEFARSILTEAYRLCVIHQLPTITSISASEFGSPAQRPANSRLDGSKIKALYGVAAADWQSELVNILKAKARAVTSVTNPGC

SEQ ID NO: 49790 - DNA, 879 bp, Pelodictyon phaeoclathratiforme BU-1
  CDS (1)..(879): transl_table=11
atgaatattcttgttaccggcagtcggggtcagcttggttctgagttgcaggaactctcaacccgctctgacaaccaccgtttttttttctatgaccttcctgatctcgatattacctctcccgagcgtgttgctgagctttgccgtgagcatgagatagaggtgatcatcaattgtgcggcatatacggctgtggacaaggcggagtcggatgttgatgcggcattcagggtgaaccgggatggtgctgccgtgcttgcggcctgtgcaaaggagcgcaatgctcttctggtgcacatttcaactgattatgtttttaatggcaagtcgcatattccttatcgggaaactgatcccgctactccgcttggtgtttacggtgtgtcgaaatgggaaggggaggagcgtatccgcgatattgcgccttctcactggattatccgtacctcatggctctattcgatctatggcgccaactttgtcaagacgatgttgcgtcttggcgccgagcgttcgacgctgaacgttgtggctgaccagattggtacgccaacctgggcggctgatcttgcaggcgctcttgtttcaatgcttgagcggtacgacaagaataaccactacgcaggacgctatcattattcaaatgaaggggtttgctcctggtatgattttgcccaggcgatcatggagttggctgaactgccctgcagggtggtgccggtcgaaagcagtcagtatccccagattgccgagagaccgcattatagcgttctgaacaagtcggctataaaggatgagtggaagcttgaaattccgtactggcgggtatcgctggctgccatgcttgagaagttgcagcatggagcgaataaaggatga

SEQ ID NO: 49791 - protein, 292 aa, Pelodictyon phaeoclathratiforme BU-1
MNILVTGSRGQLGSELQELSTRSDNHRFFFYDLPDLDITSPERVAELCREHEIEVIINCAAYTAVDKAESDVDAAFRVNRDGAAVLAACAKERNALLVHISTDYVFNGKSHIPYRETDPATPLGVYGVSKWEGEERIRDIAPSHWIIRTSWLYSIYGANFVKTMLRLGAERSTLNVVADQIGTPTWAADLAGALVSMLERYDKNNHYAGRYHYSNEGVCSWYDFAQAIMELAELPCRVVPVESSQYPQIAERPHYSVLNKSAIKDEWKLEIPYWRVSLAAMLEKLQHGANKG

SEQ ID NO: 49792 - DNA, 921 bp, Ralstonia metallidurans CH34
  CDS (1)..(921): transl_table=11
atgctgcgtgaagcacagagagcccccacgcttcttgtaacaggaagcaatggccaggtcggcttcgaactgcgtcgcagtctggcgccgctgggccgggtcgtggcgctggaccgaagccaatttgacctgactcgaccggatgcattgcgcgaactggttcgctcgattcggccagacgtcatcgtcaatccagcggcatacactgccgtagacaaggccgaaaccgaagcagaggcggcgttcgcggtaaatggcgtggcgcctggggtccttgcggaggaggcacgccgcctgggcagtctgttcgtccattactcgaccgactacgttttcgatggcaccaaggatggcgcctatctggaaggtgatgcagttaatccgcaatcggtgtatggcaagagcaaactggccggcgagcaagtagttgcagctactggtgcggcatcgcttgtgctgcgcacctgttgggtggctggtgcgcacggcgggaactttgcgaagaccatgctcaggctggcacgcgagcgagacagcctgagggtaattgcggatcagttcggcgccccgacaaccgcttccctgattgcggatgtgactgcgcaaatcgtcgcgcgccactggctccatgccccaggccgcgaagcatttcccactggtgtgtatcacctggcagccgggggggaaactacctggcacggatatgccactcacgtgctgtcaagagccgcagccaagggcgtggagatgaaggtcgatcccacccgcatcgaaccaattccagcttcgcagtatccgctgcccgcgccgcgcccagccaactcacggctggataccggcaagctgcgggacacattcaatattcaccttcctgactgggcggagggcattgaccttcttctcgatcagatcctttcctga

SEQ ID NO: 49793 - protein, 306 aa, Ralstonia metallidurans CH34
MLREAQRAPTLLVTGSNGQVGFELRRSLAPLGRVVALDRSQFDLTRPDALRELVRSIRPDVIVNPAAYTAVDKAETEAEAAFAVNGVAPGVLAEEARRLGSLFVHYSTDYVFDGTKDGAYLEGDAVNPQSVYGKSKLAGEQVVAATGAASLVLRTCWVAGAHGGNFAKTMLRLARERDSLRVIADQFGAPTTASLIADVTAQIVARHWLHAPGREAFPTGVYHLAAGGETTWHGYATHVLSRAAAKGVEMKVDPTRIEPIPASQYPLPAPRPANSRLDTGKLRDTFNIHLPDWAEGIDLLLDQILS

SEQ ID NO: 49794 - DNA, 888 bp, Mesorhizobium sp. BNC1
  CDS (1)..(888): transl_table=11
atgaagatcctggttacggggaaaaacggtcagctagcgcgcagcctgctcgaccgggccgcccggcatccgcatcttgcgctggatttcgccgcacggcccgagctggaccttgccgacccgcgcaccatcgcgccggcaatcgcccgccatgcgcccgatctcgtcgtcaatgccgccgcctatacggcagtggaccaagcggaggacgagcctgagcttgcgcatgccgtcaacggcgcagccgccggccttatcgcgcgcgccactgccgcgcgcggcattccgctcatccacatctccaccgattatgtgttcgacggcgcgcttgcccgcccctatcgcgaggaagatcccgtcaacccgctttcggtatacggcgcaagcaagctcgccggcgaaagggcggtgcgggagcaaaacccggaccatctgatcctgcgcacggcctgggtctacagcccctatggccggaattttctgaaaaccatgctgaagctcgccgaggcgcgggacgagatccgcgtagtctgcgaccagatcggcaatccgacatccgcgcacgatattgccggcggcatccttgccgcggccgaagcgcgtcgggtgcagggaacgcgaggctggggaaagacctatcacttggcaggatcgggcgaagccagctggcatgaatttgccgcgcatatttttgaggaaagcgcccgccgcggcggaccttccgcacgcgtgacgccgatcgccacggaagactatcccacgaaagccgtccgcccccgaaactcccgtctgtgctgcgaccgcttcgccgatgccttcggctaccgcgcgcccgcttggcgggaggcggtggtggaacttttaggggcagcttcgggcgcacactga

SEQ ID NO: 49795 - protein, 295 aa, Mesorhizobium sp. BNC1
MKILVTGKNGQLARSLLDRAARHPHLALDFAARPELDLADPRTIAPAIARHAPDLVVNAAAYTAVDQAEDEPELAHAVNGAAAGLIARATAARGIPLIHISTDYVFDGALARPYREEDPVNPLSVYGASKLAGERAVREQNPDHLILRTAWVYSPYGRNFLKTMLKLAEARDEIRVVCDQIGNPTSAHDIAGGILAAAEARRVQGTRGWGKTYHLAGSGEASWHEFAAHIFEESARRGGPSARVTPIATEDYPTKAVRPRNSRLCCDRFADAFGYRAPAWREAVVELLGAASGAH

SEQ ID NO: 49796 - DNA, 915 bp, Nitrobacter hamburgensis X14
  CDS (1)..(915): transl_table=11
atgcggatcgtgttgacgggtaccaacggtcaggtcggcggggcgctgcggccgctgctggaaaaaggcggcacggtcatcgccccgtcacgcatcgcgttcgacctgtcgaagcctgagacgcttgccgaggcgctcgatggcttcaaacccgatctcatcatcaatcccgcggcctataccgcggtggaccgcgcggaggacgagcgcgagcttgccttcctcgtcaacgccaaggggcctgcggcgatcgcggcgtggtcggcacggcatcgcgtgccgctgattcatttctcaaccgattatgttttcgatggctcgaatgacaggccatggcgcgaggacagtcccacgggcccgctctcggtctatggcgcgagcaagctcgccggcgaccttgccatccgggtggccggtgggccgcatctgatcgtgcgcacctcctgggtctacgcagcgagcggagccaatttcctgcgcaccatcgcgcggctggctggtgaacgaaaggaattgcgcattgtcgccgaccaggtgggcgcgccgaccacggcaagcgcgatcgccgctgccgttgccggcatcgtagtgtcgaacgggtcgaacctggaagggttgttcgcgcgcaacggcggtgtggtcaatctcgcttgcgccggcgagaccagttggtacggcttcgcaagcgccatcgtcgccgggctgaagtcgcgcggtgtgaagctcgccgtggagatgatcactccgattgcgacggccgatttcccgaccagggctaagcggcccggcaattccaggctcgacctgtcgcgcttgagagatcggttgagggtgaccacaccgacctggcaggaagcattatcgtcggagctcgacagcctcgttgcccggcaacgcgaactggcgggccgctga

SEQ ID NO: 49797 - protein, 304 aa, Nitrobacter hamburgensis X14
MRIVLTGTNGQVGGALRPLLEKGGTVIAPSRIAFDLSKPETLAEALDGFKPDLIINPAAYTAVDRAEDERELAFLVNAKGPAAIAAWSARHRVPLIHFSTDYVFDGSNDRPWREDSPTGPLSVYGASKLAGDLAIRVAGGPHLIVRTSWVYAASGANFLRTIARLAGERKELRIVADQVGAPTTASAIAAAVAGIVVSNGSNLEGLFARNGGVVNLACAGETSWYGFASAIVAGLKSRGVKLAVEMITPIATADFPTRAKRPGNSRLDLSRLRDRLRVTTPTWQEALSSELDSLVARQRELAGR

SEQ ID NO: 49798 - DNA, 855 bp, Streptococcus mutans
  CDS (1)..(855): transl_table=11
atgattttaatcacaggaagtaatggtcaattaggtacagaattacgtcatttacttaatgaacgtaatgaagactatgtggctgttgatgttgcagagatggatattacaaaagctgaaaaagtggatgaagtctttttacaggttaaaccgagtcttgtctaccattgtgcagcctatacagcagttgatgctgcagaagatgaaggtaaagagttggattatgctatcaatgtgacaggaactgaaaacattgctaaggcttgtgagaaatataatgcaactttggtttacatttcaactgattatgtgtttgatggtgaaaagccagttggtcaagaatgggaagtggatgataagccagatcctaagactgagtatggtcggacaaagcgtttaggtgaagaagcagttgaaaaatacgttaagaacttttacatcatccgtacagcttgggtatttggtaattatggtaaaaattttgtttttactatgcaacatcttgctaaaagtcataacagtttaacggttgttaatgatcagcatggtcgtccgacttggacacgaactttagctgaatttatgacttatctggctgaaaatcaaaaagaatatggttattatcatttatcaaatgatgcaaccgaggatacaacttggtatgattttgcacttgaaattttaaaggataccgatgttgtcgtaaaacctgttgactctagtcagttccctgctaaagccaaacggccgttaaattcaactatgagtttgacaaaggctaaggcgacaggatttgttattccgacttggcaagaagctttacaagaattttataagcaggatgtcaaaaaatag

SEQ ID NO: 49799 - protein, 284 aa, Streptococcus mutans
MILITGSNGQLGTELRHLLNERNEDYVAVDVAEMDITKAEKVDEVFLQVKPSLVYHCAAYTAVDAAEDEGKELDYAINVTGTENIAKACEKYNATLVYISTDYVFDGEKPVGQEWEVDDKPDPKTEYGRTKRLGEEAVEKYVKNFYIIRTAWVFGNYGKNFVFTMQHLAKSHNSLTVVNDQHGRPTWTRTLAEFMTYLAENQKEYGYYHLSNDATEDTTWYDFALEILKDTDVVVKPVDSSQFPAKAKRPLNSTMSLTKAKATGFVIPTWQEALQEFYKQDVKK

SEQ ID NO: 49800 - DNA, 867 bp, Serratia marcescens
  CDS (1)..(867): transl_table=11
atgcgtgtacttttgaccggtgctgcagggcagttggggcgctgtattatcgatcgtttccctgccaattggaccctggtggcgatggacagccagcaattggatatcgcggactccgccgccgtctcggcgacggttgagcagctagtaccggatgccattatcaatgctgcggcttatactgcggtggataaagcggaatcggaacctgaaaaggctcgggcaatcaatgcgttcggccccggcttcctcgctgctgcggcggcgaagttagacattcctttcatacacatctcgaccgattacgtctttgacggcacttcatcggaaccgtattgtgaagagacaccttgttcgcccaagagcgtttacgggcagacgaaactcgagggtgaactggcagcattacaagctaatccgaaaaccgtcgtgatcagaacggcctgggttttcagcgagtacggtaacaacttcgtgaaaaccatgttgcgagtcggcgcgcagagaggtgagttgggcgtggtgagcgaccagctcggctgcccaacctatgcgggagatattgcagcgacggtcatcgctatgctgtcccatcctcaattgccttatggcatctatcattactgcggcgataacgctgtttcatggttcgattttggttgcgctatcttccgggaggcggaaacatcaactcgctatccgcataaggtgagcgtcaaacctatcgcaacccatgaatatccaacgcccgcatccaggccagcgtattcgattctgagcaccagcaagatttgtgcgctggctctgaagcctagcccatgggaacagcagcttaaaactgtaatccagaagatattatcccagtga

SEQ ID NO: 49801 - protein, 288 aa, Serratia marcescens
MRVLLTGAAGQLGRCIIDRFPANWTLVAMDSQQLDIADSAAVSATVEQLVPDAIINAAAYTAVDKAESEPEKARAINAFGPGFLAAAAAKLDIPFIHISTDYVFDGTSSEPYCEETPCSPKSVYGQTKLEGELAALQANPKTVVIRTAWVFSEYGNNFVKTMLRVGAQRGELGVVSDQLGCPTYAGDIAATVIAMLSHPQLPYGIYHYCGDNAVSWFDFGCAIFREAETSTRYPHKVSVKPIATHEYPTPASRPAYSILSTSKICALALKPSPWEQQLKTVIQKILSQ

SEQ ID NO: 49802 - DNA, 885 bp, Actinobacillus actinomycetemcomitans
  CDS (1)..(885): transl_table=11
atggcgagactccttataacgggagctgggggacaactagggcgcagtttagctaaattattagtggataatggaagatatgaagtactagcattagatttttctgaattagatatcacaaataaagatatggtattttctataatagattcatttaaacctaatgtgattattaatgctgcggcctatacttctgtagatcaagctgagctagaagtatcttctgcttatagtgtaaatgttagaggggttcaatatttagctgaagctgcaataagacataattcagcgatcttacatgtttctacagattatgtatttgatggatataaatcagggaaatataaagaaacagatattattcatcctctttgcgtatatggaaagtctaaagcagagggagagcgtttacttttaactttatctcctaaatccataattctccgaacatcttggacatttggagaatatggtaataatttcgttaaaacgatgctacgtttagctaaaaatcgtgacattttaggtgtggttgcggatcaaatcggcggaccgacttattcaggtgacatcgcctctgttttaattcaaattgcagaaaagatcatagtaggcgaaactgttaaatatggcatctatcactttactggagaaccttgtgttagctggtacgattttgccatagctatttttgatgaagcagttgcgcaaaaagtgttagagaatgtaccgcttgtgaatgcgattaccacggcagattatccaaccctagccaaacgtcctgcgaattcttgtttagatttaaccaaaattcaacaagcattcggtattcaaccaagtgattggcaaagggctttgaagaatattagagcgtatgcggagtaa

SEQ ID NO: 49803 - protein, 294 aa, Actinobacillus actinomycetemcomitans
MARLLITGAGGQLGRSLAKLLVDNGRYEVLALDFSELDITNKDMVFSIIDSFKPNVIINAAAYTSVDQAELEVSSAYSVNVRGVQYLAEAAIRHNSAILHVSTDYVFDGYKSGKYKETDIIHPLCVYGKSKAEGERLLLTLSPKSIILRTSWTFGEYGNNFVKTMLRLAKNRDILGVVADQIGGPTYSGDIASVLIQIAEKIIVGETVKYGIYHFTGEPCVSWYDFAIAIFDEAVAQKVLENVPLVNAITTADYPTLAKRPANSCLDLTKIQQAFGIQPSDWQRALKNIRAYAE

SEQ ID NO: 49804 - DNA, 918 bp, Streptomyces glaucescens
  CDS (1)..(918): transl_table=11
atgtccgtacccctcggctctcgttggctcgtcaccggcgcgtccgggatgctcgggcgcgaactcaccgcgcgcctcagccgccggggcgtcccggtggtcccgctggttcgccgggcggacctggacgtcaccgaccccgccgccgcgcgggcgctgctggcccggcaccggcccgcggtgctcgtcaactgcgcggcctggacggcggtcgacgcggccgaggcgcacgaggcacgggccctggcggtgaacggcgagggacccggtcacctggcccgcgcctgccgggcgacgggcacccggatgatccagctgtccaccgactacgtcttcgccgggctcgccgaccgcccgtaccgggaggacgacccgcccgcgccgcgcacggcctacggcaggacgaagctcgccggggagcgggcggtgctcgacaccctcccggacggtggctacgtggtgcgcaccgcctggctgtacgggtccggcggcgcgaacttcgtctccacgatgatccgcctggcggccgcggagggcaccgtgcccgtcgtcgacgaccagcacggcggaccgacctggaccggtgatctcgccgaccggctcctcgcgctcggcgccgcggcgctgcggggcaccgcgccgcccggtgtctaccacgccgtgaacgcggggagcacgacctggcacgcgctggcgcgggagatcttccggcgggccggggccgatcccggccgggtccggccgatcggcagcggggaactggcccggccggccgcccggcccccgtacagcgtcctcgcccagggccggtggcgggccgccggtctcgccccgctgcgcgactggcgcgccgcgctcgccgaggcgttccccgcgctgctgcgcgcgtcggcgcggggcggcacggtcaggcggtga

SEQ ID NO: 49805 - protein, 305 aa, Streptomyces glaucescens
MSVPLGSRWLVTGASGMLGRELTARLSRRGVPVVPLVRRADLDVTDPAAARALLARHRPAVLVNCAAWTAVDAAEAHEARALAVNGEGPGHLARACRATGTRMIQLSTDYVFAGLADRPYREDDPPAPRTAYGRTKLAGERAVLDTLPDGGYVVRTAWLYGSGGANFVSTMIRLAAAEGTVPVVDDQHGGPTWTGDLADRLLALGAAALRGTAPPGVYHAVNAGSTTWHALAREIFRRAGADPGRVRPIGSGELARPAARPPYSVLAQGRWRAAGLAPLRDWRAALAEAFPALLRASARGGTVRR

SEQ ID NO: 49806 - DNA, 900 bp, Enterococcus faecalis
  CDS (1)..(900): transl_table=11
atggcaaagtacaaaagctactttgccctgcctttttttcaagaaggagcgaaaaaaatgattttaattactggtggaaatggccaattgggcacagaattacgtcacctattagacgaacaaggaattgagtatgtttcaacggattccacagaattagatattactgatgcggatagtacgttggcaaaagtgaaagaaattcaaccaagcgtcatttatcattgtgctgcttatacagctgttgataaagcagaagacgaaggcaaggaattagatgaaaaagtgaatgtagatggcacacgtcatgttgcagaagctgctaaagcagtgggggcgacacttgtttacgtaagtacagattatatttttgatggaactaaaaaagaaggcgtctatgcgattgatgatcaaccgaatcctttaaatgagtatggtcggacgaagttattaggtgaacaagcggtccaagaaatcctggacgattattatattattcgaacatcatgggtatttggtcaatacggtcataactttgtctttaccatgcaaaaattagcggaaacaagagaccaactaacggtagtggacgatcagtttggccgcccaacttggacaagaacgttagccgaatttatggcatttgttattgcagaaaaagcgccatttggtgtttatcatttgtctaatgaaaacagctgtagctggtatcagtttgctaaagaaattttaaaagatactgaagtggaagtactgccagtggattcaactcaatttccacaaaaggcgcaaagaccacaatattctgtcatggatttaagtaaaacagaagcgttaggctttaaaattcctacttggcaagaagccttagcacaaatgttagaaaatgttcaacaataa

SEQ ID NO: 49807 - protein, 299 aa, Enterococcus faecalis
MAKYKSYFALPFFQEGAKKMILITGGNGQLGTELRHLLDEQGIEYVSTDSTELDITDADSTLAKVKEIQPSVIYHCAAYTAVDKAEDEGKELDEKVNVDGTRHVAEAAKAVGATLVYVSTDYIFDGTKKEGVYAIDDQPNPLNEYGRTKLLGEQAVQEILDDYYIIRTSWVFGQYGHNFVFTMQKLAETRDQLTVVDDQFGRPTWTRTLAEFMAFVIAEKAPFGVYHLSNENSCSWYQFAKEILKDTEVEVLPVDSTQFPQKAQRPQYSVMDLSKTEALGFKIPTWQEALAQMLENVQQ

SEQ ID NO: 49808 - DNA, 867 bp, Sphingomonas sp
  CDS (1)..(867): transl_table=11
atgcgcatcctcgtcaccgggcatgacggccaggtcgcccaggcgctgggcgaacaggcggagggccatgagctgatcttcaccagctatcccgagttcgatctctccaagccggagacgatcgaggcggcggtggcgaagatccagcccgagctgatcgtgtcggcggctgcgtatacggcggtcgacaagtccgagagcgagcccgagctcgccatggcgatcaacggcgacggccccggcgtactggcgcgcgcgggcgcgaagatcggcgcgccgatcatccatctgtcgaccgactatgtgttcgacggcagcctggaccgcccgtggcgcgaagacgaccccaccggtccgctcggcgtctatggcgccaccaagctggccggcgagcaagcggtgcaggcctcgggcgcgaccaacgcggtgatccggctcgcctgggtctacagcccgttcggcaacaacttcgtcaagacgatgctgcgcctcgccgagacgcgggacacgctgaacgtggtcgaggaccagcagggctgcccgagctcggcgctggacatcgccacggcgatcctcaaggtcgtcggccactggcagcagaacggcgccaccagcggcctgtatcacttcaccggatcgggcgagaccaactgggccgacttcgcgcgcgcgatcttcgcggaaagcgccaagcacggcggtccgaccgccgaggtgaccggcattccgacctccggctaccccaccccggcgaagcgcccggccaattcgcggctcaattgcgacaagttcgccgaaaccttcggctatcgtgcacccgcctggcaggactcggtggcggaagtggtaggccgcctcctggcataa

SEQ ID NO: 49809 - protein, 288 aa, Sphingomonas sp
MRILVTGHDGQVAQALGEQAEGHELIFTSYPEFDLSKPETIEAAVAKIQPELIVSAAAYTAVDKSESEPELAMAINGDGPGVLARAGAKIGAPIIHLSTDYVFDGSLDRPWREDDPTGPLGVYGATKLAGEQAVQASGATNAVIRLAWVYSPFGNNFVKTMLRLAETRDTLNVVEDQQGCPSSALDIATAILKVVGHWQQNGATSGLYHFTGSGETNWADFARAIFAESAKHGGPTAEVTGIPTSGYPTPAKRPANSRLNCDKFAETFGYRAPAWQDSVAEVVGRLLA

SEQ ID NO: 49810 - DNA, 828 bp, Rhizobium meliloti
  CDS (1)..(828): transl_table=11
atggaggtcgttacgatcgggcggccgcacctcgatctcacagagccggcaacgatcctgccggcgatcgagcgatgccggccggacctcgtcgtctcggcggcagcttacacggccgtcgaccaggccgaaagcgagccggaggcggctttcgcggtcaacgcgttcggggctggcgcggtcgctgaggcggccgcctgcctcgaagtgcccatcgtccatatttcgacggattatgtcttcgacgggagcaaaccgcggagctatgcagagggcgacacaccggctccgcttagcgtctacggcgcttccaagcttgccggagaaagcgcggttgccgaggcaactccccgccatctcatcctgcgcacgggctgggtctacagccccttcgggaagaatttcgtcaagaccatcctgcggctcgcagaggagcgcgaagatatcgccgtcgttgcggatcaacggggaaatccgtcatcggcgatcgaccttgcggacgcgatcctcgatatttccgcgcggctcacgaaatcccgtcaggacgccgcttttggcctctaccacctcgctggctcgggcgtcgtaagccgggccgatttcgcgcggcatgctcttgcggcgagccgtgccgcaggcggtccctgggcgcatgttcgggacatcgcgacgggtgggtttccgacacctgcaagccgccctgcaaactcgtcgctgtcgagcgccaaattcaacgcgaccttcggccaggccatgcctgcctggcagggttccgtggagcgaaccgtgaggcggcttgtcgagagcatttcgagtgaaaccagttag

SEQ ID NO: 49811 - protein, 275 aa, Rhizobium meliloti
MEVVTIGRPHLDLTEPATILPAIERCRPDLVVSAAAYTAVDQAESEPEAAFAVNAFGAGAVAEAAACLEVPIVHISTDYVFDGSKPRSYAEGDTPAPLSVYGASKLAGESAVAEATPRHLILRTGWVYSPFGKNFVKTILRLAEEREDIAVVADQRGNPSSAIDLADAILDISARLTKSRQDAAFGLYHLAGSGVVSRADFARHALAASRAAGGPWAHVRDIATGGFPTPASRPANSSLSSAKFNATFGQAMPAWQGSVERTVRRLVESISSETS

SEQ ID NO: 49812 - DNA, 891 bp, Azorhizobium caulinodans
  CDS (1)..(891): transl_table=11
atgcgcgtcctcctgctcggcgctgacggtcagctcggccgggaactcacggctcttgcggtcgagcggggccttgcgctcgcggcgctcaaccgcgccgccacagacatcaccgatccggtggcggtggcaaaggcgctggaggcgcataagccggacgtggtggtgaatgccgccgcctatacggccgtggacaaggccgagagcgagccggatctcgccgcgaaggtgaatgcggtggcgcccggcctcatcgccgagcgctgcgccagcgcgggcgtgccgctgatccacgtctcgacggattacgtcttcgacggcaccaagaccggcgcctatgtggagagcgatccgctcgcgccgctcggcgtctacgggcgcaccaaggcggcgggcgaggcggccatccgcgccgccggcgagaagcacctcatcctgcgcaccgcctgggtctatggcatctacggcaacaatttcctcaagacaatgctgcggctcgccaaggaccgggaccggctgaccatcgtcgccgaccagcgcggctgcccgaccgccacccgcgacatcgccgagggcatcctcgcggcggcagcgcccgccgtggcgggaagtgcccgctggggcacctatcatctgggcggcacgggcgtcaccacgtggcacggcttcgcgcaggcgatcatcgaccgggcggcgacctacaccggccgcagcgaggtggcggccatcaccaccgccgagtatcccaccccggcccgacggccggccaattccgaacttgattccagcctgttcgagcggacattccacttccgcgccgcgccctggcagcagcgcacggtcgaggtggtggacacgctgctcgccaagagccccgtggaggcatcgtga

SEQ ID NO: 49813 - protein, 296 aa, Azorhizobium caulinodans
MRVLLLGADGQLGRELTALAVERGLALAALNRAATDITDPVAVAKALEAHKPDVVVNAAAYTAVDKAESEPDLAAKVNAVAPGLIAERCASAGVPLIHVSTDYVFDGTKTGAYVESDPLAPLGVYGRTKAAGEAAIRAAGEKHLILRTAWVYGIYGNNFLKTMLRLAKDRDRLTIVADQRGCPTATRDIAEGILAAAAPAVAGSARWGTYHLGGTGVTTWHGFAQAIIDRAATYTGRSEVAAITTAEYPTPARRPANSELDSSLFERTFHFRAAPWQQRTVEVVDTLLAKSPVEAS

SEQ ID NO: 49814 - DNA, 852 bp, Streptococcus pneumoniae
  CDS (1)..(852): transl_table=11
atgattttaattacaggggcaaatggccaattaggaacggaacttcgctatttattggatgaacgtaatgaagaatacgtggcagtagatgtggctgagatggacattaccgatgcagaaatggttgagaaagtttttgaagaggtgaaaccgactttagtctaccactgtgcagcctacaccgctgttgatgcagcagaggatgaaggaagagagttggacttcgccatcaatgtgacggggacaaaaaatgtcgcaaaagcatctgaaaagcatggtgcaactctagtttatatttctacggactatgtctttgatggtaagaaaccagttggacaagagtgggaagttgatgaccgaccagatccacagacagaatatggccgtactaagcgtatgggggaagagttagttgagaagcatgtgtctaatttctatattatccgtactgcctgggtatttggaaattatggcaaaaacttcgtttttaccatgcaaaatcttgcgaaaactcataagactttaacagttgtaaatgaccagtacggtcgtccgacttggactcgtaccttggctgagttcatgacctacctagctgaaaatcgtaaggaatttggttattatcatttgtcaaatgatgcgacagaagacacaacatggtatgattttgcagttgaaattttgaaaggtacagatgtcgaagtcaagccagtagattccagtcaatttccagccaaagctaaacgtccgctaaactcaacgatgagcctggccaaagccaaagctactggatttgttattccaacttggcaagatgcattgcaagaattttacaaacaagaagtgagataa

SEQ ID NO: 49815 - protein, 283 aa, Streptococcus pneumoniae
MILITGANGQLGTELRYLLDERNEEYVAVDVAEMDITDAEMVEKVFEEVKPTLVYHCAAYTAVDAAEDEGRELDFAINVTGTKNVAKASEKHGATLVYISTDYVFDGKKPVGQEWEVDDRPDPQTEYGRTKRMGEELVEKHVSNFYIIRTAWVFGNYGKNFVFTMQNLAKTHKTLTVVNDQYGRPTWTRTLAEFMTYLAENRKEFGYYHLSNDATEDTTWYDFAVEILKGTDVEVKPVDSSQFPAKAKRPLNSTMSLAKAKATGFVIPTWQDALQEFYKQEVR

SEQ ID NO: 49816 - DNA, 852 bp, Streptococcus pneumoniae
  CDS (1)..(852): transl_table=11
atgattttaattacaggggcaaatggccaattaggaacggaacttcgctatttattggatgaacgtaatgaagaatacgtggcagtagatgtggctgagatggacattaccgatgcagaaatggttgagaaagtttttgaagaggtgaaaccgactttagtctaccactgtgcagcctacaccgctgttgatgcagcagaggatgaaggaaaagagttggacttcgccatcaatgtgacggggacaaaaaatgtcgcaaaagcatctgaaaagcatggtgcaactctagtttatatttctacggactatgtctttgacggtaagaaaccagttggacaagagtgggaagttgatgaccgaccagatccacagacagaatatggccgtactaagcgtatgggggaagagttagttgagaagcatgtgtctaatttctatattatccgtactgcctgggtatttggaaattatggcaaaaacttcgtttttaccatgcaaaatcttgcgaaaactcataagactttaacagttgtaaatgaccagtacggtcgtccgacttggactcgtaccttggctgagttcatgacctacctagctgaaaatcgtaaggaatttggttattatcatttgtcaaatgatgcgacagaagacacaacatggtatgattttgcagttgaaattttgaaagatacagatgtcgaagtcaatccagtagattccagtcaatttccagccaaagctaaacgtccgctaaactcaacgatgagcctggccaaagccaaagctactggatttgttattccaacttggcaagatgcattgcaagaattttacaaacaagaagtgagataa

SEQ ID NO: 49817 - protein, 283 aa, Streptococcus pneumoniae
MILITGANGQLGTELRYLLDERNEEYVAVDVAEMDITDAEMVEKVFEEVKPTLVYHCAAYTAVDAAEDEGKELDFAINVTGTKNVAKASEKHGATLVYISTDYVFDGKKPVGQEWEVDDRPDPQTEYGRTKRMGEELVEKHVSNFYIIRTAWVFGNYGKNFVFTMQNLAKTHKTLTVVNDQYGRPTWTRTLAEFMTYLAENRKEFGYYHLSNDATEDTTWYDFAVEILKDTDVEVNPVDSSQFPAKAKRPLNSTMSLAKAKATGFVIPTWQDALQEFYKQEVR

SEQ ID NO: 49818 - DNA, 882 bp, Pseudomonas fluorescens
  CDS (1)..(882): transl_table=11
atgaacgctcctctgaaaatccttatcagcggccagcacggccaggtctcccgggagctgcagcagcgcctcggcgacctcggcgagctggtggtcctgggtcgtgagcaactggacctgagccacccggaacagatccgccagcaagtgcgcgccattcgcccggacctgatcatcaatgccgccgcccacaccgccgtcgaccaggcccagagcgagccggacctggcttttgcgatcaacgccacggcccccgggatcttcgcccaggaagccttcgagctgggtgtgccgctgattcactactccaccgactacgtgttcgatggcagcaaggaaacgccctatgtggaggacgacgagcccaacccgctgagtgtctacggcgagagcaagctggctggcgaacgggcgatccggctggtccagggccagcatttgatcctgcgcaccagctgggtctattccagccatggcaagaacttcctgctgaccatgcagcgcctgctgcaggaaaaacccgagctgcgggtagtggccgaccagatcggcgcgcccacctgggccggcaccatcgccaccagcacccgggcgctgatcgagcgttggcgagccgggcagcccggcgcatggggcatctaccacctcaccgcccacggcgagacttcctggttcggctttgcccaggccatcggcgagcagttgctggccatggacaaaccctgcgccgtccttgaagccatcccttccagcgcttaccctacaccggcgccgcggccgttgaactcgcgtctggactgcagccgcctggcacgggagtggggcgtggtccagccggactggcacaccgcattgcgcgagtgtcttgccgagcagggctag

SEQ ID NO: 49819 - protein, 293 aa, Pseudomonas fluorescens
MNAPLKILISGQHGQVSRELQQRLGDLGELVVLGREQLDLSHPEQIRQQVRAIRPDLIINAAAHTAVDQAQSEPDLAFAINATAPGIFAQEAFELGVPLIHYSTDYVFDGSKETPYVEDDEPNPLSVYGESKLAGERAIRLVQGQHLILRTSWVYSSHGKNFLLTMQRLLQEKPELRVVADQIGAPTWAGTIATSTRALIERWRAGQPGAWGIYHLTAHGETSWFGFAQAIGEQLLAMDKPCAVLEAIPSSAYPTPAPRPLNSRLDCSRLAREWGVVQPDWHTALRECLAEQG

SEQ ID NO: 49820 - DNA, 1005 bp, Xenopus laevis
  CDS (1)..(1005)
atggaagggagatacaaggactacaggatccgcttctcacccggctgggtcgaggttgtgcaggatgatgttactgttcctagtagaagggctctgataacgggggcaaccggacttcttggtcgagctgtatacaaagagtttaaggagaacagctggcatgtgctgggctgcgggtacagtcgtgctcgacccagattcgaatgcctcaacctattggatgaagcagcggtgaaagcattgatccaagacttcaagcctcacgtgatcattcattgtgctgcagagaggagaccagatattgtcgaaagtcaaccagagttagcttcattactaaatgtggtggcatctgagaatttagcaaaagtagccgctggagttggagcgtttctaatttatgttagctcagattatgtctttgatggaacaagcccgccttacagggaagattccataccacatcccttgaacctttatggcaagacaaaactggatggagagagagcagtgttgcagaataatgaaggtgctgcagttcttcgagtgccagttatgtatggagacgtggaaaaacttagtgaaagtgctgtcacaattctttttgataaggtgcagtttagcaacaagtcggcaaatctggaccattgtcagcaaaggtttcctactcatgtcaaagatgttgctacagtttgtcttcaattaacagagcgaaaaatacaggatccctctattaagggaatataccattggtctggaaatgagcagatgaccaaatacgaaatagcttgtgccatggcagatgccttcaaccttcccagcagccatctgcgtccaatcacagatgagcccgtaggagcgactcctcggccatggaatccacaactggactgttcgaaactggagaagatgggcattggccagagaacaccgtttagagtgggaattagggaaaccctctggccgttcttagtggacaagagatggagacagacagtcttccactag

SEQ ID NO: 49821 - protein, 334 aa, Xenopus laevis
MEGRYKDYRIRFSPGWVEVVQDDVTVPSRRALITGATGLLGRAVYKEFKENSWHVLGCGYSRARPRFECLNLLDEAAVKALIQDFKPHVIIHCAAERRPDIVESQPELASLLNVVASENLAKVAAGVGAFLIYVSSDYVFDGTSPPYREDSIPHPLNLYGKTKLDGERAVLQNNEGAAVLRVPVMYGDVEKLSESAVTILFDKVQFSNKSANLDHCQQRFPTHVKDVATVCLQLTERKIQDPSIKGIYHWSGNEQMTKYEIACAMADAFNLPSSHLRPITDEPVGATPRPWNPQLDCSKLEKMGIGQRTPFRVGIRETLWPFLVDKRWRQTVFH

SEQ ID NO: 49822 - DNA, 900 bp, Shigella boydii
  CDS (1)..(900): transl_table=11
atgaatattctccttttcggcaaaacagggcaggtaggttgggaactacagcgtgctctggcacctctgggtaatttgattgctcttgatgttcactccactgattattgtggtgattttagtaatcctgaaggtgtagctgaaaccgtaagaagcattcggcctgatattattgtcaacgcagccgctcacaccgcagtagacaaagcagaatcagaaccggagtttgcacaattacttaacgcgacaagtgtcgaagcgattgcgaaagcagccaatgaagtcggcgcctgggttattcactactctactgactacgtatttccggggaccggtgaaataccatggcaggagacggatgcaaccgcaccgctaaatgtgtacggtgaaaccaagttagctggagaaaaagcattacaagagcattgtgcgaagcaccttattttccgtaccagctgggtatatgcaggtaaaggaaacaattttgccaagacaatgttacgtctggcaaaagagcgcgaagaattagctgtcattaacgatcagtttggtgcaccaacaggtgctgagttgctggctgattgtacggcacatgccattcgtgttgcactgaataaaccagaagtcgcaggcttataccatctggtagccagtggtaccacaacctggtacgattatgctgcgctggtttttgaagaggcgcgcgaagcaggcattccccttgcactcaacaagctcaacgcagtaccaacaacagcctatcctacactagctcgtcgtccgcataactctcgccttgatacagaaaaatttcagcagaactttgcgcttgtcttgcctgactggcagattggcgtgaaacgcatgctcaacgaattatttacgactacagctatttaa

SEQ ID NO: 49823 - protein, 299 aa, Shigella boydii
MNILLFGKTGQVGWELQRALAPLGNLIALDVHSTDYCGDFSNPEGVAETVRSIRPDIIVNAAAHTAVDKAESEPEFAQLLNATSVEAIAKAANEVGAWVIHYSTDYVFPGTGEIPWQETDATAPLNVYGETKLAGEKALQEHCAKHLIFRTSWVYAGKGNNFAKTMLRLAKEREELAVINDQFGAPTGAELLADCTAHAIRVALNKPEVAGLYHLVASGTTTWYDYAALVFEEAREAGIPLALNKLNAVPTTAYPTLARRPHNSRLDTEKFQQNFALVLPDWQIGVKRMLNELFTTTAI

SEQ ID NO: 49824 - DNA, 915 bp, Streptomyces griseus subsp
  CDS (1)..(915): transl_table=11
atgtccccgtaccctcgcccgcgttggctcgtcaccggtgcgtccggcatgctggggcgcgagctcacccccctgctggaccgccggggtgccgccgtgaccgcgctcggtcgcggccacctggacatcacggacggcgccgccgtgcgttccgccgtggcggagcaccggccggcggtggtggtcaactgcgcggcgtggaccgcggtcgacgaggccgagtcggagccggccctggccatggcggtgaacggggagggcccgcgccatctcgcgcaggcgtgccgcgccgtgggggccgtgctgctccagctgtccaccgactacgtgttccccggctcgggcggacggccctaccgggaggaccacccgaccggtccgcgcacggtgtacggctgcaccaagcgggccggggagcgcgcggtgctggaggtcctcccggacaccggctacatcgtccgtacggcttggctgtacggagcgggcggccccaacttcgtggcgaagatgatccggctggaggcggagcaggacaccgtgctggtcgtggacgaccagcacggccagccgacctggaccgccgacctcgcggaccggctggcggccctgggggcggcggcgctggcgggaacggccccggccgggatctaccacgcgaccaacacgggcgggaccacctggaacgcgctggcgcgggagaccttccgcctgctcggcgccgacccggcacgggtccggcccaccaccagtctggcgctggcccggcctgccgtacggccccggtacagcgtgctggaccagtcccgctggaaggcggccggactcgaaccgctgcggcactggcgggccgcgctgacggagtcgttccccgcactctgcggagcggccggccggccggtgcccgggccgcgctga

SEQ ID NO: 49825 - protein, 304 aa, Streptomyces griseus subsp
MSPYPRPRWLVTGASGMLGRELTPLLDRRGAAVTALGRGHLDITDGAAVRSAVAEHRPAVVVNCAAWTAVDEAESEPALAMAVNGEGPRHLAQACRAVGAVLLQLSTDYVFPGSGGRPYREDHPTGPRTVYGCTKRAGERAVLEVLPDTGYIVRTAWLYGAGGPNFVAKMIRLEAEQDTVLVVDDQHGQPTWTADLADRLAALGAAALAGTAPAGIYHATNTGGTTWNALARETFRLLGADPARVRPTTSLALARPAVRPRYSVLDQSRWKAAGLEPLRHWRAALTESFPALCGAAGRPVPGPR

SEQ ID NO: 49826 - DNA, 924 bp, Saccharopolyspora erythraea
  CDS (1)..(924): transl_table=11
atgacccgcagccggctcgcggtgctggtgccgggcgggcgtggccaggtcggctcggagctgaggcggatcgtgtccggctggtccggagcactggtccacgcaccgggatcgggcgaactggacgtgaccgacgccgaggccgtcgccgacgcggtggactccttcgccgagaccgcgcgcgactccgacctgcggccggtggtcgtcaacgccgccgcctacaccgcggtcgacgcggcggaggaggagccggaccggtcggcggcgatcaacgtcgcgggcgcggcggccctggcggacgcctgcggcaggcgcggtgttccgctgctgcacatctccaccgactacgtcttcccgggggacgcgacccggccctacgagcccgacgacgagaccgggccgcgaacctcctacgggcgcacgaagctagacggagagcgtgcggtgctcgactcgggcgcgcgggcctgggtggtgcgcaccgcctgggtctacggcgcgggcgggaagaacttcgtcaagacgatggcgcggctggagtccgagcgcgacaccctgtccgttgtggacgaccaggtcggatgtcccacgtgggcggcggatctggcggcgggactgctggagctggccggacgggtggccgaacgcaagggccccgagcagcgggtgctgcactgcgtcaacggcggccagtcgagctggttcgagttcgcacgcgcggtcttcgccgagctgggcgccgacccggagcgggtccggccctgcagcagtgaggagttccccctcccggcgccgcggccggcgtactcggtgctctccggccgcgcttgggaggcgagcgggctgaccccgctgcgccactggcgggaagcgctcgccgcggccttcgccgccgacggcgacgcgctgcgcggccggtag

SEQ ID NO: 49827 - protein, 307 aa, Saccharopolyspora erythraea
MTRSRLAVLVPGGRGQVGSELRRIVSGWSGALVHAPGSGELDVTDAEAVADAVDSFAETARDSDLRPVVVNAAAYTAVDAAEEEPDRSAAINVAGAAALADACGRRGVPLLHISTDYVFPGDATRPYEPDDETGPRTSYGRTKLDGERAVLDSGARAWVVRTAWVYGAGGKNFVKTMARLESERDTLSVVDDQVGCPTWAADLAAGLLELAGRVAERKGPEQRVLHCVNGGQSSWFEFARAVFAELGADPERVRPCSSEEFPLPAPRPAYSVLSGRAWEASGLTPLRHWREALAAAFAADGDALRGR

SEQ ID NO: 49828 - DNA, 909 bp, Xanthomonas campestris pv
  CDS (1)..(909): transl_table=11
gtgaccacgctggtgttcggtgcgaacgggcaggtaggggcggaactgctacgcgcattggctgccgatggcgcggtgcaggcgacgacacgcagtggccgattgcctgatggtagcgcgtgcgagaccgcagacttcgacgcaccggaaactttgccagccttgctggaccggattggcccgtcgcttgtcgtcaatgctgcggcctacacggcagtggattgcgccgagcaggatcgcgtcagcgcgatgcgggcgaatgcgcaggcacctttgaccattgcggcatggtgtgccgcccgtgacgtgccgctggtgcattactcgaccgattacgtcttcgacggccaggacaccgccccctatcttgaggatgcccaaacctcgccgctaggcgtgtatggcgaaaccaagctcgctggtgagaacgccatccgtgcttccggcgcgcagcatctgatcctgcgtacggcatgggtgtacgcatcgcacggcgcgaatttcctgcgcaccatgttgcgtgtcggcgccgagcgcgacgagctacgcgtggtggccgatcagatcggaacgccgacgccggcggcgttgatcgccgatatcactgcacagttgcttcggcaacgcaccgccgaaacatcgggtacctggcatctcactgctgcagggcagaccagctggcatggctttgccgaggcgatcttcgaagaggctgtgagcgcaggactgctgccgcgtgcgccgcgcgtggtaccgatcaccaccgcagactatccgacccctgcgaagcggccggcgtattcgcggttgtcgatcgagaaactgcagcgcgatttcgacatcgtgctgccggaatggcgacctggcttgcagcgcgtgattgccgaagtcgccgctgccagacagtaa

SEQ ID NO: 49829 - protein, 302 aa, Xanthomonas campestris pv
MTTLVFGANGQVGAELLRALAADGAVQATTRSGRLPDGSACETADFDAPETLPALLDRIGPSLVVNAAAYTAVDCAEQDRVSAMRANAQAPLTIAAWCAARDVPLVHYSTDYVFDGQDTAPYLEDAQTSPLGVYGETKLAGENAIRASGAQHLILRTAWVYASHGANFLRTMLRVGAERDELRVVADQIGTPTPAALIADITAQLLRQRTAETSGTWHLTAAGQTSWHGFAEAIFEEAVSAGLLPRAPRVVPITTADYPTPAKRPAYSRLSIEKLQRDFDIVLPEWRPGLQRVIAEVAAARQ

SEQ ID NO: 49830 - DNA, 870 bp, Yersinia enterocolitica
  CDS (1)..(870): transl_table=11
atgaagagaaaaattcttatcactggtggtactggaatgcttggcgcttatgtcaccagtgcacttaaagataccgattataatgtcattgtcactgagagaaataccctaaatctttctgtgccggaggcaatatttagttatattacggcagagaagccggatgtaatactgcattttgcagctgaaacagatgttgacctctgtgagcgtgaacctgcccgtgctggaatatataaccacttggcaactgagcaaattgctcaagcagctaagttttgtggggcttggttattatatctttcttcatctaatgtttttgggggtgaaggtaaactaagttacaatgaattagatatcccattaccgatgaattattatggtcgttcaaagctaataggtgaatcttcagtacgtaatgcttgtacaaacaatcatctcataattcgcgctgggtggatgatcggtggtggcccagacaaggatcacaaatttgttggtaagattattcaacagataaaagctggctctacgtcaattaaagctgtgagtgatcgtttaggtagtattacttcagctatgcagttgtgtaattttattatatgggcgataaataaacgccatacaggaacgttgcattttgcaagcagtggtaccattagccgttttgatattgcttgcgcgattggcgaccttcttaatttcaaaggggatattataccagttcactcatcagtatttcctctatcagcacctcgcccttactcggaagggattgagtctatatatatgtctattcttagtgacgcaccaaaaccaagtctttggaaaagtgacttagctaaatatgtaggaacatttctcgtttaa

SEQ ID NO: 49831 - protein, 289 aa, Yersinia enterocolitica
MKRKILITGGTGMLGAYVTSALKDTDYNVIVTERNTLNLSVPEAIFSYITAEKPDVILHFAAETDVDLCEREPARAGIYNHLATEQIAQAAKFCGAWLLYLSSSNVFGGEGKLSYNELDIPLPMNYYGRSKLIGESSVRNACTNNHLIIRAGWMIGGGPDKDHKFVGKIIQQIKAGSTSIKAVSDRLGSITSAMQLCNFIIWAINKRHTGTLHFASSGTISRFDIACAIGDLLNFKGDIIPVHSSVFPLSAPRPYSEGIESIYMSILSDAPKPSLWKSDLAKYVGTFLV

SEQ ID NO: 49832 - DNA, 843 bp, Lactobacillus rhamnosus
  CDS (1)..(843): transl_table=11
atgaaaattttgattaccggcgcacaaggccaacttggtacagaactacgccacttattggatgcacgcggcatgacgtatcgggcgactgacgccaaagatctggatattaccgatgaagccgccgttaatcagtattttgcggactatcagcctgaggtagtgtatcactgtgctgcctatacagccgttgataaagccgaagacgaggcaaaggctatcaatcagctggtgaacgttgacggtactcgtaatctggctaaagctgcggagaaggtcgatgcgaccttagtttacatcagtactgattacgtatttgatggcgacagcgaggaaatttatacagttaacgatcaacctgcgccacgcaatgaatatggacgggcaaaatacgaaggcgaacagcaagtgcaaaagtaccttaagaagtactacattattcgtacttcttgggtatttggtgaatatggtcacaacttcgtctacacgatgttgaacctcgccaaaacgcataaggaattgaccgtggtggacgatcaatatggccgtccatcatggaccaaaacgctggccgagtttatgacctttgccgttgataagcgtttagattacggaatctatcatctatccaatgataacagctgtaattggtatgaatttgccagtgctattttggcggataaagacgttacggttaagccggtatcgtcaaaggaatacccacaaaaagcatggcggccccgccattcgattttggatttaagtaagacgaaggccaccgggtttgagattccaacgtggcaagacgctttaaagaatttcttgaaaagtatagacaaataa

SEQ ID NO: 49833 - protein, 280 aa, Lactobacillus rhamnosus
MKILITGAQGQLGTELRHLLDARGMTYRATDAKDLDITDEAAVNQYFADYQPEVVYHCAAYTAVDKAEDEAKAINQLVNVDGTRNLAKAAEKVDATLVYISTDYVFDGDSEEIYTVNDQPAPRNEYGRAKYEGEQQVQKYLKKYYIIRTSWVFGEYGHNFVYTMLNLAKTHKELTVVDDQYGRPSWTKTLAEFMTFAVDKRLDYGIYHLSNDNSCNWYEFASAILADKDVTVKPVSSKEYPQKAWRPRHSILDLSKTKATGFEIPTWQDALKNFLKSIDK

SEQ ID NO: 49834 - DNA, 843 bp, Lactobacillus rhamnosus
  CDS (1)..(843): transl_table=11
atgaaaattttgattaccggcgcacaaggccaacttggtacagaactacgccacttattggatgcacgcggcatgacgtatcgggcgactgacgccaaagatctggatattaccgatgaagccgccgttaatcagtattttgcggactatcagcctgaggtagtgtatcactgtgctgcctatacagccgttgataaagccgaagacgaggcaaaggctatcaatcagctggtgaacgttgacggtactcgtaatctggctaaagctgcggagaaggtcgatgcgaccttagtttacatcagtactgattacgtatttgatggcgacagcaaggaaatttatacagttaacgatcaacctgcgccacgcaatgaatatggacgggcaaaatacgaaggcgaacagcaagtgcaaaagtaccttaagaagtactacattattcgtacttcttgggtatttggtgaatatggtcacaacttcgtctacacgatgttgaacctcgccaaaacgcataaggaattgaccgtggtggacgatcaatatggccgtccatcatggaccaaaacgctggccgagtttatgacctttgccgttgataagcgtttagattacggaatctatcatctatccaatgatagcagctgtaattggtatgaatttgccagtgctattttggcggataaagacgttacggttaagccggtatcgtcaaaggaatacccacaaaaagcatggcggccccgccattcgattttggatttaagtaagacgaaggccaccgggtttgagattccaacgtggcaagacgctttaaagaatttcttgaaaagtatagacaaataa

SEQ ID NO: 49835 - protein, 280 aa, Lactobacillus rhamnosus
MKILITGAQGQLGTELRHLLDARGMTYRATDAKDLDITDEAAVNQYFADYQPEVVYHCAAYTAVDKAEDEAKAINQLVNVDGTRNLAKAAEKVDATLVYISTDYVFDGDSKEIYTVNDQPAPRNEYGRAKYEGEQQVQKYLKKYYIIRTSWVFGEYGHNFVYTMLNLAKTHKELTVVDDQYGRPSWTKTLAEFMTFAVDKRLDYGIYHLSNDSSCNWYEFASAILADKDVTVKPVSSKEYPQKAWRPRHSILDLSKTKATGFEIPTWQDALKNFLKSIDK

SEQ ID NO: 49836 - DNA, 843 bp, Lactobacillus rhamnosus
  CDS (1)..(843): transl_table=11
atgaaaattttgattaccggcgcacaaggccaacttggtacagaactacgccacttattggatgcacgcggcatgacgtatcgggcgactgacgccaaagatctggatattaccgatgaagccgccgttaatcagtattttgcggactatcagcctgaggtagtgtatcactgtgctgcctatacagccgttgataaagccgaagacgaggcaaaggctatcaatcagctggtgaacgttgacggtactcgtaatctggctaaagctgcggagaaggtcgatgcgaccttagtttacatcagtactgattacgtatttgatggcgacagcaaggaaatttatacagttaacgatcaacctgcgccacgcaatgaatatggacgggcaaaatacgaaggcgaacagcaagtgcaaaagtaccttaagaagtactacattattcgtacttcttgggtatttggtgaatatggtcacaacttcgtctacacgatgttgaacctcgccaaaacgcataaggaattgaccgtggtggacgatcaatatggccgtccatcatggaccaaaacgctggccgagtttatgacctttgccgttgataagcgtttagattacggaatctatcatctatccaatgataacagctgtaattggtatgaatttgccagtgctattttggcggataaagacgttacggttaagccggtatcgtcaaaggaatacccacaaaaagcatggcggccccgccattcgattttggatttaagtaagacgaaggccaccgggtttgagattccaacgtggcaagacgctttaaagaatttcttgaaaagtatagacaaataa

SEQ ID NO: 49837 - protein, 280 aa, Lactobacillus rhamnosus
MKILITGAQGQLGTELRHLLDARGMTYRATDAKDLDITDEAAVNQYFADYQPEVVYHCAAYTAVDKAEDEAKAINQLVNVDGTRNLAKAAEKVDATLVYISTDYVFDGDSKEIYTVNDQPAPRNEYGRAKYEGEQQVQKYLKKYYIIRTSWVFGEYGHNFVYTMLNLAKTHKELTVVDDQYGRPSWTKTLAEFMTFAVDKRLDYGIYHLSNDNSCNWYEFASAILADKDVTVKPVSSKEYPQKAWRPRHSILDLSKTKATGFEIPTWQDALKNFLKSIDK

SEQ ID NO: 49838 - DNA, 912 bp, Acetobacter tropicalis
  CDS (1)..(912): transl_table=11
atgagcattctggcatctgagggtggtcccattctggtcaccggtggcaccgggcagcttgcaacatctctggtcacgcttggtggtccgcgcgttcattgcgttggacgtcccagttttgattttgacaaacctgaaacattggccgccacgctggaagccgtcaaaccggttgccgtggccaatgccgcagcctggaccgctgttgatctggcggaaaaggaacctgaagcagccgcccgcgccaacacgagtggtccggcagaactggcccgcctgtgcgcccagcagaatattccgctgatccatgtttccacggattacgtcttttccggagacaaaggcacaccgtatgtggaaacagatgcggtctcccctgacacggtctatggcagcacaaaggctgaaggcgaaaagcaggcactggccgccaatcccaaaaccctgattttccggacatcttgggtgtattcggctcatggcaagaactttgttcgcaccatgctgaacgcaggtgccaaaaatccggccctgaaagtggtcggggaccagaaaggcaatcccaccagttcagatgatctggcgcgcgccattctttccgttctcgccattctcgaaaaagacggctggaaagatgattttgccggtatctaccatgtgcgtggaaccggtgagaccacatggcatggtctggcggtagaagctctgaaagatgcagcagaccatgggcaacctatgcccacagtcaccgctatccgcacggaagactggcccaccccggccaaacggcccgctgattcacggatggacaattccaagctcacgcgtgtatttggcatcaccatgccggcgtgggaagaaagcgtaaagaaagttgtaaaccagatttttgcccagactccttcagcctga

SEQ ID NO: 49839 - protein, 303 aa, Acetobacter tropicalis
MSILASEGGPILVTGGTGQLATSLVTLGGPRVHCVGRPSFDFDKPETLAATLEAVKPVAVANAAAWTAVDLAEKEPEAAARANTSGPAELARLCAQQNIPLIHVSTDYVFSGDKGTPYVETDAVSPDTVYGSTKAEGEKQALAANPKTLIFRTSWVYSAHGKNFVRTMLNAGAKNPALKVVGDQKGNPTSSDDLARAILSVLAILEKDGWKDDFAGIYHVRGTGETTWHGLAVEALKDAADHGQPMPTVTAIRTEDWPTPAKRPADSRMDNSKLTRVFGITMPAWEESVKKVVNQIFAQTPSA

SEQ ID NO: 49840 - DNA, 900 bp, Escherichia coli
  CDS (1)..(900): transl_table=11
atgaatatcctcctttttggcaaaacagggcaggtaggttgggaactacagcgtgctctggcacctctgggtaacttgattgctcttgatgttcattccactgattattgtggcgatttcagtaaccccgaaggtgtggctgaaaccgtcaaaaaaattcgcccagatgttattgttaatgttgctgctcataccgcggtagataaggctgagtcagaaccagaatttgcacaattactcaatgcgaccagcgttgaagcaattgcaaaagcggctaatgaagttggggcttgggtaattcattactcaactgactacgtcttccctggaaatggcgacatgccatggctcgagacggatgtaaccgctccgctcaatgtttatggcaaaaccaaattggctggagaaagagcattacaagaacattgcgcaaagcatcttattttccgtaccagctgggtatatgcaggtaaaggaaataactttgccaaaacaatgttacgtcaggcaaaagagcgcgaagaactggctgtgataaacgatcagtttggcgcaccaacaggtgctgaattgctggctgattgcaccgctcatgccattcgcgtggcattaaaaaaaccagaagttgctggcttgtaccatctggtagcaaatggcacaacaacctggcacgattacgccgcgctagtattcgaagaagcccgtaaagcagggattgaccttgcacttaacaaactcaacgccgtaccaacaacggcttatcctactccagcccgccgtcctcataattctcgcctcaataccgaaaagtttcagcagaactttgcgcttgtcttgcctgactggcaggtgggcgtgaaacgtatgctcaacgaattatttacgactacggcaatttaa

SEQ ID NO: 49841 - protein, 299 aa, Escherichia coli
MNILLFGKTGQVGWELQRALAPLGNLIALDVHSTDYCGDFSNPEGVAETVKKIRPDVIVNVAAHTAVDKAESEPEFAQLLNATSVEAIAKAANEVGAWVIHYSTDYVFPGNGDMPWLETDVTAPLNVYGKTKLAGERALQEHCAKHLIFRTSWVYAGKGNNFAKTMLRQAKEREELAVINDQFGAPTGAELLADCTAHAIRVALKKPEVAGLYHLVANGTTTWHDYAALVFEEARKAGIDLALNKLNAVPTTAYPTPARRPHNSRLNTEKFQQNFALVLPDWQVGVKRMLNELFTTTAI

SEQ ID NO: 49842 - DNA, 900 bp, Shigella dysenteriae
  CDS (1)..(900): transl_table=11
atgaatatcctccttttcggcaaaacagggcaggtaggttgggaactacagcgtgctctggcacctctgggtaatttgattgctcttgatgttcactccactgattactgtggtgattttagtaatcctgaaggtgtagctgaaaccgtaagaagcattcggcctgatattattgtcaacgcagccgctcacaccgcagtagacaaagcagaatcagaaccggagtttgcacaattacttaacgcgacgagtgtcgaagcgatcgcgaaagcagccaatgaagtcggcgcctgggttattcactactctactgactacgtatttccggggaccggtgaaataccatggcaggaggcggatgcaaccgcaccgctaaatgtttacggtgaaaccaagttagctggagaaaaagcattacaagagcattgtgcgaagcacctaattttccgtacaagctgggtctatgcaggtaaaggaaataacttcgccaaaacgatgttgcgtctgggaaaagagcgtgaagaattagccgttattaatgatcagtttggtgcgccaacaggtgctgaactgctggctgattgtacggcacatgcaattcgtgtggcagtgaataaaccagaagtcgcaggcttgtaccatctggtagccactggtaccacaacctggcacgattatgctgcgctggtttttgaagaggcacgaaaagcaggtattccccttgcactcaacaagctcaacgcagtaccaacaacagcttatcctacaccagctcgtcgtccacataactctcgccttaatacagaaaaatttcagcaaaattttgcgcttgttttgcctgactggcaggttggcgtgaaacgaatgctcaacgaattatttacgactacagcaatttaa

SEQ ID NO: 49843 - protein, 299 aa, Shigella dysenteriae
MNILLFGKTGQVGWELQRALAPLGNLIALDVHSTDYCGDFSNPEGVAETVRSIRPDIIVNAAAHTAVDKAESEPEFAQLLNATSVEAIAKAANEVGAWVIHYSTDYVFPGTGEIPWQEADATAPLNVYGETKLAGEKALQEHCAKHLIFRTSWVYAGKGNNFAKTMLRLGKEREELAVINDQFGAPTGAELLADCTAHAIRVAVNKPEVAGLYHLVATGTTTWHDYAALVFEEARKAGIPLALNKLNAVPTTAYPTPARRPHNSRLNTEKFQQNFALVLPDWQVGVKRMLNELFTTTAI

SEQ ID NO: 49844 - DNA, 963 bp, Mus musculus
  CDS (1)..(963)
atgccggaggccatggaacaggaggaagtgaacatccctagccggcgggttctcattactggtgccactgggcttcttggcagagcagtttacaaagagtttcagcagagcaactggcacaccgttggctgtggctttcgaagagcaagaccaaaattcgaacaagtgaacctgttggattctgaagctgttcatcacctcattcatgatttccagcctcatgtcatagtgcattgtgctgcagagagaagacctgatgttgttgagagtcagccagatgctgcttcccagctgaatgtgggtgcctctgggaacttggcaaaggaggcagctgcgattggagcatttctcatctacattagctcagattatgtgtttgatggcacaaatcccccttacacagaagaagatataccaagtcccctgaatctatatggaaaaacaaaattagatggagaaaaagcagtcctggagaataatttaggggctgctgtgttgagaattcctgttctgtatggggaagttgaaaagcttgaagaaagtgctgtgactgttatgttcgacaaggtgcagttcagcaacaagtcagcaaacatggaccattggcagcagaggttccccacacatgtgaaagacgtagccagtgtgtgccggcagctggcagagaagaggatgctggatccatccattaagggaacctttcactggtctggcaatgagcagatgaccaagtatgaaatggcgtgtgcaattgcagatgccttcaacctccccagcagccacttaagacctattactgacagtcctgtcataggagcacagcgccccaaaaatgctcagctcgattgctccaaattggagacgttgggcattggccagaggacaccatttcgaactggaatcaaagaatctctctggcctttcctcatcgacaagagatggagacagactgtctttcattag

SEQ ID NO: 49845 - protein, 320 aa, Mus musculus
MPEAMEQEEVNIPSRRVLITGATGLLGRAVYKEFQQSNWHTVGCGFRRARPKFEQVNLLDSEAVHHLIHDFQPHVIVHCAAERRPDVVESQPDAASQLNVGASGNLAKEAAAIGAFLIYISSDYVFDGTNPPYTEEDIPSPLNLYGKTKLDGEKAVLENNLGAAVLRIPVLYGEVEKLEESAVTVMFDKVQFSNKSANMDHWQQRFPTHVKDVASVCRQLAEKRMLDPSIKGTFHWSGNEQMTKYEMACAIADAFNLPSSHLRPITDSPVIGAQRPKNAQLDCSKLETLGIGQRTPFRTGIKESLWPFLIDKRWRQTVFH

SEQ ID NO: 49846 - DNA, 879 bp, Yersinia enterocolitica
  CDS (1)..(879): transl_table=11
atgagagtgataattactggggcccatggtcaagttggctgcagtctggttgagaaatttcaagatcaagataaggttgaattgttggcaactggccgagatgaattggacattacaaatcaatctgcggtggatgagattatcgaacagttcaaacctgattatattattaattcagcggcctatactgcggttgataaagcagaggaagaaatcgaactttcttatgcaataaatcatgatggtgtggctcatctggcaaaggcagcaaacaaaatgggggcagtacttcttcatatatctacagattatgtttttgatggtgaaaatgaagcagcttacgaagagacatcgccgacaaaacctaaatctatatatggaaaaagtaagcttgctggcgaacttgcaatagcagaagctatggataaatttttaattgtaagaacctcctgggtatttggtacacacggaaataactttgtaaaaacaatgcttagactaggtactactcatgagtgtcttagtattgttggcgaccaatttggtgggccaacctattcagacgatattgctaatgctttagtgaaaatggtgaagtttatagatgatggtaatacgcctgaatgggggtgttatcacttttcaggtgaacctcatgtcagttggtatgagtttgcaaaggttatttttaacaaagctcgagacaaaaaaataatagataaactaccaactttatctccaattaacacatcagaatatccaacaagagcgagtaggcctgccaactcaagattgaattgtaataagataaaagcccaattcaatatagaaccaagtaactggcaagtggctttgaataatattcaggaatataagtga

SEQ ID NO: 49847 - protein, 292 aa, Yersinia enterocolitica
MRVIITGAHGQVGCSLVEKFQDQDKVELLATGRDELDITNQSAVDEIIEQFKPDYIINSAAYTAVDKAEEEIELSYAINHDGVAHLAKAANKMGAVLLHISTDYVFDGENEAAYEETSPTKPKSIYGKSKLAGELAIAEAMDKFLIVRTSWVFGTHGNNFVKTMLRLGTTHECLSIVGDQFGGPTYSDDIANALVKMVKFIDDGNTPEWGCYHFSGEPHVSWYEFAKVIFNKARDKKIIDKLPTLSPINTSEYPTRASRPANSRLNCNKIKAQFNIEPSNWQVALNNIQEYK

SEQ ID NO: 49848 - DNA, 855 bp, Streptococcus oralis
  CDS (1)..(855): transl_table=11
atgatattaattacaggtgcaaatggtcaactcggtaccgaactacgttatttactagatgaacgaaatgtggactatgttgccgtggatgtggccgaaatggatatcaccaatgctgaaatggttgagaaagtctttgccgaggttaatccaactctggtctatcattgtgcagcttatactgctgttgatgcggcagaagatgagggaaaagaactggattttgccatcaacgtaactggaactgaaaatgtagccaaggcctctgagaaatacggagctactctggtctatatctcgacagactatgtctttgatgggaaaaaaccagtaggacaagaatgggaagtcgatgacctacctggtccgcagacagagtacgggcgtaccaagcgaatgggtgaggaactcgttgaaaaccttacgtcacagcattatatcatccgcactgcttgggtctttggaaattatggcaaaaactttgtctttaccatgcaaaatcttgctaaaacccataaaactctcactgttgtcaacgaccaacacggccgcccaacttggacacgtaccttggctgagttcatgacctacctgactgataatcaaaaagagtatggctactaccacttatcaaatgactccactgaagataccacttggtatgacttcgctgtcgagattcttaaggacagtgatgttgaagtgattccagtagactccagcaagtttcctgccaaggctaaacgccccctcaactcaaccatgagtttagccaaagcgaagaccacaggtttcgtcattccaacctggcaagatgcccttaaagaattttataaacaagaagtaagaaaataa

SEQ ID NO: 49849 - protein, 284 aa, Streptococcus oralis
MILITGANGQLGTELRYLLDERNVDYVAVDVAEMDITNAEMVEKVFAEVNPTLVYHCAAYTAVDAAEDEGKELDFAINVTGTENVAKASEKYGATLVYISTDYVFDGKKPVGQEWEVDDLPGPQTEYGRTKRMGEELVENLTSQHYIIRTAWVFGNYGKNFVFTMQNLAKTHKTLTVVNDQHGRPTWTRTLAEFMTYLTDNQKEYGYYHLSNDSTEDTTWYDFAVEILKDSDVEVIPVDSSKFPAKAKRPLNSTMSLAKAKTTGFVIPTWQDALKEFYKQEVRK

SEQ ID NO: 49850 - DNA, 900 bp, Shigella boydii
  CDS (1)..(900): transl_table=11
atgaatattctccttttcggcaaaacagggcaggtaggttgggaactacagcgtgctctggcacctttgggtaatttgattgctcttgatgttcactccactgattattgtggtgattttagtaatcctgaaggtgtggctgaaaccgtcaaaaaaattcgccctgatgttattgttaatgctgcggctcataccgcagtagataaggctgagtcagaacccgaatttgcacaattactcaatgcgaccagcgttgaatcaattgcaaaagcggctaatgaagttggggcctgggtaattcattactcaactgactacgtatttccgggaaccggtgaaataccatggctggagacggatgcaaccgcaccgctaaatgtttacggtgaaaccaagttagccggagaaaaagcgttacaggaacattgcgcgaagcatcttattttccgtaccagctgggtatacgcaggtaaaggaaataacttcgccaaaacgatgttgcgtctggcaaaagagcgtgaagaattagcggttattaacgatcagtttggtgcaccaacgggtgctgagctgctggctgattgtacggcacatgctattcgtgttgcactgaaaaaaacagaagtcgcaggcttgtaccatttggtagctagtggtaccacaacctggtacgattatgctgcgctggtttttgaagaggcgcgcaaagcaggcattccccttgtactcaacaagctcaacgcagtaccaacaactgcctatcctacaccagctcgtcgtccacataactctcgccttaatacagaaaaatttcagcagaactttgcgcttgtcttgcctgactggcaggttggcgtgaaacgaatgctcaacgaattatttacgactacagcaatttaa

SEQ ID NO: 49851 - protein, 299 aa, Shigella boydii
MNILLFGKTGQVGWELQRALAPLGNLIALDVHSTDYCGDFSNPEGVAETVKKIRPDVIVNAAAHTAVDKAESEPEFAQLLNATSVESIAKAANEVGAWVIHYSTDYVFPGTGEIPWLETDATAPLNVYGETKLAGEKALQEHCAKHLIFRTSWVYAGKGNNFAKTMLRLAKEREELAVINDQFGAPTGAELLADCTAHAIRVALKKTEVAGLYHLVASGTTTWYDYAALVFEEARKAGIPLVLNKLNAVPTTAYPTPARRPHNSRLNTEKFQQNFALVLPDWQVGVKRMLNELFTTTAI

SEQ ID NO: 49852 - DNA, 885 bp, Clostridium thermosaccharolyticum
  CDS (1)..(885): transl_table=11
atgaagctgcttattacgggggcaagaggacagcttggtatacagttaaggtctgttttagaaagaggtaaaagtgaattaggcaagattgacgatatttatagcaatgcagatataaagtatgtgtcacataatgatctagatattactaatctaaatgatgttttagattatgtagagcaatataaaccaaacgccatcataaattgtgctgcatatacaaatgttgatagatgcgaaagtgatattgacaatgcatttaaagtaaatgcaataggtccgagaaacctagcaatagcttcacatatagtagatgctaagttgcttcatatatcaacagattatgtatttagtggtgaaggcaacgaaccatataaagaatatgatatgccaaatccagtaagtgtatatggtaaatcaaaacttcttggagagcaatacgttagagacttttgtgataaatattttatagttaggacagcatggttatatggaaagtatggaaagaattttgtctatactatcataaatgcagcaaaagaaagaggatatttggaagttgtcaatgaccaaagaggtaatccaacaaatgcagaagatctagcatatcatattttaaaattaattctaaccgatgaatatggtatataccactgcactggaaatggagagtgcagttggtatgattttgcatgcaaaattgttgaatatactgacataaagtgccgtgttatgtctataacatctgataaaataaaaagagaagcaaaaagaccgtcgtattcatctcttgataacatgatgctaagatgcacgattggtgacaaaatgagaaattgggacgatgcattaaaatcttttatagatgttctagaaagcaaatag

SEQ ID NO: 49853 - protein, 294 aa, Clostridium thermosaccharolyticum
MKLLITGARGQLGIQLRSVLERGKSELGKIDDIYSNADIKYVSHNDLDITNLNDVLDYVEQYKPNAIINCAAYTNVDRCESDIDNAFKVNAIGPRNLAIASHIVDAKLLHISTDYVFSGEGNEPYKEYDMPNPVSVYGKSKLLGEQYVRDFCDKYFIVRTAWLYGKYGKNFVYTIINAAKERGYLEVVNDQRGNPTNAEDLAYHILKLILTDEYGIYHCTGNGECSWYDFACKIVEYTDIKCRVMSITSDKIKREAKRPSYSSLDNMMLRCTIGDKMRNWDDALKSFIDVLESK

SEQ ID NO: 49854 - DNA, 891 bp, Klebsiella terrigena
  CDS (1)..(891): transl_table=11
atgaaaattttacttattggcaaaaatggtcaggttggctgggagctacagcgctcgctgtccacgctgggtgaggtggtcgccgttgactatttcgataaggaactatgcggcgatctgacggatcttgccgggattgcgcaaaccgtccgccaggttaaaccggatgtggttgtcaatgcggccgcgcatacggcggtggataaagccgaaagcgaacgcgagctatccgatctactgaatgagcggggcgtagcggtactggcggaggagtcggcgaagctgggagccctgatggtgcactactccaccgactatgtctttgatggagaaggcgagcattatcgccccgaagacgaggccaccgggccgctgaacgtttatggcgaaaccaagcgcgcaggtgaactggcgctggcgcaggcgaaccctcgccatctgattttccgtaccagctgggtctacgcgacgcgtggggccaactttgccaaaaccatgctgcgcctggcgggcgaaaaagagacgctgtcgattattaacgaccagcacggcgcgccgaccggtgccgagctgctggcggattgtaccgccatcgccattcgtgaagagctgcgtaacagggcggttgccgggacctaccatctggtggccagcggtgaaaccagctggtatgactatgcccgctttgtctttgatgtggcgcgggcaaacggtgtgctgctggccatcaaagaggttaacgggatccctacaacggcttatccgacgccagcaaaacgtccgctgaattcccgcctgtcgaatgagaaattccagcgggtatttggcgtaacgctcccgggctggcgccagggcgttgagcgcgttgttgttgaagttttaggtaagtag

SEQ ID NO: 49855 - protein, 296 aa, Klebsiella terrigena
MKILLIGKNGQVGWELQRSLSTLGEVVAVDYFDKELCGDLTDLAGIAQTVRQVKPDVVVNAAAHTAVDKAESERELSDLLNERGVAVLAEESAKLGALMVHYSTDYVFDGEGEHYRPEDEATGPLNVYGETKRAGELALAQANPRHLIFRTSWVYATRGANFAKTMLRLAGEKETLSIINDQHGAPTGAELLADCTAIAIREELRNRAVAGTYHLVASGETSWYDYARFVFDVARANGVLLAIKEVNGIPTTAYPTPAKRPLNSRLSNEKFQRVFGVTLPGWRQGVERVVVEVLGK

SEQ ID NO: 49856 - DNA, 861 bp, Bacillus stearothermophilus
  CDS (1)..(861): transl_table=11
atgagtaaacacaaaatattagttactggtgcgaaaggacaactcggcgcagagatggtcaaattgttaaaagacatggaatatgaagtatatggatatggacgagcagaactcgatataacggattttcagcaagtgaaaagtgttattgaccatatccatcctaatgttgttattcacgctgctgcttatacaaatgtagatgcagcagagtccgaaccagatcaagcatttttcgtgaatgcatacggaacaagaaacgtagtcgtagcgtcagaacatataggtgctaagtttgtttatataagtaccgattatgtgtttgacggcaccgccaacgcaccttataacgagtttgcttttacgagtccgataagcgtatatggaaaaagtaaactagccggtgaacagtttgtaagagaccttcactctaaattttttattattcgaacatcgtgggtttacgggaaacatggaaataattttgtgaaaacaatgttaaaacttgcacaagaacaaaaagaattgtttgtcgttgatgatcaaattggatgcccaacttatacagttgatttagctagctgcatttttcaacttattcatactgagaaatatggggtctaccatatttctaattcaggccattgctcttggtatgaatttgcaaaagccattttcgaagaggctaatgttaatatagtagttaatccatgtaaaacaaaagattatccaagacctgctcaacgccctctatattctgtattggatcatatggctctacgattaaatggatttaaagaattaaggcattggcgggaggcgttaaaggaatttattaaagtttatggggtgaaaccttga

SEQ ID NO: 49857 - protein, 286 aa, Bacillus stearothermophilus
MSKHKILVTGAKGQLGAEMVKLLKDMEYEVYGYGRAELDITDFQQVKSVIDHIHPNVVIHAAAYTNVDAAESEPDQAFFVNAYGTRNVVVASEHIGAKFVYISTDYVFDGTANAPYNEFAFTSPISVYGKSKLAGEQFVRDLHSKFFIIRTSWVYGKHGNNFVKTMLKLAQEQKELFVVDDQIGCPTYTVDLASCIFQLIHTEKYGVYHISNSGHCSWYEFAKAIFEEANVNIVVNPCKTKDYPRPAQRPLYSVLDHMALRLNGFKELRHWREALKEFIKVYGVKP

SEQ ID NO: 49858 - DNA, 846 bp, Bacillus stearothermophilus
  CDS (1)..(846): transl_table=11
atgaaagtgattgtaacaggtgcaaaaggtcagcttggtacagatttagtccatttacttgctgatagagggtatgaagtttatggttatggacgagaggagttagatataacaaactttgaccaagtaaaacaggttatcagtgaagttaatcctgatgttgtcattcatgccgctgcatatacaaaagtcgatttagcggaatctgaaccagaccaagcatttttaattaacgcatatgggacgagaaatgttgctgtcgcatcggaagcagtaggtgctaaacttgtctatataagtacggattatgtttttgatggaacggctactacgccatataatgaatttgctctaacaaatccacttagtgtatacggtaaaagcaagttggcaggggaacagtttgttcgcgacttacactctaagttttttatcgtcagaacttcttgggtgtatggaaagcatggaaataacttcgtcaaaacaatgttacggttggcccaagaacgtaacgagttaatggttgtcaatgatcaagttggctgtccaacctatacagtagatttagcaaattgtattttagaaataattcaaacagaaaagtacggcatttatcatgtttctaattcgggacattgttcttggtatgagtttgcgaaagcgatttttgaggaagctggaattgaggttaaagtaaatccttgtacgacaaaagatttcccaagaccagcgccaaggccagcgtattccgtgtttgagcatatggctcttagattgaatggattcaatgaaatgagaaattggagagaagcattgaaagagtttattgtacaaattaaactataa

SEQ ID NO: 49859 - protein, 281 aa, Bacillus stearothermophilus
MKVIVTGAKGQLGTDLVHLLADRGYEVYGYGREELDITNFDQVKQVISEVNPDVVIHAAAYTKVDLAESEPDQAFLINAYGTRNVAVASEAVGAKLVYISTDYVFDGTATTPYNEFALTNPLSVYGKSKLAGEQFVRDLHSKFFIVRTSWVYGKHGNNFVKTMLRLAQERNELMVVNDQVGCPTYTVDLANCILEIIQTEKYGIYHVSNSGHCSWYEFAKAIFEEAGIEVKVNPCTTKDFPRPAPRPAYSVFEHMALRLNGFNEMRNWREALKEFIVQIKL

SEQ ID NO: 49860 - DNA, 849 bp, Bacillus stearothermophilus
  CDS (1)..(849): transl_table=11
atgaaaattgttgttacgggggcaaacgggcagttaggtcaagagcttgtaggacaactgcagcaaacgaacgttgagctctattcgtttacaaaaagtgacttagatattacgaatgacagcatagtaaacgaaacgattacaaagattaagcctgatatccttataaacgctgctgcttatacaaaagtcgatcaagcggaaatcgaggaagaaacagcttatttagtgaatgcgtttgggcaaagaaatttggcgatagcagcggaaaaagttggggcgaaaatatgttatattagcacagattacgtctttgatgggacttcgatgaccccttatcgagaatatgatcgaacgaatccactaggggtatacggaaaatcaaagtatgctggtgaagaactgacaaaatcattatgttcgcgatattttattgtgagaacggcatgggtatatggagagtttgggcaaaattttgtcaaaacgatgcttcggttagcaaaagaaaaagaagaaatcggtgttgtcaatgaccaaattggctctcctacatatacggttgacttagctcgctttattattgaattagtccaaactgagaagtttggaatttatcatgcgacaaatagtgggtcatgttcttggtacgagtttgccaaagctatttttgaagaaagtaatattcatgtgaaagtaaatccaatcacgacggaacaatttcctagaccggcagcacgtcctaaatactctgtgttagacaattttgcgatgaaggtgaatgggtttccaatgttaagacattggcgtgaagcattgaaagaatttttgaaaagtgattttaggatttga

SEQ ID NO: 49861 - protein, 282 aa, Bacillus stearothermophilus
MKIVVTGANGQLGQELVGQLQQTNVELYSFTKSDLDITNDSIVNETITKIKPDILINAAAYTKVDQAEIEEETAYLVNAFGQRNLAIAAEKVGAKICYISTDYVFDGTSMTPYREYDRTNPLGVYGKSKYAGEELTKSLCSRYFIVRTAWVYGEFGQNFVKTMLRLAKEKEEIGVVNDQIGSPTYTVDLARFIIELVQTEKFGIYHATNSGSCSWYEFAKAIFEESNIHVKVNPITTEQFPRPAARPKYSVLDNFAMKVNGFPMLRHWREALKEFLKSDFRI

SEQ ID NO: 49862 - DNA, 864 bp, Bacteroides coprosuis
  CDS (1)..(864): transl_table=11
atgaatattctgattactggtgctaatggacagttggggtctgagtttagagaactatcgcctctttactccagctataatttcttctttgctggttgtgattctctgaatatctgtgaagtagaggctgtacgtgagtatatatccgcccataatattgattttattataaactgtgcggcatatactgctgttgatgcagcagaagagaatccagtagattgtgataaggtaaatcatacagcagtatccaatttggctaaagtagcagatgagtatgatgctggcttgattcatttttcaactgattatgtatttgatggttctaagaatactccttatacagaagaagatcctacttcagcgcgggctatttatggtataacaaagctagctagtgaacgtgtggctttagctaaatgtaataaggctatggttataaggacctcttgggtatattctttttatggacataactttgtgaagactgtattgaagcaacttcagcttagaggatctatgggagttgtttatgatcagatagggactcctacttatgccaaagatttagcaaagtttgtacttaatgtgttgagtactgattttataccagggttataccattatagtaacgaaggtgtttgttcttggtttgattttgctaaaatggtacaacgatttgctggtctaaaaggggaaatttaccctattcactctgatcagtatcctgcaaaagctcctagacctgcatattctgtactagataaaacaaaggtaaaagacacctataacataaagattccttactgggtagatagcctagaggagtgcattcagagaattcaaaacgatactaataaatag

SEQ ID NO: 49863 - protein, 287 aa, Bacteroides coprosuis
MNILITGANGQLGSEFRELSPLYSSYNFFFAGCDSLNICEVEAVREYISAHNIDFIINCAAYTAVDAAEENPVDCDKVNHTAVSNLAKVADEYDAGLIHFSTDYVFDGSKNTPYTEEDPTSARAIYGITKLASERVALAKCNKAMVIRTSWVYSFYGHNFVKTVLKQLQLRGSMGVVYDQIGTPTYAKDLAKFVLNVLSTDFIPGLYHYSNEGVCSWFDFAKMVQRFAGLKGEIYPIHSDQYPAKAPRPAYSVLDKTKVKDTYNIKIPYWVDSLEECIQRIQNDTNK

SEQ ID NO: 49864 - DNA, 852 bp, Thermotoga sp
  CDS (1)..(852): transl_table=11
atgaaggttcttataacaggagcgaatggacaacttggaagagcctttcaggaactgttcaaaaacgagaaagttgaattcatagcagcaccgaaagaagaacttgacataacagatctcagaaagatcagggaatttgtttcaaagaacccggaaataacccacataatcaactgtgctgcttacaacaaagtggacgaagctgaaagagactggaaaacagcgtaccttgtcaacggcatcggcccgaaaaatcttgcgatagtttcaaacgaaataggtgcggaactcgttcattattcaacggattatgtcttttcaggaaagaaaggatctccatacacgatatacgacacttccgatcctataaacaaatatggtgagagtaaggtacttggagaaagattcgttatgagcttttctaacagatactacctcatcagaacgagctgggtgttcggtgatggtatgaactttgtgagaaaagttttggaatggagcaagaaaagcaaagtgctgagaatcgtagatgatgaagtgagttccccaacgtacgcaccagatcttgcaaaagcaacgtgggagttgataaaactcaaagcgtacggattgtatcacataacgaacagtggctattgctctcgatatgaatgggctgagttcattctgaacgaaatagggtgggatggagagctcaagagagcaaagcaggaagattttaatcttcccgcgaaaaggcctaagttttcggtgttggatgggtttggattgagggaatttactgggatgaagatggaatcgtggaaaaggagaacaacagaatttatcgaaaaattaggaagtgattactga

SEQ ID NO: 49865 - protein, 283 aa, Thermotoga sp
MKVLITGANGQLGRAFQELFKNEKVEFIAAPKEELDITDLRKIREFVSKNPEITHIINCAAYNKVDEAERDWKTAYLVNGIGPKNLAIVSNEIGAELVHYSTDYVFSGKKGSPYTIYDTSDPINKYGESKVLGERFVMSFSNRYYLIRTSWVFGDGMNFVRKVLEWSKKSKVLRIVDDEVSSPTYAPDLAKATWELIKLKAYGLYHITNSGYCSRYEWAEFILNEIGWDGELKRAKQEDFNLPAKRPKFSVLDGFGLREFTGMKMESWKRRTTEFIEKLGSDY

SEQ ID NO: 49866 - DNA, 867 bp, Sphingomonas elodea
  CDS (1)..(867): transl_table=11
atgcgcatcctcgtcaccgggcatgacggccaggtcgcccagtcgctgggcgaacaagcacagggccacgagctgatcttcaccagctatcccgagttcgacctctccaggccggagacgatcgaagcggcggtagcgaagatccagcccgagctgatcgtgtcggccgccgcctataccgcggtcgacaagtccgagagcgaacccgagctcgccatggcgatcaacggtgacggccccggcgtgctcgcgcgtgcgggcgcgaagatcggcgcgccgatcatccagctgtcgaccgactatgtgttcgacggcagcctcgaccgcccctggcgcgaggacgaccccaccggcccgctcggcgtctatggcgcgaccaagctggccggcgagcaggcggtacaggcctcgggtgcgaccaacgccgtgatccggctggcctgggtctacagcccgttcggcaacaacttcgtcaagacgatgctgcgcctcgccgagacgcgcgacgcgctgaacgtggtggaagaccagcagggctgccccagctcggccctggacatcgcctcggcgatcctggcggtggtcgaacgctggcagcgcgacggcgcgttcagcggcgtctaccacttcgccggctcgggcgagaccaactgggccgacttcgcccgcgccatctttgccgaaagtgccaagcgcggcggcccgacggcgacggtgaccggcatccccagttcggactatccgacgcctgccaagcgcccggccaactcccgcctcgattgcagccgcttcgccgataccttcggctatcgcgcgccggcctggcaggactcgctggcggtggtgatgggacgcctgctcggctga

SEQ ID NO: 49867 - protein, 288 aa, Sphingomonas elodea
MRILVTGHDGQVAQSLGEQAQGHELIFTSYPEFDLSRPETIEAAVAKIQPELIVSAAAYTAVDKSESEPELAMAINGDGPGVLARAGAKIGAPIIQLSTDYVFDGSLDRPWREDDPTGPLGVYGATKLAGEQAVQASGATNAVIRLAWVYSPFGNNFVKTMLRLAETRDALNVVEDQQGCPSSALDIASAILAVVERWQRDGAFSGVYHFAGSGETNWADFARAIFAESAKRGGPTATVTGIPSSDYPTPAKRPANSRLDCSRFADTFGYRAPAWQDSLAVVMGRLLG

SEQ ID NO: 49868 - DNA, 852 bp, Streptococcus gordonii
  CDS (1)..(852): n means a or g or c or t/u, s means g or c
atgattttaatcacaggttcaaatggtcagctgggaacagaacttcgtcatcttttagatgagcgcaatgaggattatgttgcagttgacgttgccgaaatggatattacgaatgctgaaatggttgaaaaggtctttgcagaagttaaaccaaccttggtatatcactgtgccgcttatacagcagttgatgcagcagaggatgaaggaaaagagcttaattatgccatcaatgtgactggaactgaaaatgtagcaaaagcggctgaagcacacggagcgacattagtttatatttctacggactatgtctttgatggccaaaagcctgtcggtgaagaatgggaagtagatgatcaaccagatcctaaaacagaatacggccgtaccaagcgtatgggagaagagttggtagagaagtattctagtcgtttctacattattcgtacagcttgggtctttggtaattatggtaaaaactttgtctttacaatgcaaaatctagctaagactcacccgactttgacagttgttaacgaccagcatggccgtccgacttggactcgtaccttagctgaattcatgacctacttggctgraaatcaaaaggaattcggctattaccatctgtctaatgacgctgcagaagacactacttggtatgactttgcagttgagattctcaaggatacgaatgtagaagttaaaccggtggactcaagccaattccctgctaaagcaaaacggccactcaattcaactatgagcttgactaaggcaaaggcgactggctttgttattccaagctggcaagatgccctgaaagaattctataaacaagaaaagaaataa

SEQ ID NO: 49869 - protein, 283 aa, Streptococcus gordonii
  Xaa in position 200 is unknown
MILITGSNGQLGTELRHLLDERNEDYVAVDVAEMDITNAEMVEKVFAEVKPTLVYHCAAYTAVDAAEDEGKELNYAINVTGTENVAKAAEAHGATLVYISTDYVFDGQKPVGEEWEVDDQPDPKTEYGRTKRMGEELVEKYSSRFYIIRTAWVFGNYGKNFVFTMQNLAKTHPTLTVVNDQHGRPTWTRTLAEFMTYLAXNQKEFGYYHLSNDAAEDTTWYDFAVEILKDTNVEVKPVDSSQFPAKAKRPLNSTMSLTKAKATGFVIPSWQDALKEFYKQEKK

SEQ ID NO: 49870 - DNA, 888 bp, Vibrio cholerae
  CDS (1)..(888): transl_table=11
atgatgcgtgttctagtgacgggcagccgtggtcaagtggggcactgcttagtccagcagctcagtaccatgaaagaggttgagtttttagcggtagaccgcgaccaactggatatcacctatcccgctcaagtggatgcggtggtgaacgaattcaagcctaacatcatcataaatgcggcggcgcataccgccgttgaccgtgcagagcaagagattgagctctcttacgcgattaaccgagatggccctcactacctagcccaagcagcacagaaggttggtgcggcgatactgcacatttcgacagactatgtcttttccggtgataaaccgaatccatatctcgaagctgaccctaccgcaccactgggcgtgtatggcgaaagcaaattagcgggagaaatcgcggtcgctcaagcctgccctcggcacattatcttgcgcacggcttgggtgtttggtgagcatggcaataactttgtgaaaaccatgcttcgacttgctgccgatacctgtcatgaactgagtattgttggtgaccaatttggtggtcctacctacgcaggtgatattgctagcgcacttgcaactatagcgaggaaaatctcgaaaggtgattcaattgaatacggtatatatcattattctggtacgccacatgtaagctggtgtcaatttgcagatgctatttttgatttagcagttgaacaaggtgttttgagttcaaaacctataattaagagtgttactacagaacaatacccaacgctagctaaacgccctgcgaattctaaaatgagtaataaaaagattgagaataagcttggtattaagggaagcgattggcacgccgcattaaaagatatcaaaatgtatacgaggtaa

SEQ ID NO: 49871 - protein, 295 aa, Vibrio cholerae
MMRVLVTGSRGQVGHCLVQQLSTMKEVEFLAVDRDQLDITYPAQVDAVVNEFKPNIIINAAAHTAVDRAEQEIELSYAINRDGPHYLAQAAQKVGAAILHISTDYVFSGDKPNPYLEADPTAPLGVYGESKLAGEIAVAQACPRHIILRTAWVFGEHGNNFVKTMLRLAADTCHELSIVGDQFGGPTYAGDIASALATIARKISKGDSIEYGIYHYSGTPHVSWCQFADAIFDLAVEQGVLSSKPIIKSVTTEQYPTLAKRPANSKMSNKKIENKLGIKGSDWHAALKDIKMYTR

SEQ ID NO: 49872 - DNA, 855 bp, Vibrio cholerae
  CDS (1)..(855): transl_table=11
atgtttttagtaacgggttcaaatggattacttggaagtgaaataagaagaatattgggaagtgataaagggatttatacagatagaaatgaactagacgtaacagataagaatagtattaagaagttcctcatgtctaggaaagatattgaggtgatcataaattgcgctgctggagctaatgccgaatacattgaggaaaatagtgaatggggcagaagaattactgttgatgctcccatgtatttagctcaggaagcaaaagagaatggaataaagctaatacatatttctacagattatgtttttgatggagataggaatgtgccatatattgaaagtgattatactaatggtctttcattatacggtagattcaaggcggaaggggaacaagctgtattaaaaaatagtgatacttgtgcaatcataagaaccgcatggcttttttctgagcaaatgaaagattttattggtgcaatggtgcgtctttcggagacaagagacagcgtaaatgttgtatttgatcaagtcggaagtccaacatatgtacctgacttagcctcacacataataacaatagctaataacctaaatgttggagagaaagagatttttcatgttacaaatgaaggtgtttgtagttggtacgatattgcatgtcaaattatgagagaattgaaaattgattgcaaggttaaaccaataagaagtagtgaatataaaactaaagcagcaaggcctcattattcagtgctggataagaaaaaagtaaaagaaagattttcccttgaaattagacattatagtgatgcattatctgagtgtttaaaaaacatacatgccactaggtag

SEQ ID NO: 49873 - protein, 284 aa, Vibrio cholerae
MFLVTGSNGLLGSEIRRILGSDKGIYTDRNELDVTDKNSIKKFLMSRKDIEVIINCAAGANAEYIEENSEWGRRITVDAPMYLAQEAKENGIKLIHISTDYVFDGDRNVPYIESDYTNGLSLYGRFKAEGEQAVLKNSDTCAIIRTAWLFSEQMKDFIGAMVRLSETRDSVNVVFDQVGSPTYVPDLASHIITIANNLNVGEKEIFHVTNEGVCSWYDIACQIMRELKIDCKVKPIRSSEYKTKAARPHYSVLDKKKVKERFSLEIRHYSDALSECLKNIHATR

SEQ ID NO: 49874 - DNA, 891 bp, Vibrio cholerae
  CDS (1)..(891): transl_table=11
atgatgcgtgttctagtgacgggcagccgtggtcaagtggggcactgcttagtccagcagctcagtaccatgaaagaggttgagtttttagcggtagaccgcgaccaactggatatcacccattccgctcaagtggatgcggtggtgaatgaattcaagcctaacatcatcatcaatgcggcggcgcataccgccgttgaccgtgcagagcaagagattgagctctcttacgcgattaaccgagatggccctcactacctagcccaagcggcacagaaggttggtgcggcgatactgcacatttcgacagactatgtcttttctggtgataaaccgaatccatatctcgaaactgaccctaccgcaccacagggcgtgtatggcgaaagcaaattagcgggagaaatcgcggtcgctcaagcctgccctcggcacattatcttgcgcacggcttgggtgtttggtgagcatggcaataactttgtgaaaaccatgctgcgtttagcacaaacacgcgatgccctaggcgtggtagcagaccagtatggtggcccgacgtatgcgggagatattgccaacgcgctactgatgatggcgaaagcgattgtggaggggaaatctaccgcttttggtgtatatcatttttctggattaccgcatgtcagttggcatgagtttgcttgcactatttttgataaagcccgtgaccaagggatattgaataaatccttgcaagtcaatgcaattactacgcaagagtacccaaccccggcgaagaggccggctaactctcagttagacacccagaaaatccatcaacacttcggtgtagttgccagcgattggcaggccgcattgaaccatctcatcgactataagagtgaagaataa

SEQ ID NO: 49875 - protein, 296 aa, Vibrio cholerae
MMRVLVTGSRGQVGHCLVQQLSTMKEVEFLAVDRDQLDITHSAQVDAVVNEFKPNIIINAAAHTAVDRAEQEIELSYAINRDGPHYLAQAAQKVGAAILHISTDYVFSGDKPNPYLETDPTAPQGVYGESKLAGEIAVAQACPRHIILRTAWVFGEHGNNFVKTMLRLAQTRDALGVVADQYGGPTYAGDIANALLMMAKAIVEGKSTAFGVYHFSGLPHVSWHEFACTIFDKARDQGILNKSLQVNAITTQEYPTPAKRPANSQLDTQKIHQHFGVVASDWQAALNHLIDYKSEE

SEQ ID NO: 49876 - DNA, 891 bp, Vibrio cholerae
  CDS (1)..(891): transl_table=11
atgatgcgtgttctagtgacgggcagccgtggtcaagtggggcactgcttagtccagcagctcagtaccatgaaagaggttgagtttttagcggtagaccgcgaccaactggatatcacctatcccgctcaagtggatgcggtggtgaacgaattcaagcctaacatcatcatcaatgcggcggcgcataccgccgttgaccgtgcagagcaagagattgagctctcttacgcgattaaccgagatggccctcactacctagcccaagcggcacagaaggttggtgcggcgatactgcacatttcgacagactatgtcttttccggtgataaaccgaatccatatctcgaaactgaccctaccgcaccacagggcgtgtatggcgaaagcaaattagcgggagaaatcgcggtcgctcaagcctgctctcggcacattatcttgcgcacggcttgggtgtttggtgagcatggcaataactttgtgaaaaccatgctgcgtttagcacaaacacgcgatgccctaggcgtggtagcagaccagtgtggtggcccgacgtatgcgggagatattgccaacgcgctactgatgatggcgaaagcgattgtggagggtaaatctaccgcttttggtgtgtatcatttttctggattaccgcatgtcagttggcatgagtttgcttgcactatttttgataaagcccgtgaccaagggatattgaataaatccttgcaagtcaatgcaattactacgcaagagtacccaaccccggcgaagagaccggctaactctcggttagacacccagaaaatccatcaacacttcggtgtagttgccagtgattggcagactgcattgaaccatctcatcgactataagagtgaagaataa

SEQ ID NO: 49877 - protein, 296 aa, Vibrio cholerae
MMRVLVTGSRGQVGHCLVQQLSTMKEVEFLAVDRDQLDITYPAQVDAVVNEFKPNIIINAAAHTAVDRAEQEIELSYAINRDGPHYLAQAAQKVGAAILHISTDYVFSGDKPNPYLETDPTAPQGVYGESKLAGEIAVAQACSRHIILRTAWVFGEHGNNFVKTMLRLAQTRDALGVVADQCGGPTYAGDIANALLMMAKAIVEGKSTAFGVYHFSGLPHVSWHEFACTIFDKARDQGILNKSLQVNAITTQEYPTPAKRPANSRLDTQKIHQHFGVVASDWQTALNHLIDYKSEE

SEQ ID NO: 49878 - DNA, 891 bp, Vibrio cholerae
  CDS (1)..(891): transl_table=11
atgatgcgtgttctagtgacgggcagccgtggtcaagtggggcactgcttagtccagcagctcagtaccatgaaagaggttgagtttttagcggtagaccgcgaccaactggatatcacctatcccgctcaagtggatgcggtggtgaacaaattcaagcctaacatcatcatcaatgcggcggcgcataccgccgttgaccgagcagagcaagagattgagctctcttacgcgattaaccgagatggccctcactacctagcccaagcggcacagaaggttggtgcggcgatactgcacatttcgacagactatgtcttttccggtgataaaccgaatccatatctcgaaactgaccctaccgcaccacagggcgtgtatggcgaaagcaaattagcgggagaaatcgcggtcgctcaagcctgccctcggcacattatcttgcgcacggcttgggtgtttggtgagcatggcaataactttgtgaaaaccatgttgcgtttggcacaaacacgcgatgccctaggcgtggtagcagaccagtgtggtggccctacgtatgcgggagatattgccaacgcgctactgatgatggcgaaagcgattgtggatgggaaatctaccgcttttggtgtgtatcatttttctggattaccgcatgtcagttggcatgagtttgcttgcactatttttgataaagcccgtgaccaagggatattgaataaatccttgcaagtcaatgcaattactacgcaagagtacccaaccccggcgaagaggccggctaactctcggttagacacccagaaaatccatcaacacttcggtgtagttgccagtgattggcagactgcattgaaccatctcatcgactataagagtgaagaataa

SEQ ID NO: 49879 - protein, 296 aa, Vibrio cholerae
MMRVLVTGSRGQVGHCLVQQLSTMKEVEFLAVDRDQLDITYPAQVDAVVNKFKPNIIINAAAHTAVDRAEQEIELSYAINRDGPHYLAQAAQKVGAAILHISTDYVFSGDKPNPYLETDPTAPQGVYGESKLAGEIAVAQACPRHIILRTAWVFGEHGNNFVKTMLRLAQTRDALGVVADQCGGPTYAGDIANALLMMAKAIVDGKSTAFGVYHFSGLPHVSWHEFACTIFDKARDQGILNKSLQVNAITTQEYPTPAKRPANSRLDTQKIHQHFGVVASDWQTALNHLIDYKSEE

SEQ ID NO: 49880 - DNA, 891 bp, Vibrio cholerae
  CDS (1)..(891): transl_table=11
atgatgcgtgttctagtgacgggcagccgtggtcaagtggggcactgcttagcccagcagctcagtaccatgaaagaggttgagtttttagcgatagaccgcgaccaactggatatcacccattctgctcaagtggatgcggtggtgaacgaatttaagcctaacatcatcatcaatgcggcggcgcataccgccgttgaccgtgcagagcaagagattgagctctcttacgcgattaaccgagatggccctcactacctagcccaagcggcacagaaggttggtgcggcgatactgcacatttcgacagactatgtcttttccggtgataaaccgaatccatatctcgaaactgaccctaccgcaccacagggcgtgtatggcgaaagcaaattagcgggagaaatcgcggtcgctcaagcctgccctcggcacattatcttgcgcacggcttgggtgtttggtgagcatggcaataactttgtgaaaaccatgctgcgtttagcacaaacacgcgatgccctaggcgtggtagcagaccagtatggtggccctacgtatgcgggagatattgccaacgcgctactgatgatggcgaaagcgattgtggaggggaaatctaccgcttttggtgtgtatcatttttctggattaccgcatgtcagttggcatgagtttgcttgcactatttttgataaagcccgtgaccaagggatattgaataaatccttgcaagtcaatgcaatcactacgcaagagtacccaaccccggcgaagagaccggctaactctcggttagacacccagaaaatccatcaacacttcggtgtagttgccagtgattggcagactgcattgaaccatctcatcgactataagagtgaagaataa

SEQ ID NO: 49881 - protein, 296 aa, Vibrio cholerae
MMRVLVTGSRGQVGHCLAQQLSTMKEVEFLAIDRDQLDITHSAQVDAVVNEFKPNIIINAAAHTAVDRAEQEIELSYAINRDGPHYLAQAAQKVGAAILHISTDYVFSGDKPNPYLETDPTAPQGVYGESKLAGEIAVAQACPRHIILRTAWVFGEHGNNFVKTMLRLAQTRDALGVVADQYGGPTYAGDIANALLMMAKAIVEGKSTAFGVYHFSGLPHVSWHEFACTIFDKARDQGILNKSLQVNAITTQEYPTPAKRPANSRLDTQKIHQHFGVVASDWQTALNHLIDYKSEE

SEQ ID NO: 49882 - DNA, 873 bp, Vibrio vulnificus
  CDS (1)..(873): transl_table=11
atgaaagttttaattaccggatgtaacggccaagttggtcattgtctgactgagcgtctaaaaactcaagctgaggtgttggctttagattacgaagggctagatattaccaaccgtgaagctgtgtttaacacagtggctgagtttaagcctaattacattatcaacgccgcagcgtataccgcggtcgaccgtgctgagcaagaagttaagctttcttttgccattaaccgtgatggcccaagttacttagcacaagcctccaatgagtgcggcgcggttatgctacacatttccaccgattatgtattcgatggtatgggcgataagccataccaagaaggcgataacaccggacctcaaggtgtttatgggcagagcaaattagcaggagagcaagccgtagctgaagcttgtcctgagcatttgattctacgtacagcttgggtgtttggggagcatggcaacaactttgtaaaaaccatgctgcgtttagcacaaagccgcgatgagctgagtattgtcggcgatcagtttggcggcccaacctatgccggcgatattgctgatgcgttgattgccatggtgcaatacatcgagctgggtagcaaacctaagtggggtgtgtatcacttctctggaatgccatacgccagctggtatgatttcgcgtctgctatattccaagcggcagaacaacataaaatgttggataaacaaccactactctcttcaattccaacatcagcttacccaacgccagccaaacgcccagccaactcccgattagattgtgcgaaaattgaaaatcaattcggcataaagccaagtgattggcaggttgctttaaacaatattcaagcttataagtaa

SEQ ID NO: 49883 - protein, 290 aa, Vibrio vulnificus
MKVLITGCNGQVGHCLTERLKTQAEVLALDYEGLDITNREAVFNTVAEFKPNYIINAAAYTAVDRAEQEVKLSFAINRDGPSYLAQASNECGAVMLHISTDYVFDGMGDKPYQEGDNTGPQGVYGQSKLAGEQAVAEACPEHLILRTAWVFGEHGNNFVKTMLRLAQSRDELSIVGDQFGGPTYAGDIADALIAMVQYIELGSKPKWGVYHFSGMPYASWYDFASAIFQAAEQHKMLDKQPLLSSIPTSAYPTPAKRPANSRLDCAKIENQFGIKPSDWQVALNNIQAYK

SEQ ID NO: 49884 - DNA, 900 bp, Lactococcus lactis subsp
  CDS (1)..(900): transl_table=11
atgattttaataacaggtggaaatggtcagcttggaacagagttgcgtcatttacttgacgaacgtggcatggcttatacagcaacagatgccaaagaacttgatatcactgataaagttgcggttgatacattctttgacaaaaacaaacctgaacttgtttatcactgcgcagcttatacagctgttgataaagccgaagatgaaggtcgcgagcttgatgaaaaaatcaatgtcgatggcacaaaaaatgtggccgaagcagctgcacgcgtaggtgcaacattggtttatatttcaacagactatgtttttggtgggactttgccaattggtcaagaatggccagttgatgcaccaaaagcgcctgaatctgaatatggacggacaaaacaccttggtgaagaagctgttgttgcctctggtgtaaaacattatatcgttcgtactgcttgggtttttggttcatatgggccaaactttgtctttacaatgcaaaatttggcgactcgttttcctgaattgaccgttgttaatgaccaacatggtcgtccaacatggacacgtacgcttgctgaatttatggtttatttagttaatgaaaaagctgactttggtttttatcatttaacaaatgatgctgcacctggcgaagacgtaacttggtttgattttgccaaagaaattttgaaagatacagatgtgcttgttaagcctgtagattctagtaaattcccagcaaaagccaaacgtccatttaattcaacaatgagtcttgaaaaagcaaaagcgacaggttttgtcattcctacatggcaagatgctttagcaagtatgcttgaaaaaggcgatttacgtgaaaataaagatggcctaaaaggcgagattagtaaaaaataa

SEQ ID NO: 49885 - protein, 299 aa, Lactococcus lactis subsp
MILITGGNGQLGTELRHLLDERGMAYTATDAKELDITDKVAVDTFFDKNKPELVYHCAAYTAVDKAEDEGRELDEKINVDGTKNVAEAAARVGATLVYISTDYVFGGTLPIGQEWPVDAPKAPESEYGRTKHLGEEAVVASGVKHYIVRTAWVFGSYGPNFVFTMQNLATRFPELTVVNDQHGRPTWTRTLAEFMVYLVNEKADFGFYHLTNDAAPGEDVTWFDFAKEILKDTDVLVKPVDSSKFPAKAKRPFNSTMSLEKAKATGFVIPTWQDALASMLEKGDLRENKDGLKGEISKK

SEQ ID NO: 49886 - DNA, 867 bp, Streptomyces roseochromogenes subsp
  CDS (1)..(867): transl_table=11
atggtgaatcggtggttagttactggtgcggcaggaatgctcgggcgagatttagtgggggttttgcaagggttgaacgaatcagtggttgctgtcactcgacaggatctcgacatcaccgaccgcttttcagtccgagccgttgtctccaggtatcaaccgacgacgattgtcaattgcgcagcgtggacgcgattccctgaagcggaggtcagtgaatcggaggcccttcttatcaacggaagaggggtcagagagcttgcttcgatatgcagcgatcgatcgatacggttggtccacctctccactgattatgttttcgatggcacgagttgccagccctatgccgaaagtgcggccaccagtccgatcaacgcgtacggccggacaaagctggccggcgagcaggctgtgctcgagttgctgccagacgacgggacgatcgtacgaaccgcctggctttacgggcgacatggcacgaacttcattcgcaagatggtccggctggagcagatgcgcaagacggtggacgtggtggacgatcagtggggccagccaacgtggaccgtggatttggcacaacagatcgtggcactcgttcggcagggcgcatccggcgtgttccacggaacgagctcaggtgagaccacttggtacgacatcgcccggatggtcttccggttgctcggtgcggatcccggacgcatccgcccggtgcgcagcgaccaagtcgccggtggcgaactgcggccccggtacacggtgttggggcatgctgcctggcgcgaggtcgggctgacgccgattcggcattgggctaccgctctgacgcagtcgtttccccttctggttgacggtgaatcgtaa

SEQ ID NO: 49887 - protein, 288 aa, Streptomyces roseochromogenes subsp
MVNRWLVTGAAGMLGRDLVGVLQGLNESVVAVTRQDLDITDRFSVRAVVSRYQPTTIVNCAAWTRFPEAEVSESEALLINGRGVRELASICSDRSIRLVHLSTDYVFDGTSCQPYAESAATSPINAYGRTKLAGEQAVLELLPDDGTIVRTAWLYGRHGTNFIRKMVRLEQMRKTVDVVDDQWGQPTWTVDLAQQIVALVRQGASGVFHGTSSGETTWYDIARMVFRLLGADPGRIRPVRSDQVAGGELRPRYTVLGHAAWREVGLTPIRHWATALTQSFPLLVDGES

SEQ ID NO: 49888 - DNA, 837 bp, Streptococcus suis
  CDS (1)..(837): transl_table=11
atgattttaattacaggtgcaaatggtcagttgggtacagaattgcgttatctcttggatgagcgtggtgttgattacgttgccgctgacgtagcagaaatggacatcacggatgcagataaagtagatgccttctttgcagaagtaaagccaagcgttgtataccactgtgcagcctacacagctgttgatatggcagaggatgaaggcaaggaactcaactacaagattaacgtaacaggctctgaaaatgttgccaaggcaaccgctaaatactgtgcgaccctcgtttacatctcaacggactatgtcttcaatggtgatttgccagtcggcaaagagtggcaagtagatgaccaaccggatcctcaatctgaatacggtcgcaccaagcgcaagggtgaggaagcagttgagaaatttgctgacaaattctacactgttcgtacagcttgggtctttggtaactacggtaaaaactttgttttcactatgcaaaatcttgcggaaacccgcgatactttgacggttgtcaatgaccaacacggtcgtccaacttggacccgtacccttgcggaattcatggtacacttggtggacaccaagcaagcatttggttactaccatttgtcaaacgatgcagcagaagatacgacttggtttgactttgcgacggaagtcctcaaggataccaacaccaaggtattgccagtggattctagccagttcccagccaaggcaaaacgtccattcaactcaaccatgagcttggacaaggcaaaggcgacaggttttgtcatcccaacttggcaagaagcattggaaggcattctataa

SEQ ID NO: 49889 - protein, 278 aa, Streptococcus suis
MILITGANGQLGTELRYLLDERGVDYVAADVAEMDITDADKVDAFFAEVKPSVVYHCAAYTAVDMAEDEGKELNYKINVTGSENVAKATAKYCATLVYISTDYVFNGDLPVGKEWQVDDQPDPQSEYGRTKRKGEEAVEKFADKFYTVRTAWVFGNYGKNFVFTMQNLAETRDTLTVVNDQHGRPTWTRTLAEFMVHLVDTKQAFGYYHLSNDAAEDTTWFDFATEVLKDTNTKVLPVDSSQFPAKAKRPFNSTMSLDKAKATGFVIPTWQEALEGIL

SEQ ID NO: 49890 - DNA, 903 bp, Aeromonas hydrophila
  CDS (1)..(903): transl_table=11
atgaagatcttgttgttgggggctcgtggccaactgggacgagcccttttttctgcgctacgccagatgtttcctcattggcaagtggatgcacctggaagggaagagtgcgacatcacgattccggatgtcttgtgtggctggattgatgcttgccgtcccgatgtcatcatcaactgtgctgcctacacggcagtcgatgaggctgaaagtgagcaggaactggccgacatggcaaatcaccaggccttgttgtgtatggcgagggaagccagtaatgcgggtgcgttgctggtgcacttctcaacggattatgtatttgacgggacaggaaccaagccttggcttgagacggatcaacccagacctctgaatgtctatggcatgagcaagtatgctggtgaactcgccatacagcgcctgtgcccacatcatttgattattcgcactggctggctgtacggtggagaaggcagacactttgcgcgcaccattttggcgcgggccaggcaggggcaagcacttgctgtggttgacgatcagtggggagctccgacccaggttgattggctggcgagagcatctgtattggcgctgtcgcaagtgttgaactcacctaataaggctgggctataccatctggtgtgccgcggcgagacaagctggcatggcttcgcctctgctctggtgaatgaggcgtttcgattaggcatgttgaaagaacagataaatgttcgcgctattcattcggatgaatggccacaacaggcgcgccgacctttgaactccaggttggattgccatcatttttcagatctctttggaactgagcagccacactggcaggaacagatgaaagattggctgtttagccttaagatatcagaggtgaaagaaatatga

SEQ ID NO: 49891 - protein, 300 aa, Aeromonas hydrophila
MKILLLGARGQLGRALFSALRQMFPHWQVDAPGREECDITIPDVLCGWIDACRPDVIINCAAYTAVDEAESEQELADMANHQALLCMAREASNAGALLVHFSTDYVFDGTGTKPWLETDQPRPLNVYGMSKYAGELAIQRLCPHHLIIRTGWLYGGEGRHFARTILARARQGQALAVVDDQWGAPTQVDWLARASVLALSQVLNSPNKAGLYHLVCRGETSWHGFASALVNEAFRLGMLKEQINVRAIHSDEWPQQARRPLNSRLDCHHFSDLFGTEQPHWQEQMKDWLFSLKISEVKEI

SEQ ID NO: 49892 - DNA, 903 bp, Aeromonas hydrophila
  CDS (1)..(903): transl_table=11
atgaagatcttgttgttgggggctcgtggccaactgggacgagcccttttttctgcgctacgccagatgtttcctcattggcaagtggatgcacctggaagggaagagtgcgacatcacgattccggatgtcttgtgtggctggattgatgcttgccgtcccgatgtcatcatcaactgtgctgcctacacggcagtcgatgaggctgaaagtgagcaggaactggccgacatggcaaatcaccaggccttgttgtgtatggcgagggaagccagtaatgcgggggcgttgctggtgcacttctcaacggattatgtgtttgacgggacaggagccaggccttggcgtgagacggatcaacccagacctctgaatgtctatggcatgagcaagtatgctggtgaactcgccatacagcgcctatgcccacatcatttgattattcgcactggctggctgtacggtggagaaggcagacactttgcgcgcaccattttggcgcgggccagacaggggcaagcacttgctgtggttgacgatcagtggggagctccgacccaggttgattggctggcgagagcatctgtattggcgctgtcgcaagtgttgaactcacctaataaggctgggctataccatctggtgtgccgcggcgagacaagctggcacggttttgcctctgctctggtgaatgaggcgtttcggttaggcatgttgaaagagcagagaaatgttcacgctattcattcggatgaatggccacaacaggcgcgccgacctttgaactcgaggttggattgccatcatttttcagatctctttggaactgagcagccacactggcaggaacagatgaaagattggctgtttagccttaagatatcagaggtgaaagaaatatga

SEQ ID NO: 49893 - protein, 300 aa, Aeromonas hydrophila
MKILLLGARGQLGRALFSALRQMFPHWQVDAPGREECDITIPDVLCGWIDACRPDVIINCAAYTAVDEAESEQELADMANHQALLCMAREASNAGALLVHFSTDYVFDGTGARPWRETDQPRPLNVYGMSKYAGELAIQRLCPHHLIIRTGWLYGGEGRHFARTILARARQGQALAVVDDQWGAPTQVDWLARASVLALSQVLNSPNKAGLYHLVCRGETSWHGFASALVNEAFRLGMLKEQRNVHAIHSDEWPQQARRPLNSRLDCHHFSDLFGTEQPHWQEQMKDWLFSLKISEVKEI

SEQ ID NO: 49894 - DNA, 1002 bp, Lactobacillus gasseri
  CDS (1)..(1002): transl_table=11
atgaaagtttttgtaactggcgttaatggtcaacttggccatgacgtaatgaatgaacttgctaagcgcggctatgaaggtgtaggttctgacttggcacctgaatatgctggtgttgctgacggaagcagcgttactaaggcaccttatgtttctttagatattactgatgcaaaagccgtagacaaggttatttctgaagtaaatcctgatgttattgttcactgtgctgcctggactgcagttgatatggctgaagatgacgataaggttgcagctgttcgcaaagttaacgttgacggaactcaaaacatcgctaacgttgcaaagaaattagattccccaatggtttacttgtcaactgactatgtcttcgatggccagggaactaccccttgggaaccagactttaagggctataagcctttgaatgtttatggtgaaaccaagcttggcggggaagaagctgttgctaatactttagacaagtatttcattgttagaattgcttgggtatttggtgtaaatggctcaaactttatcaagactatgcttaaggttggttcaaatcacgacgaagttaaggttgttagtgatcagattggtaccccaacttatacttttgacttagctcgtcttttggtagatatgattgaaactgataaatatggctactaccacgcaactaattcagaactaccagcaactgaaagtggctatgacgaaaatggtactaagactggttatatttcttggtacgatttcactaaagaaatttatcgtcaagctggctataagacaaaggttactcctgtaactactgaagaatatggcttatctaaggcagttcgtccgtttaactctcgtctagataagagcaagttagaagaaaatggctttaaaccacttccaacttggactgatgctattagtcgttacttagatatcttaaaagatgacggtttccttcgacaatctgaagaagtagacttttttaattga

SEQ ID NO: 49895 - protein, 333 aa, Lactobacillus gasseri
MKVFVTGVNGQLGHDVMNELAKRGYEGVGSDLAPEYAGVADGSSVTKAPYVSLDITDAKAVDKVISEVNPDVIVHCAAWTAVDMAEDDDKVAAVRKVNVDGTQNIANVAKKLDSPMVYLSTDYVFDGQGTTPWEPDFKGYKPLNVYGETKLGGEEAVANTLDKYFIVRIAWVFGVNGSNFIKTMLKVGSNHDEVKVVSDQIGTPTYTFDLARLLVDMIETDKYGYYHATNSELPATESGYDENGTKTGYISWYDFTKEIYRQAGYKTKVTPVTTEEYGLSKAVRPFNSRLDKSKLEENGFKPLPTWTDAISRYLDILKDDGFLRQSEEVDFFN

SEQ ID NO: 49896 - DNA, 921 bp, Leptospira interrogans
  CDS (1)..(921): transl_table=11
atgatttattatactggaaaaaacggtcagttagcttgggaattggccgaaagatttaaatctaatggattggaagcagtaggatttggtagggaagaatgggatcttgcagatcttgattctgccgcacgaattttgaaggattctcctcggattttagttcattgtggggcttatactgcggtggataaggcagagtccgactcagagaacgcttacaaaatcaattcgttatctgtaaaaaaaatttcggaagaatgtctaaaaagaaaaatccatttaatttatatatccactgattttgtatttgatgcaaattcggaaacgatcggtgatacgattcgtttttggaaaccggattctacactttctccgaaaggaatctacggattgtcaaaggcggaaggggaaaagtggattcgaaatacgtttgcgaattctaaacaagcaaatatcatccgtaccagttgggtatattcctctcatggaaataattttccaaaaacaattgtgaaacttttacaagactctaatcgtcatgaattaagagtgatcgaagatcaattgggaagacctacttgggctggtaggcttgcggattttataatattcttaatttatggaattctaaaaggagaatcttatcctaagattctacatttttctaactcaggagttgcgagctggtacgattttgcacttgcagttcgggatcttgcacattctttttcattgatagagaatttaaaacctatttttccaattcctacggaaggttatccaacacctgcacctaggcctagatattcaattttagatttagaagaaactcgaaaaatttttggcgttgttccgcattggagagaggatttaaccctttgtctaaaagaacttgccgaagtttccggaaaaaaagtatga

SEQ ID NO: 49897 - protein, 306 aa, Leptospira interrogans
MIYYTGKNGQLAWELAERFKSNGLEAVGFGREEWDLADLDSAARILKDSPRILVHCGAYTAVDKAESDSENAYKINSLSVKKISEECLKRKIHLIYISTDFVFDANSETIGDTIRFWKPDSTLSPKGIYGLSKAEGEKWIRNTFANSKQANIIRTSWVYSSHGNNFPKTIVKLLQDSNRHELRVIEDQLGRPTWAGRLADFIIFLIYGILKGESYPKILHFSNSGVASWYDFALAVRDLAHSFSLIENLKPIFPIPTEGYPTPAPRPRYSILDLEETRKIFGVVPHWREDLTLCLKELAEVSGKKV

SEQ ID NO: 49898 - DNA, 900 bp, Shigella boydii
  CDS (1)..(900): transl_table=11
atgaatattctccttttcggcaaaacagggcaggtaggttgggaactacagcgtgctctggcacctttgggtaatttgattgctcttgatgttcactccactgattattgtggtgattttagtaatcctgaaggtgtagctgaaaccgtaagaagcattcggcctgatattattgtcaacgcagccgctcacaccgcagtagacaaagcagaatcagaaccggagtttgcacaattacttaacgcgacaagtgtcgaagcgattgcgaaaacagccaatgaagtcggcgcctgggttattcactactctactgactacgtatttccggggaccggtgaaataccatggcaggagacggatgcaaccgcaccgctaaatatttacggtgaaaccaagttagctggagaaaaagcattacaagagcattgtgcgaagcaccttattttccgtaccagctgggtatatgcaggtaaaggaaacaattttgccaagacaatgttacgtctggcaaaagagcgcgaagaattagctgtcattaacgatcagtttggtgcaccaacaggtgctgaactgctggctgattgtacggcacatgcaattcgtatggcactgaataaaccagaagtcgcaggtttgtaccatctggtagccagtggtaccacaacctggcacgattatgctgcgctggtttttgaagcggcgcgcaatgcaggcattccccttgcactcaacaagctcaacgcagtaccaacaactgcctatcctacaccagctcgtcgtccacataactctcgccttaatacagaaaaatttcagcagaactttgcgcttgtcttgcctgactggcaggttggcgtgaaacgaatgctcaacgaattatttacgactacagcaatttaa

SEQ ID NO: 49899 - protein, 299 aa, Shigella boydii
MNILLFGKTGQVGWELQRALAPLGNLIALDVHSTDYCGDFSNPEGVAETVRSIRPDIIVNAAAHTAVDKAESEPEFAQLLNATSVEAIAKTANEVGAWVIHYSTDYVFPGTGEIPWQETDATAPLNIYGETKLAGEKALQEHCAKHLIFRTSWVYAGKGNNFAKTMLRLAKEREELAVINDQFGAPTGAELLADCTAHAIRMALNKPEVAGLYHLVASGTTTWHDYAALVFEAARNAGIPLALNKLNAVPTTAYPTPARRPHNSRLNTEKFQQNFALVLPDWQVGVKRMLNELFTTTAI

SEQ ID NO: 49900 - DNA, 900 bp, Shigella boydii
  CDS (1)..(900): transl_table=11
atgaatatcctcctttttggcaaaacagggcaggtaggttgggaactacagcgtgctctggcacctctgggtaatttgattgctcttgatgttcactccactgattattgtggtgattttagtaattctgaaggtgtagctgaaactgtcaaaaaaattcgccctgatgttattgttaatgcggctgctcataccgcggtagataaggctgagtcagaacccgaatttgcacaattactcaatgcgacaagtgttgaagcgattgcaaaagcagccaatgaggtcggtgcatgggttattcactactctactgactacgtatttccgggaaccggtgaaataccatggcaggaggcggatgcaaccgcaccgctgaacgtttatggtgaaaccaagttagccggggaaaaagcattacaagagcattgtgcgaagcatcttattttccggaccagctgggtctatgcaggtaaaggaaataacttcgccaaaacgatgttgcgtctggcaaaagagcgtgaagaattagctgttattaacgatcagtttggtgcgccaactggcgcagagttactggctgattgtacggcacatgccattcgtgtggcactgaataaaccggaagtcgcaggcttgtaccatctggtagctagtggtaccacaacgtggcacgattatgctgcgctggtttttgaagaggcgcgcaaagcaggcattccccttgcactcaacaagctcaacgcagtaccaacaacagcctatcctacaccagctcgtcgtccgcataactctcgccttgatacagaaaaatttcagcagaactttgcgcttgtcttgcctgactggcagattggcgtgaaacgcatgctcaacgaattatttacgactacagctatttaa

SEQ ID NO: 49901 - protein, 299 aa, Shigella boydii
MNILLFGKTGQVGWELQRALAPLGNLIALDVHSTDYCGDFSNSEGVAETVKKIRPDVIVNAAAHTAVDKAESEPEFAQLLNATSVEAIAKAANEVGAWVIHYSTDYVFPGTGEIPWQEADATAPLNVYGETKLAGEKALQEHCAKHLIFRTSWVYAGKGNNFAKTMLRLAKEREELAVINDQFGAPTGAELLADCTAHAIRVALNKPEVAGLYHLVASGTTTWHDYAALVFEEARKAGIPLALNKLNAVPTTAYPTPARRPHNSRLDTEKFQQNFALVLPDWQIGVKRMLNELFTTTAI

SEQ ID NO: 49902 - DNA, 918 bp, Saccharopolyspora spinosa
  CDS (1)..(918): transl_table=11
atgagtcgcctcgccgtgctggtgcccggcggccgcggccagctgggctcggagctggcccggatcctcgccgcgcggacgggggcgctggtgcaccggccgggttccggggaactggacgtcaccgacgccgaggaggtcgccgacgcgttgggttccttcgcggagacggcgaaggacgcggagctgcgaccggtggtgatcaacgccgcggcgtacacggcggtggacgcggccgagtccgacccggaccgcgcggcccggatcaacgccgaaggcgcggcctcgctggcgaaagcgtgccggagcagcggtctgcccctggtgcacgtgtcgacggattacgtgttccccggtgatggggcccggccgtacgagccgacggacccgaccgggccgcgatcggtctacgggcgcaccaagctcgaaggcgaacgggccgtgctggagtccggcgcgcgggcctgggtggtgcgcacggcatgggtgtacggcgcgagcggcaagaacttcctgaaaacgatgatccgcctctcgggggagcgcgacacgctgtccgttgtggacgatcagatcggctcgccgacttgggcggcggacctggcgagcggcctgctggagctggccgaacgggtcgccgaacgccgtggaccggagcagaaggtgctgcactgcaccaattccggccaggtgacctggtacgagttcgcgcgggcgatcttcgcggaattcggcctggacgagaaccgcgtccacccgtgcacgacggcggacttccccctcccggcgcaccgcccggcctactcggtcctgtccgacgtggcgtggcgagaggcgggcctgaccccgatgcgcacctggcgggaagccctggcggcggccttcgagaaagacggcgaaaccctccgaacccgctga

SEQ ID NO: 49903 - protein, 305 aa, Saccharopolyspora spinosa
MSRLAVLVPGGRGQLGSELARILAARTGALVHRPGSGELDVTDAEEVADALGSFAETAKDAELRPVVINAAAYTAVDAAESDPDRAARINAEGAASLAKACRSSGLPLVHVSTDYVFPGDGARPYEPTDPTGPRSVYGRTKLEGERAVLESGARAWVVRTAWVYGASGKNFLKTMIRLSGERDTLSVVDDQIGSPTWAADLASGLLELAERVAERRGPEQKVLHCTNSGQVTWYEFARAIFAEFGLDENRVHPCTTADFPLPAHRPAYSVLSDVAWREAGLTPMRTWREALAAAFEKDGETLRTR

SEQ ID NO: 49904 - DNA, 849 bp, Aneurinibacillus thermoaerophilus
  CDS (1)..(849): transl_table=11
atgaaagttcttgtgacaggtggtaagggacaattcgggtatgatgtaacacagatgttgcagggagcaggacatcgtgtgttttcgtatggacgcgaggagttggatattactgatcaaaagcaagttcagtacacaatggaagaggtacagccggacgtggtaattcacgcggctgcatacacaaaagttgatttagccgaaaccgaggtgaatacagcttacaaagttaacgccttgggtacacgtaatgtagcggtagccgctgaagcatgtcgtgccaagcttgtctatattagtacagattatgtttttgatgggcaggcggctggaccttaccacgaatttgcgccaacgaacccgcaaagcatatacggaaagtctaaactggcaggcgagagttttgttcaacagctatgttcccgtttctttattgtccgaacttcttgggtatacgggaaatatggacataattttgtgaagacgatgcttcggctagcaggggagcgggatgaattgaatgtcgtacatgatcaggttggctgtcccacatatactgttgatttggctgcttttgtattgaatttgatcgaaacggaagcttatggtatttaccatgcttccaatacgggaagctgttcatggtacgagttcgcctgtgcgattttcgaagaagcagaaattaagataaaagtaaatccgatcccaacttcggaatatccgcttccggctccgcgtccagcgaactcagtatttgagcatatgatgatacgtttgcaggaaatgaagccgctccgtccgtggagaatagcattacaggagtttatacaggatattcgtaaaagctag

SEQ ID NO: 49905 - protein, 282 aa, Aneurinibacillus thermoaerophilus
MKVLVTGGKGQFGYDVTQMLQGAGHRVFSYGREELDITDQKQVQYTMEEVQPDVVIHAAAYTKVDLAETEVNTAYKVNALGTRNVAVAAEACRAKLVYISTDYVFDGQAAGPYHEFAPTNPQSIYGKSKLAGESFVQQLCSRFFIVRTSWVYGKYGHNFVKTMLRLAGERDELNVVHDQVGCPTYTVDLAAFVLNLIETEAYGIYHASNTGSCSWYEFACAIFEEAEIKIKVNPIPTSEYPLPAPRPANSVFEHMMIRLQEMKPLRPWRIALQEFIQDIRKS

SEQ ID NO: 49906 - DNA, 894 bp, Acinetobacter calcoaceticus
  CDS (1)..(894): transl_table=11
atgaaaatcttattgcttggcaaaaatggacaagtggggtgggaactgcaacgcgcacttgcacctttgggtgaggtcattgctttagaccgacatggtttaaatggcttatctggtgatatgacccagccgcaggcgattagtgatacgattttggcagtacaaccagatgtggtcgtcaatgcttctgcttatacggctgtagatttggctgaaacagaacgtgaactagcggatgttgttaatcatcaaacagtaatggctgtcgccaaagcttgtcagcatgtaaatgctttgttcgtgcattattctacagactatgtttttgatggtgtaggtgaaacagcttttgttgaaactgacgcgattgctccgttaaatgtctatggtaaaactaaagccttaggtgagcaagcaatagtgcagagtggttgccagtatcttatttttaggacatcgtgggtttatgccagtaaaggcaaaaacttcttaaaaacgatgttaggtttggcccaacagcgagaagaattatctattattgcagatcagattggtgcgccgacatctgctgaattaattgccgatgttacagcacatgctattccgcaaacattaacagataaaagcaaagttggtacctatcatttggttgcaagcggagaaacgtcatggttcggctatgcaagttttgtttttgagcaagttcgtgcatttggacaagcattgactattcaaaatgtaaatgcaattccgacctcagcttatccaacacctgcaacaagaccacataattcaagattaaataatcagaagatacaacacactttcggaatactgctaccaaattggcaagatggtgtgaaacgtgcattagtggagttattaagtaaatga

SEQ ID NO: 49907 - protein, 297 aa, Acinetobacter calcoaceticus
MKILLLGKNGQVGWELQRALAPLGEVIALDRHGLNGLSGDMTQPQAISDTILAVQPDVVVNASAYTAVDLAETERELADVVNHQTVMAVAKACQHVNALFVHYSTDYVFDGVGETAFVETDAIAPLNVYGKTKALGEQAIVQSGCQYLIFRTSWVYASKGKNFLKTMLGLAQQREELSIIADQIGAPTSAELIADVTAHAIPQTLTDKSKVGTYHLVASGETSWFGYASFVFEQVRAFGQALTIQNVNAIPTSAYPTPATRPHNSRLNNQKIQHTFGILLPNWQDGVKRALVELLSK

SEQ ID NO: 49908 - DNA, 897 bp, Burkholderia mallei
  CDS (1)..(897): transl_table=11
atgaagattttggtgacgggggcaaacggccaagtgggctgggaactcgctcggagtctggcggtattggggcaagttgtcccgctcacgcgtgagcaggccgatctcggccgccccgaaacgcttgctcgaattgttgaggacgcgaagccggatgtcgtcgtcaatgctgcggcatatacggcggtcgatgctgcggaaaccgatggtgctgcagcgaatgtgatcaacggtgaggcggtaggtgtgctggccgccgcgacgaagcgtgtcggcggcttgttcgttcattactcgacggactacgtttttgacggcaccaagccgtcgccatacatcgagacggatccgacgtgtcccgtcaatgcctacggcgccagcaagttgctgggagagttggcggttgcggagaccggcggcgactggctgacgtttcgcaccacgtgggtgttcgccgcacgcggcaagaacttcctgcgaacgatgcttcgtcttgccaaggagcgcgaagagatgaagatcgtggccgatcagttcggcgcgccgacctgggcgcgatcgattgctgacggcacggcccacgcgctcacgaccgcgatgcgtgaacgcgcggcaggcgcgttcacgtccggcgtctatcacatgacatccgcggggcagacttcatggcacggtttcgcggacgcgatcatcgcatcctggcgagcggctccgggggcggcaccgctcgccgtcagccggatcgtgccgattccggcgagcgcctatcccgtgccggcacagcgcccggcaaactcggtactgtcgaacaaggcgctgaaagagcgtttcggtatcgaactgcctgattggcggtatgcactacggctgtgcgtcaacgatctgcttttccaatga

SEQ ID NO: 49909 - protein, 298 aa, Burkholderia mallei
MKILVTGANGQVGWELARSLAVLGQVVPLTREQADLGRPETLARIVEDAKPDVVVNAAAYTAVDAAETDGAAANVINGEAVGVLAAATKRVGGLFVHYSTDYVFDGTKPSPYIETDPTCPVNAYGASKLLGELAVAETGGDWLTFRTTWVFAARGKNFLRTMLRLAKEREEMKIVADQFGAPTWARSIADGTAHALTTAMRERAAGAFTSGVYHMTSAGQTSWHGFADAIIASWRAAPGAAPLAVSRIVPIPASAYPVPAQRPANSVLSNKALKERFGIELPDWRYALRLCVNDLLFQ

SEQ ID NO: 49910 - DNA, 930 bp, Azospirillum brasilense
  CDS (1)..(930): transl_table=11
atggctgaggccgccccccacaccctccccgttctcgtcttcggtgccaacggtcaggtcggcttcgagctgcggcgcgccgcctgggcgccgggcctggcgccgctcgggctggaccgcgcgtccggcgacgtcaccgacgcaaaggcggtgagcgcggccatcgctgcccaccgcccggcgctggtggtcaacgcctcggcctacaccgccgtggacaaagcggagagcgagcgggacacggccttcgcggtcaaccgcgacggtccggcgaatctggcgcgcgcctgcgccgcagccggggtgccgctgatccatatctccaccgactacgtcttcgacgggaccagcaagaccaccccctggagcgagagcgaccccgtcgccccgcagggcgtctacgccgccagcaaactggccggcgaagaagccgtgcgggacgcccagcccgaccatgtgatcctgcgcaccgcctgggtgttcggggcgcacgggcacaatttcgtgaagaccatgctgcggctggcgcgcgagcgggacgagttgcgggtcgtcgccgaccagcacggctgtccgaccccggcggcggccatcgccgcggccatcgccaccatcgcacaggcccggctgaccggcgagggctggactcccggcaccttccactatggcggggcgccggccaccacttggcacggcttcgccgagcggatcgtcgatcgcgccgccgcccgcatcggccgccgtccggccgtgaccgccatcaccaccgccgactttccgacaccggcccgacggcccgccaattccgtcctcgacaccgcacgcctcggccaggcctacggcatcccgccggcggattggatggctggactcgaccgcgtgcttgacgacatcctcgacgaaacccagggcgtgggagcgaaggcatga

SEQ ID NO: 49911 - protein, 309 aa, Azospirillum brasilense
MAEAAPHTLPVLVFGANGQVGFELRRAAWAPGLAPLGLDRASGDVTDAKAVSAAIAAHRPALVVNASAYTAVDKAESERDTAFAVNRDGPANLARACAAAGVPLIHISTDYVFDGTSKTTPWSESDPVAPQGVYAASKLAGEEAVRDAQPDHVILRTAWVFGAHGHNFVKTMLRLARERDELRVVADQHGCPTPAAAIAAAIATIAQARLTGEGWTPGTFHYGGAPATTWHGFAERIVDRAAARIGRRPAVTAITTADFPTPARRPANSVLDTARLGQAYGIPPADWMAGLDRVLDDILDETQGVGAKA

SEQ ID NO: 49912 - DNA, 879 bp, Actinobacillus actinomycetemcomitans
  CDS (1)..(879): transl_table=11
gtggcaaaatttttgattacgggggcaaacgggcaagttggctactgtttaacccaacagttacaaggcaggcacgaaattttagccgttgatcatgatgagcttgatattacaaaccaaagtgcggtgaaaaaaacggtcgaaaatttttgtcctgatgtagttatcaacgccgcagcacacactgcggtagatcgtgcggaaaccgaagttgagcgttccgaggccattaatgtaaaaggtccgcaatacttggcggaaaccgcgaaaagtgttgatgcggcaattttacatatttcaacagactatgtttttgacgggcggagtgcaggtaaatacaaagaaactgatgcagccgatccgcaaggcatttatggcaaaaccaaactagcaggcgaacaagccgttgtagaagcgaacgataaatttattgtcttgcgtaccgcttgggtattctgcgagcatggcaacaatttcgttaaaacaatgctgcgtttagccaaaactcgtgacactttaggcgtagttgccgatcagatcggtggacctacctatgcaggcgatattgccgctgcgttaattcaaatcgcagaaaaaatcattgcaggcgaatctgttgaatatggcatttatcactttacagggctgccttatgtcagctggtgtgattttgccagagcaatttttgatgaagccgtttcgcaaaatatgttagaaaaagcaccgcttgtcaacgcaatcaccacggcagattacccaacaccagccaaacgccctgcgaattcttgtttagatttaactaaaattcaacaagcattcggtatccaaccaagtgattggcaaagggctttgaagaatattagaacgtatgcggagtaa

SEQ ID NO: 49913 - protein, 292 aa, Actinobacillus actinomycetemcomitans
MAKFLITGANGQVGYCLTQQLQGRHEILAVDHDELDITNQSAVKKTVENFCPDVVINAAAHTAVDRAETEVERSEAINVKGPQYLAETAKSVDAAILHISTDYVFDGRSAGKYKETDAADPQGIYGKTKLAGEQAVVEANDKFIVLRTAWVFCEHGNNFVKTMLRLAKTRDTLGVVADQIGGPTYAGDIAAALIQIAEKIIAGESVEYGIYHFTGLPYVSWCDFARAIFDEAVSQNMLEKAPLVNAITTADYPTPAKRPANSCLDLTKIQQAFGIQPSDWQRALKNIRTYAE

SEQ ID NO: 49914 - DNA, 888 bp, Acetobacter xylinus
  CDS (1)..(888): transl_table=11
atgctacataatccgtcgattctggtaacaggagggcatggacagcttgctaccgcgctggccggtcatgaaggtgtcatgcgggtcgggcgaccggatttcgatttcgaccgacccgggacaatcgatcagatcatggcggaaaatacacccgaattcgtcgtgaacgctgccgcctggactgccgtggacgcagcggaaacagatgccgaaggggctgcaagggccaaccacgccggcccggcccgactggctgccgcatgccgggcgcggggcattccgcttatccatatctcgaccgattacgttttcagcggcgacaagggcagtccgtatatggaaactgatcctgttgatccacgctcggtctacggcagtaccaaggcggccggggaacaggcggtattggcggcacagcctgacagtatcatcctgcggacggcctgggtctattcaccctataaccgcaatttcgtgcgcaccatggtcgaagccgcagccaggcggcctaccctgcgggttgtcagtgaccagatcggcaatccgaccagcgcagacgcactggcgcagaccatcatgcacatcatccggcagatccgtgagaccggttggaaagcggattatgccggaatttaccacgcagccggccagggtgcgacaagctggtatgacctggcctgtgccgcggttgccgctgcggccaggcatggcaacccgcaaccggttatggaacccattaccaccgccgactggccaacaccggcccggcgcccggcggatgcgcggcttgactgcacccgcctgcaggaaacatttggccatgcgcccggtccgtggcagcccgaagtggagcgtgtggcggaactgatcgtatcacagcagggatag

SEQ ID NO: 49915 - protein, 295 aa, Acetobacter xylinus
MLHNPSILVTGGHGQLATALAGHEGVMRVGRPDFDFDRPGTIDQIMAENTPEFVVNAAAWTAVDAAETDAEGAARANHAGPARLAAACRARGIPLIHISTDYVFSGDKGSPYMETDPVDPRSVYGSTKAAGEQAVLAAQPDSIILRTAWVYSPYNRNFVRTMVEAAARRPTLRVVSDQIGNPTSADALAQTIMHIIRQIRETGWKADYAGIYHAAGQGATSWYDLACAAVAAAARHGNPQPVMEPITTADWPTPARRPADARLDCTRLQETFGHAPGPWQPEVERVAELIVSQQG

SEQ ID NO: 49916 - DNA, 900 bp, Salmonella enterica
  CDS (1)..(900): transl_table=11
atgaatatcttactttttggtaagacagggcaagtaggctgggagttgcaacgttctctggcgccagtggggaatctgattgccctggatgtccattcaaaagagttttgcggtgattttagcaatcccaaaggcgttgccgaaaccgttcgtaagcttcgtcccgatgtgattgttaacgcagcagcacatactgcagtagataaagcagagtctgaaccagaactggcgcagttgcttaacgccaccagtgtggaagccatcgctaaagcggccaacgaaattggcgcatgggtagtgcattattcaaccgattatgtatttcctggtaccggcgatatcccatggcaggaaacggacgctacgtcgccgctaaatgtctatggcaagaccaaactagcgggagaaaaggccctgcaggataactgccctaaacaccttatcttccgcaccagttgggtttatgcaggtaagggcaataatttcgcaaagactatgcttcgtttggcgaaagagcgtcagacactttcggtcatcaacgatcagtacggtgcgccaaccggtgcggaattactggctgactgcacggctcatgcgatccgtgtggcgttaaagaaaccagaagtagcaggtctttaccatctggtggccggtggaactacaacctggcatgactacgcagcgttagtctttgacgaggcgcgcaaggcagggctaacgcttgcgcttactgagcttaatgccgtgccaaccagtgcctatccgacgccggcgagcagacctggaaattcgcgtcttaatactgaaaagtttcagagtaattttggccttattctgccgcaatgggaattaggggttaagcgtatgctgactgaaatgtttacgacgacaaccatctga

SEQ ID NO: 49917 - protein, 299 aa, Salmonella enterica
MNILLFGKTGQVGWELQRSLAPVGNLIALDVHSKEFCGDFSNPKGVAETVRKLRPDVIVNAAAHTAVDKAESEPELAQLLNATSVEAIAKAANEIGAWVVHYSTDYVFPGTGDIPWQETDATSPLNVYGKTKLAGEKALQDNCPKHLIFRTSWVYAGKGNNFAKTMLRLAKERQTLSVINDQYGAPTGAELLADCTAHAIRVALKKPEVAGLYHLVAGGTTTWHDYAALVFDEARKAGLTLALTELNAVPTSAYPTPASRPGNSRLNTEKFQSNFGLILPQWELGVKRMLTEMFTTTTI

SEQ ID NO: 49918 - DNA, 900 bp, Salmonella enterica
  CDS (1)..(900): transl_table=11
atgaatatcttactttttggtaagacagggcaagtaggctgggagttgcaacgttctctggcaccagtagggaatctgattgccctggatgtccattcaaaagagttttgcggtgattttagtaatccgaaaggcgttgccgaaaccgttcgtaagcttcgtcccgatgtgattgttaacgcagccgcacatactgcagtagataaagcagagtctgaaccagaactggcgcagttacttaacgccaccagtgtggaagccatcgctaaagcggccaacgaaactggcgcatgggtagtgcattattcaaccgactatgtatttcctggtaccggcgatatcccatggcaggaaacggacgctacgtcgccgctgaatgtctatggcaaaaccaaactggcgggagaaaaggccctgcaggataactgccctaagcaccttatcttccgcaccagttgggtttatgcaggtaagggcaataatttcgcaaagacaatgcttcgtctggcgaaagagcgtcagacactttcagtcattaacgatcagtacggtgcgccaaccggtgcggaattactggctgactgcacggcccatgcgatccgtgtggtgttaaataaaccagaagtcgcaggtctttaccatctggttgccgggggaaccacaacctggcatgactacgcggccttagtctttgacgaggcgcgcaaagcagggataacgcttgcgctgactgagcttaatgctgtgccgaccagcgcctacccgacgccggcgagcagacctggcaattcgcgtctcaatactgaaaagtttcagcgtaattttggccttattctgccgcaatgggaattaggagttaagcgcatgctgactgaaatgtttacgacgacaaccatctga

SEQ ID NO: 49919 - protein, 299 aa, Salmonella enterica
MNILLFGKTGQVGWELQRSLAPVGNLIALDVHSKEFCGDFSNPKGVAETVRKLRPDVIVNAAAHTAVDKAESEPELAQLLNATSVEAIAKAANETGAWVVHYSTDYVFPGTGDIPWQETDATSPLNVYGKTKLAGEKALQDNCPKHLIFRTSWVYAGKGNNFAKTMLRLAKERQTLSVINDQYGAPTGAELLADCTAHAIRVVLNKPEVAGLYHLVAGGTTTWHDYAALVFDEARKAGITLALTELNAVPTSAYPTPASRPGNSRLNTEKFQRNFGLILPQWELGVKRMLTEMFTTTTI

SEQ ID NO: 49920 - DNA, 867 bp, Streptomyces rishiriensis
  CDS (1)..(867): transl_table=11
atgatgaatcggtggttggttactggtgcgggaggaatgctcgggagggatttggtgcgggttttggaggcgctgaacgaaccagtgctggctgccactcggcaggatctcgacatcaccgaccgattctcggtccgagccgttgtctccaggtatcgaccgacggcgatcgtcaattgcgcagcatggacgagatttcatgaagcggagaccagtgaagcggaggcccatcttatcaatggaagaggggcaagagagctggctacgatatgcggcgatcgatcgattcggttggtccatctctccaccgattacgttttcgacggcgcgagccgccggccctatgccgaaagcgcggccaccggtccgatcaacgcctacggccggacaaagctggccggcgagcaagctgtgctcgagttgctgccggacgacgggacgatcgtgagaaccgcttggctgtacggtcgacacggcacgaacttccttcgcaagatggtccggttggagcagacgcacaagacggtggacgtggtagacgatcagtggggccagccgacgtggagcgtggatttggcacaacagatcgtggcactcgttcggcacggtgcgtccggcgtgttccacgggacaagctcaggcgagaccacgtggtacgacttcgcccggatgatcttccggttgctcggtgcggatcccggacgaatccgcccggtgcgcagcgaccagatcgccggcggcgaactgcgtccccggtacacggtgttggggcatgccgcctggcgcgaggtcgggctgacgccgattcggcactggtccgccgctctggagcggtcgtttccccttctggctgacgaggaatggtaa

SEQ ID NO: 49921 - protein, 288 aa, Streptomyces rishiriensis
MMNRWLVTGAGGMLGRDLVRVLEALNEPVLAATRQDLDITDRFSVRAVVSRYRPTAIVNCAAWTRFHEAETSEAEAHLINGRGARELATICGDRSIRLVHLSTDYVFDGASRRPYAESAATGPINAYGRTKLAGEQAVLELLPDDGTIVRTAWLYGRHGTNFLRKMVRLEQTHKTVDVVDDQWGQPTWSVDLAQQIVALVRHGASGVFHGTSSGETTWYDFARMIFRLLGADPGRIRPVRSDQIAGGELRPRYTVLGHAAWREVGLTPIRHWSAALERSFPLLADEEW

SEQ ID NO: 49922 - DNA, 879 bp, Actinobacillus actinomycetemcomitans
  CDS (1)..(879): transl_table=11
gtggcaaaatttttgattacgggggcaaacgggcaggttggctactgtttaacccaacagttacaaggcaggcacgaaattttagccgttgatcatgatgagcttgatattacaaaccaaagtgcggtgaaaaaaacggtcgaaaattttcgtcctgatgtagttatcaacgccgcagcacacactgcggtagatcgtgcggaaaccgaagttgagcgttccgaggccattaatgtaaaaggtccgcaatacttggcggaaaccgcgaaaagtgttgatgcggcaattttacatatttcaacagactatgtttttgacgggcggagtgcaggtaaatacaaagaaactgatgcagccgatccgcaaggcatttatggcaaaaccaaactagcaggcgaacaagccgttgtagaagcgaacgataaatttattgtcttgcgtaccgcttgggtattctgcgagcatggcaacaatttcgttaaaacaatgctgcgtttagccaaaactcgtgacactttaggcgtagttgccgatcagatcggtggacctacctatgcaggcgatattgccgctgcgttaattcaaatcgcagaaaaaatcattgcaggcgaatctgttgaatatggcatttatcactttacaggggagccttatgtcagctggtgtgattttgccagagcaatttttgatgaagccgtttcgcaaaatatgttagaaaaagcaccgcttgtcaacgcaatcaccacggcagattacccaacaccagccaaacgccctgcgaattcttgtttagatttaactaaaattcaacaagcattcggtatccaaccaagtgattggcaaagggctttgaagaatattagagcgtatgcggagtaa

SEQ ID NO: 49923 - protein, 292 aa, Actinobacillus actinomycetemcomitans
MAKFLITGANGQVGYCLTQQLQGRHEILAVDHDELDITNQSAVKKTVENFRPDVVINAAAHTAVDRAETEVERSEAINVKGPQYLAETAKSVDAAILHISTDYVFDGRSAGKYKETDAADPQGIYGKTKLAGEQAVVEANDKFIVLRTAWVFCEHGNNFVKTMLRLAKTRDTLGVVADQIGGPTYAGDIAAALIQIAEKIIAGESVEYGIYHFTGEPYVSWCDFARAIFDEAVSQNMLEKAPLVNAITTADYPTPAKRPANSCLDLTKIQQAFGIQPSDWQRALKNIRAYAE

SEQ ID NO: 49924 - DNA, 885 bp, Streptomyces antibioticus
  CDS (1)..(885): transl_table=11
atgagatggctgatcaccggcgccgccggaatgctgggccgggaactcgtccggcgcctcgccgagaacgaggaggacgtcgcggccctcggccacgaccacctcgacgtcacccgccccttcgccgtgcgggcggcactcgccgagcaccgtcccgggatcgtcgtcaactgcgccgcctacacggccgtcgacgacgccgagacggacgaggccgccgctgccctcctcaacgccgaggccccccggctgctggccgaggcctgcgccccccacggcgcacgcctcgtccacctgtccaccgactacgtctttcccggcgacgcccgcaccccctacgccgaggaccaccccacggctccccgcagcgcctacggacgcaccaaacgggacggcgagcaagcggtgctgacggcactgcccaccgccaccgtgctgcgcaccgcctggctgtacgggcgcaccggccgcagcttcgtccgcacgatgatcgaacgggaggcgcgcggcggagccatcgacgtcgtcgccgaccagtgcggccagcccacctggaccggcgacctcgccgaccgcatcatcgccgtcggccggcaccccggcgtccacggcatcctgcacgccaccaacgccggctccgccacctggtacgacctggcacaagaggtcttccggctcctcgacgccgaccccgggcgggtccggcccaccaccggcgccgccttccgcagacccgccccccgccccgcctacagcgtcctcggccacgaccgctggcgcgggaccggcctggcacccctgcgtgactggcgctcggccctgcgcgaggcgttccccgacatcctcgccgcggaacacccaccgacccggcgaggagcagcatga

SEQ ID NO: 49925 - protein, 294 aa, Streptomyces antibioticus
MRWLITGAAGMLGRELVRRLAENEEDVAALGHDHLDVTRPFAVRAALAEHRPGIVVNCAAYTAVDDAETDEAAAALLNAEAPRLLAEACAPHGARLVHLSTDYVFPGDARTPYAEDHPTAPRSAYGRTKRDGEQAVLTALPTATVLRTAWLYGRTGRSFVRTMIEREARGGAIDVVADQCGQPTWTGDLADRIIAVGRHPGVHGILHATNAGSATWYDLAQEVFRLLDADPGRVRPTTGAAFRRPAPRPAYSVLGHDRWRGTGLAPLRDWRSALREAFPDILAAEHPPTRRGAA

SEQ ID NO: 49926 - DNA, 876 bp, Streptomyces nogalater
  CDS (1)..(876): transl_table=11
atgctcgcccggcacctgaccgcggccctggcggagaccggcaggagccggcccgccgccgaggcggtggtactcgggcggcgcgcgctggacatcaccgacgggcgggcggtggacgccgcgttcgccgcgcaccggccgcgggtggtggtcaactgcgccgccttcacggacgtggacggcgccgagtcgcggtgggcggaggcgatgcgcgtcaacggcggcgggccccggctgctggcccgccgctgtgcgcgccacggcgtacggctgatccacgtctcgaccgactacgtcttcccgggcgacacccgcagcccttacggcgagtcggacgctccgggcccgcgcacggtgtacggccgcagcaaactggccggggaacgggccgtgctgtcgctgctgccggatacgggcaccgtggtgcgcacggcgtggctctacggcgggcagggccgcagcttcgtgcgcacgatgctggagcgtgccccggacgacggccatgtcgacgtcgtcaacgaccagtgggggcagccgacgtgggccggtgacgtggcccggctgctggtgacgctggcccgcacgccgccagaccgggcgcgcgggatcttccacgccaccaacgccggggcggccacctggtacgagctggcccgggaggtgttccggctggcgggcgcggacccggaacgggtgcgcccggtggcgacggccgaccggccgggcccggcgccccggccggcgtgcacggtgctcgggcacgaccgctggcggctggtcggcgtcgcaccgccccgcgactggcgtgcagccctgcgcgaggcgatgcgtcagctgctgcccggcgggcgcctcaggaacctgacggggacgtga

SEQ ID NO: 49927 - protein, 291 aa, Streptomyces nogalater
MLARHLTAALAETGRSRPAAEAVVLGRRALDITDGRAVDAAFAAHRPRVVVNCAAFTDVDGAESRWAEAMRVNGGGPRLLARRCARHGVRLIHVSTDYVFPGDTRSPYGESDAPGPRTVYGRSKLAGERAVLSLLPDTGTVVRTAWLYGGQGRSFVRTMLERAPDDGHVDVVNDQWGQPTWAGDVARLLVTLARTPPDRARGIFHATNAGAATWYELAREVFRLAGADPERVRPVATADRPGPAPRPACTVLGHDRWRLVGVAPPRDWRAALREAMRQLLPGGRLRNLTGT

SEQ ID NO: 49928 - DNA, 921 bp, Leptospira interrogans
  CDS (1)..(921): transl_table=11
atgatttattatactggaaaaaacggtcagttaggttgggaattggccgaaagatttaaatctaatggattggaagcagtaggatttggtagggaagaatgggatcttgcagatcttgattctgccgcacgaattttgaaggattctcctcggattttagttcattgtggggcttatactgcggtagataaggcagagtccgactcagagaacgcttacaaaatcaattcgttatctgtaaaaaaaatttcggaagaatgtctaaaaagaaaaatccatttaatttatatatccactgattttgtgtttgatgcaaattcggaaacgatcggtgatacgattcgtttttggaaaccggattctacactttctccaaaaggaatctacggattgtcaaaggcggaaggggaaaagtggattcgaaatacgtttgcgaattctaaacaagcaaatatcatccgtaccagttgggtatattcctctcatggaaataattttccaaaaacaattgtgaaacttttacaagattccaatcgtcatgaattaagagtgatcgaagatcaattgggaagacctacttgggctggtaggcttgcggattttataatattcttaatttatggaattctaaaaggagaatcttatcctgagattctacatttttctaactcaggagttgcgagctggtacgattttgcacttgcggttcgggatttttcacattctttttcattgatagaaaatttgaagccgatttatccaattcctacggaaggttatccaacacctgcacctaggcctagatattcaattttagatttagacgaaactcgaaaaatttttggcgttgttccgcattggagagaggatttaaccctttgtctgaaagaacttgccgaagtttccggaaaaaaagtatga

SEQ ID NO: 49929 - protein, 306 aa, Leptospira interrogans
MIYYTGKNGQLGWELAERFKSNGLEAVGFGREEWDLADLDSAARILKDSPRILVHCGAYTAVDKAESDSENAYKINSLSVKKISEECLKRKIHLIYISTDFVFDANSETIGDTIRFWKPDSTLSPKGIYGLSKAEGEKWIRNTFANSKQANIIRTSWVYSSHGNNFPKTIVKLLQDSNRHELRVIEDQLGRPTWAGRLADFIIFLIYGILKGESYPEILHFSNSGVASWYDFALAVRDFSHSFSLIENLKPIYPIPTEGYPTPAPRPRYSILDLDETRKIFGVVPHWREDLTLCLKELAEVSGKKV

SEQ ID NO: 49930 - DNA, 879 bp, Actinobacillus actinomycetemcomitans
  CDS (1)..(879): transl_table=11
atggcaaaatttttgattacgggtgcaaacgggcaagttggccactgtttaactcaacaattacaaggcaagcacgaaattttagccgttgatcatgatgagcttgatattaccaaccaaagtgcggtgaaaaaaacggtcaaaaattttcgtcctgatgtagttattaacgccgcagcacacactgcggtagatcgtgcagaaactgaaattgagctttccgaagccattaatgtaaaaggtcctcaatacttggcagaagccgcgaaaagtgttggtgctgcaattttacatatttcaacagactatgtttttgacggccggcgtgcaggtaaatacaaagaaactgatgcaaccgatccgcaaagtatttacggcaaaaccaaactagcgggcgaacaagccgttgtagaagcaaacgataaatttatcgtattgcgtaccgcttgggtattctgcgagcacggcagcaattttgttaaaacaatgctgcgattagccaaaactcgtgacactttaggtgtagttgccgatcagatcggcggacctacctatgcaggagatattgccgctgcgttaattcaaatcgcagaaaaaattattgcaggcaaatctgttgaatatggtatttatcactttacgggagagccttatgtcagctggtgtgattttgccagagcaatttttgatgaagccgtttcgcaaaatatgttagaaaaagtaccgcttgtcaatgcaatcaccacggcagattacccaacaccagccaaacgccctgcgaattcttgtttagatttaaccaaaattcaacaagtattcggtatccaaccaagtgattggcaaagagctttgaaaaatattaaagcgtatgcggagtaa

SEQ ID NO: 49931 - protein, 292 aa, Actinobacillus actinomycetemcomitans
MAKFLITGANGQVGHCLTQQLQGKHEILAVDHDELDITNQSAVKKTVKNFRPDVVINAAAHTAVDRAETEIELSEAINVKGPQYLAEAAKSVGAAILHISTDYVFDGRRAGKYKETDATDPQSIYGKTKLAGEQAVVEANDKFIVLRTAWVFCEHGSNFVKTMLRLAKTRDTLGVVADQIGGPTYAGDIAAALIQIAEKIIAGKSVEYGIYHFTGEPYVSWCDFARAIFDEAVSQNMLEKVPLVNAITTADYPTPAKRPANSCLDLTKIQQVFGIQPSDWQRALKNIKAYAE

SEQ ID NO: 49932 - DNA, 855 bp, Streptococcus pneumoniae
  CDS (1)..(855): transl_table=11
atgatcttaattacaggtgcaaatggtcaacttggtaccgaactacgttatttactaaatgagcgaaatgtggactatgttgcagtggatgtgaccgaaatggatatcactaattctgaaatggttgaaaaagtctttgctgaggttaagccaactctagtctatcattgtgcagcctacactgctgttgatgcagccgaagatgaagggaaagaactggattttgccatcaacgtaactggaactgaaaatgtagccaagggctctgagaaatacggagctattctggtctatatctcaacagactacgtctttgatggaaagaaaccagtaggacaagagtgggaagtcgatgacatacctgatccgcaaacagagtacggacgtaccaagcgaatgggagaagaacttgttgagaaccttacgtcacagcattacatcattcgtactgcttgggtttttggaaattatggaaggaactttgtctttaccatgcaaagcctagccgaaacccataaaacgctcacagtggtcagcgaccaatacggtcgcccaacttggacacggaccttggccgagttcatgacctatgtgactgaaaatcaaaaagagtatggctactatcacttatcgaatgacgcagctgaggacaccacttggtatgactttgctagcgagattcttaaggagagtgatgttgaactattgccagtagactctagcaagttccccgctaaggctaaacgacctctcaactcaactatgagtttggcaaaggcaaaggcaacaggtttcgtcatcccaacctggcaagatgcccttaaagagttttataaacaagaagtaagaaaataa

SEQ ID NO: 49933 - protein, 284 aa, Streptococcus pneumoniae
MILITGANGQLGTELRYLLNERNVDYVAVDVTEMDITNSEMVEKVFAEVKPTLVYHCAAYTAVDAAEDEGKELDFAINVTGTENVAKGSEKYGAILVYISTDYVFDGKKPVGQEWEVDDIPDPQTEYGRTKRMGEELVENLTSQHYIIRTAWVFGNYGRNFVFTMQSLAETHKTLTVVSDQYGRPTWTRTLAEFMTYVTENQKEYGYYHLSNDAAEDTTWYDFASEILKESDVELLPVDSSKFPAKAKRPLNSTMSLAKAKATGFVIPTWQDALKEFYKQEVRK

SEQ ID NO: 49934 - DNA, 891 bp, Klebsiella pneumoniae
  CDS (1)..(891): transl_table=11
atgaatatttcactgatcggcaacaatggccaggtgggctgggagctgcatcgttccctgtctttcctcggcgacgtggtcgcggtggattattttgataaagagctttgcggtgacctgaccaacctggaaggcgtcgcgcataccgtgcgtcctgtccgcccggatgtggtggtgaatgccgccgcgcactcgccgtggacaaggctcaaatctatcgggagctttcccacctgcctgatacgacaaatgggtggcggtgctggcggtggagtcggcgaactcggtgccctgatggtgcactattccaccgactatgtgttcgacggcgccggcagccattatcgtcgggaagatgaagcgaccggcccgcttaacgtctacggcgaaaccaagcgtgccggtgagctggccctgcagcagggcaacccgcgtcacctgattttccgtaccagctgggtgtatgccacccgcggcgccaactttgccaaaaccatgctccgcctggcgggggagaaagagaccctcaccatcattgacgaccttctttgggcgcccaccggcgctgagctgctggcagactgcacggcgacggcaatccgtgaaacgctgcgtaatccggcgctggccggcacgtatcacctggtggccagcggcgaaacagctggtgcgactatgcccgctatgtgtttgaagtggcgagagcgcacggtgccgagcctggcggtgcaggaagtgaagggcattccgaacgacggcctatccgacgccggcgaagcgtccgctcaactcgcgcctgtcgaattaaaaatccagcaggcattcggggtgactctcccggactggcgtcagggtgtggctcgcgtggtaacagaagtcctgggcaaataa

SEQ ID NO: 49935 - protein, 296 aa, Klebsiella pneumoniae
MNISLIGNNGQVGWELHRSLSFLGDVVAVDYFDKELCGDLTNLEGVAHTVRPVRPDVVVNAAAHSPWTRLKSIGSFPTCLIRQMGGGAGGGVGELGALMVHYSTDYVFDGAGSHYRREDEATGPLNVYGETKRAGELALQQGNPRHLIFRTSWVYATRGANFAKTMLRLAGEKETLTIIDDLLWAPTGAELLADCTATAIRETLRNPALAGTYHLVASGETAGATMPAMCLKWRERTVPSLAVQEVKGIPNDGLSDAGEASAQLAPVELKIQQAFGVTLPDWRQGVARVVTEVLGK

SEQ ID NO: 49936 - DNA, 921 bp, Leptospira borgpetersenii
  CDS (1)..(921): transl_table=11
atgatttattatactggaaaaagcggtcagttaggttgggagttgaccaaaagattcaaatctttggatttggaatctataggatttagtagagaagaatgggaccttaccgatcttgattctgtagaaaaaattttaaaagattctcctaaaattttagttcattgtggagcctatactgccgtggataaagcagagtccgattcggagaacgtttacaagatcaattccttatctgtaaaaaaaatttcggaagaatgtctaaaaagaaaaatccatctgatttatatatccactgattttgtgttcgatgcaaattcggaaacgatcggggatacgattcgtttttggaaaccggattctacactttccccgaaaggaatttatggtttatcgaaagcggaaggagaaaggtggattcaaaatatatttgcggattctaaacaagcgaatatagtccgaacaagttgggtatattcctcttatggaaataattttcctaaaacaattttgaaacttttacaagatcctaagcgtaccgaattaaaagtaattgaagatcaattggggaggcctacttgggcgggtaggcttgccgactttataatattcttaatttatgaaattctaaaaaagggggggtatccggagattttgcacccttccaattccggaattgcgagttggtatgattttgcgatagcaattcgagatatctcgtattctttttcattgatagaaaatttaaaaccgatttctccgattcctacggaaagttatcctacagctgccccgagacctagatactcaattttagatttaaatgaaactcgaaaaatttttggtcccgttccgcattggaaagaagatttaactctctgtctgaaagaaatcgccgagattttcggaaaaaaagtatga

SEQ ID NO: 49937 - protein, 306 aa, Leptospira borgpetersenii
MIYYTGKSGQLGWELTKRFKSLDLESIGFSREEWDLTDLDSVEKILKDSPKILVHCGAYTAVDKAESDSENVYKINSLSVKKISEECLKRKIHLIYISTDFVFDANSETIGDTIRFWKPDSTLSPKGIYGLSKAEGERWIQNIFADSKQANIVRTSWVYSSYGNNFPKTILKLLQDPKRTELKVIEDQLGRPTWAGRLADFIIFLIYEILKKGGYPEILHPSNSGIASWYDFAIAIRDISYSFSLIENLKPISPIPTESYPTAAPRPRYSILDLNETRKIFGPVPHWKEDLTLCLKEIAEIFGKKV

SEQ ID NO: 49938 - DNA, 906 bp, Escherichia coli
  CDS (1)..(906): transl_table=11
atgaatatcctcctattcggcaaaacagggcaggtaggttgggaactgcagcgtgctctggcaccgctgggtaatctgattgctcttgatgttcactccactgattattgtggtgattttagtaatcccgaaggtgtagctgaaactgtcaaaaaaattcgccctgatgttattgttaatgcggctgctcacactgacgtagacaaagcggaatcagaaccggaatttgcacaattacttaacgcgacaagtgtcgaagcgattgcaaaagcagccaatgaagtcggtgcttgggttattcactactctactgactacgtatttccgggaaccggtgaaataccgtggcagggaggaacggatgctacagcacctttgaatgtttatggtgaaactaaacttagctccgagaaaaaagcgttacagaaacattgcggcaagcatattattttccgtaccagctgggtatatgcaggtaaaggaaataacttcgccaaaacaatgttgcgtctggcaaaagagcgcgaagaactggctgtgataaacgatcagtttggccgaccaacaggtgccgaattgctggctgattgcaccgctcatgccattcgcgtagcagtagacaaaccagaagttgctggtttgtaccatctggttgctggcggtacaacaacctggcacgattatgccgctctggtatttgaagaagcgcgcaaagcagggattaaccttgctcttaacaaacttaacgccgtgccaacaacggcctatcccacaccagcccgtcgaccccataactctcgcctcaatacagaaaagtttcagcagaactttgcgcttgtcttgcctgactggcaggtgggtgtgaaacgaatgctcaacgaattatttacgactacggcaatttaa

SEQ ID NO: 49939 - protein, 301 aa, Escherichia coli
MNILLFGKTGQVGWELQRALAPLGNLIALDVHSTDYCGDFSNPEGVAETVKKIRPDVIVNAAAHTDVDKAESEPEFAQLLNATSVEAIAKAANEVGAWVIHYSTDYVFPGTGEIPWQGGTDATAPLNVYGETKLSSEKKALQKHCGKHIIFRTSWVYAGKGNNFAKTMLRLAKEREELAVINDQFGRPTGAELLADCTAHAIRVAVDKPEVAGLYHLVAGGTTTWHDYAALVFEEARKAGINLALNKLNAVPTTAYPTPARRPHNSRLNTEKFQQNFALVLPDWQVGVKRMLNELFTTTAI

SEQ ID NO: 49940 - DNA, 891 bp, Rhizobium sp
  CDS (1)..(891): transl_table=11
atgcggctcgcggtgaccggcaaaaacggacaaatcgccctcgctttgaaggcgcaggcgcgacctgacgtcgagatacttactttggggcggccgaatttcgatctggcttgccgctcgactgtcgcaagctccatcagggatgccgcaccggacataattgtctctttggccgcctataccgccgtcgataaggccgaaagcgagccatacgaagccttcgctgtgaaccgcgatggagtgcaggcactggccgaggcagccgccgggctcggtgtcccagttattcatctttcgacagattacgtgtttgacggtgcgaagccggtgccttactgcgaggaagaccgcacaggcccgatttcagtttatggcaggtccaaacttgagggtgaatttgcggttgcctccgccaacccaaatcatacgatcctgcgcacttcatgggtctattctcgatacggccaaaacttcgtgaagaagatgctccggctcgccgatacgaatgacgaattgaatgtcgtcgccgatcagctcggctgtccgacatcggctgacgacatcagcgtcgccgtcatgacgatagccagacggatgctgtcgagctcatcggctgatttgcgcgggatattccacctgtcaggatcgggtgaggccagctgggcggccttcgcgaaatacgtcttttccgtttacgacgagataaccgggcgccaaatcaaagtccatgacatatccgctgcagaatatcccacaccggctcgccgcccagcaaattcgaggctccactgcgacaagcttgagcgaacctttggtatccgtctgccaaattgggaggagtccacgcgccggctggtttgggcgctgcttttagaagggaaagatgcgtga

SEQ ID NO: 49941 - protein, 296 aa, Rhizobium sp
MRLAVTGKNGQIALALKAQARPDVEILTLGRPNFDLACRSTVASSIRDAAPDIIVSLAAYTAVDKAESEPYEAFAVNRDGVQALAEAAAGLGVPVIHLSTDYVFDGAKPVPYCEEDRTGPISVYGRSKLEGEFAVASANPNHTILRTSWVYSRYGQNFVKKMLRLADTNDELNVVADQLGCPTSADDISVAVMTIARRMLSSSSADLRGIFHLSGSGEASWAAFAKYVFSVYDEITGRQIKVHDISAAEYPTPARRPANSRLHCDKLERTFGIRLPNWEESTRRLVWALLLEGKDA

SEQ ID NO: 49942 - DNA, 900 bp, Salmonella typhimurium
  CDS (1)..(900): transl_table=11
atgaatatcttactttttggtaagacagggcaagtaggctgggagttgcaacgttctctggcaccggtagggaatctgattgccctggatgtccattcaaaagagttttgcggtgattttagtaatccgaaaggcgttgccgaaaccgttcgtaagcttcgtcccgatgtgattgttaacgcagcagcccatactgcagtagataaagcagagtctgaaccagaactggcgcagttacttaacgccaccagtgtggaagccatcgctaaagcagccaacgaaactggcgcatgggtagtgcattattcaaccgattatgtatttcctggtaccggcgatatcccatggcaggaaacggacgctacgtcgccgctgaatgtctatggcaaaaccaaactggcgggagaaaaggccctgcaggataactgccctaaacaccttatcttccgcaccagttgggtttatgcaggtaagggcaataatttcgcaaagacaatgcttcgtctggcgaaagagcgtcagacactttcagtcattaacgatcagtacggtgcgccaaccggtgcggaattactggctgactgtacggcgcatgcgatccgtgtggcgttaaataaaccagaagtcgcaggtctttaccatctggttgccgggggaaccacaacctggcatgactacgcggccttagtctttgacgaggcgcgcaaagcagggataacgcttgcgctgactgagcttaatgctgtgccgaccagcgcctacccgacgccggcgagcagaccaggcaattcgcgtctcaatactgaaaagtttcagcgtaattttgaccttattctgcctcaatgggaattaggagttaagcgtatgctgactgaaatgtttacgacgacaaccatctaa

SEQ ID NO: 49943 - protein, 299 aa, Salmonella typhimurium
MNILLFGKTGQVGWELQRSLAPVGNLIALDVHSKEFCGDFSNPKGVAETVRKLRPDVIVNAAAHTAVDKAESEPELAQLLNATSVEAIAKAANETGAWVVHYSTDYVFPGTGDIPWQETDATSPLNVYGKTKLAGEKALQDNCPKHLIFRTSWVYAGKGNNFAKTMLRLAKERQTLSVINDQYGAPTGAELLADCTAHAIRVALNKPEVAGLYHLVAGGTTTWHDYAALVFDEARKAGITLALTELNAVPTSAYPTPASRPGNSRLNTEKFQRNFDLILPQWELGVKRMLTEMFTTTTI

SEQ ID NO: 49944 - DNA, 915 bp, Streptomyces griseus
  CDS (1)..(915): transl_table=11
atgtccccgtaccctcgcccgcgttggctcgtcaccggtgcgtccggcatgctggggcgcgagctcacccccctgctggaccgccggggtgccgccgtgaccgcgctcggtcgcggccacctggacatcacggacggcgccgccgtgcgttccgccgtggcggagcaccggccggcggtggtggtcaactgcgcggcgtggaccgcggtcgacgaggccgagtcggagccggccctggccatggcggtgaacggggagggcccgcgccatctcgcgcaggcgtgccgcgccgtgggggccgtgctgctccagctgtccaccgactacgtgttccccggctcgggcggacggccctaccgggaggaccacccgaccggtccgcgcacggtgtacggctgcaccaagcgggccggggagcgcgcggtgctggaggtcctcccggacaccggctacatcgtccgtacggcttggctgtacggagcgggcggccccaacttcgtggcgaagatgatccggctggaggcggacgaggacaccgtgctggtcgtggacgaccagcacggccagccgacctggaccgccgacctcgcggaccggctggcggccctgggggcggcggcgctggcgggaacggccccggccgggatctaccacgcgaccaacacgggcgggaccacctggaacgcgctggcgccggagaccttccgcctgctcggcgccgacccggcacgggtccggcccaccaccagtctggcgctggcccggcctgccgtacggccccggtacagcgtgctggaccagtcccgctggaaggcggccggactcgaaccgctgcggcactggcgggccgcgctgacggagtcgttccccgcactctgcggacgggccggccggccggtgcccgggccgcgctga

SEQ ID NO: 49945 - protein, 304 aa, Streptomyces griseus
MSPYPRPRWLVTGASGMLGRELTPLLDRRGAAVTALGRGHLDITDGAAVRSAVAEHRPAVVVNCAAWTAVDEAESEPALAMAVNGEGPRHLAQACRAVGAVLLQLSTDYVFPGSGGRPYREDHPTGPRTVYGCTKRAGERAVLEVLPDTGYIVRTAWLYGAGGPNFVAKMIRLEADEDTVLVVDDQHGQPTWTADLADRLAALGAAALAGTAPAGIYHATNTGGTTWNALAPETFRLLGADPARVRPTTSLALARPAVRPRYSVLDQSRWKAAGLEPLRHWRAALTESFPALCGRAGRPVPGPR

SEQ ID NO: 49946 - DNA, 26 bp, Artificial sequence
  (1)..(26): primer
atgaatatcctcctttttggcaaaac

SEQ ID NO: 49947 - DNA, 27 bp, Artificial sequence
  (1)..(27): primer
ttaaattgctgtagtcgtaaataattc

SEQ ID NO: 49948 - protein, 351 aa, Artificial sequence
  Variant (2)..(3): xaa in position 2 to 3 is any amino acid
  Variant (6)..(6): xaa in position 6 is any amino acid
  Variant (8)..(9): xaa in position 8 to 9 is any amino acid
  Variant (11)..(19): xaa in position 11 to 19 is any amino acid
  Variant (20)..(63): xaa in position 20 to 63 is any or no amino acid
  Variant (65)..(69): xaa in position 65 to 69 is any amino acid
  Variant (70)..(70): xaa in position 70 is any or no amino acid
  Variant (73)..(73): xaa in position 73 is any amino acid
  Variant (75)..(75): xaa in position 75 is any amino acid
  Variant (78)..(78): xaa in position 78 is any amino acid
  Variant (81)..(89): xaa in position 81 to 89 is any amino acid
  Variant (90)..(91): xaa in position 90 to 91 is any or no amino acid
  Variant (93)..(99): xaa in position 93 to 99 is any amino acid
  Variant (101)..(113): xaa in position 101 to 113 is any amino acid
  Variant (120)..(120): xaa in position 120 is any amino acid
  Variant (122)..(133): xaa in position 122 to 133 is any amino acid
  Variant (134)..(141): xaa in position 134 to 141 is any or no amino acid
  Variant (143)..(145): xaa in position 143 to 145 is any amino acid
  Variant (148)..(149): xaa in position 148 to 149 is any amino acid
  Variant (151)..(152): xaa in position 151 to 152 is any amino acid
  Variant (155)..(165): xaa in position 155 to 165 is any amino acid
  Variant (166)..(173): xaa in position 166 to 173 is any or no amino acid
  Variant (176)..(176): xaa in position 176 is any amino acid
  Variant (178)..(182): xaa in position 178 to 182 is any amino acid
  Variant (184)..(184): xaa in position 184 is any amino acid
  Variant (185)..(189): xaa in position 185 to 189 is any or no amino acid
  Variant (192)..(193): xaa in position 192 to 193 is any amino acid
  Variant (195)..(205): xaa in position 195 to 205 is any amino acid
  Variant (206)..(213): xaa in position 206 to 213 is any or no amino acid
  Variant (215)..(216): xaa in position 215 to 216 is any amino acid
  Variant (219)..(219): xaa in position 219 is any amino acid
  Variant (221)..(221): xaa in position 221 is any amino acid
  Variant (224)..(228): xaa in position 224 to 228 is any amino acid
  Variant (230)..(239): xaa in position 230 to 239 is any amino acid
  Variant (240)..(257): xaa in position 240 to 257 is any or no amino acid
  Variant (259)..(260): xaa in position 259 to 260 is any amino acid
  Variant (262)..(268): xaa in position 262 to 268 is any amino acid
  Variant (269)..(273): xaa in position 269 to 273 is any or no amino acid
  Variant (275)..(277): xaa in position 275 to 277 is any amino acid
  Variant (279)..(296): xaa in position 279 to 296 is any amino acid
  Variant (297)..(316): xaa in position 297 to 316 is any or no amino acid
  Variant (318)..(318): xaa in position 318 is any amino acid
  Variant (321)..(322): xaa in position 321 to 322 is any amino acid
  Variant (324)..(324): xaa in position 324 is any amino acid
  Variant (326)..(335): xaa in position 326 to 335 is any amino acid
  Variant (336)..(350): xaa in position 336 to 350 is any or no amino acid
GXXGQXGXXLXXXXXXXXXXXXXXXXXXXXXXXXXXXXXXXXXXXXXXXXXXXXXXXXXXXXXPXXXXXXAAXTXVDXAEXXXXXXXXXXXNXXXXXXXAXXXXXXXXXXXXXSTDYVFXGXXXXXXXXXXXXXXXXXXXXPXXXYGXXKXXGEXXXXXXXXXXXXXXXXXXXRTXWXXXXXGXXXXXXNFXXTXXXXXXXXXXXXXXXXXXXVXXDQXGXPTXXXXXAXXXXXXXXXXXXXXXXXXXXXXXXXXXXGXXHXXXXXXXXXXXXWXXXAXXXXXXXXXXXXXXXXXXXXXXXXXXXXXXXXXXXXXXAXRPXXSXLXXXXXXXXXXXXXXXXXXXXXXXXXW

SEQ ID NO: 49949 - protein, 10 aa, Artificial sequence
  Variant (2)..(3): xaa in position 2 to 3 is any or no amino acid
  Variant (6)..(6): xaa in position 6 is Leu or Val
  Variant (7)..(7): xaa in position 7 is Ala, Gly, Ser or Val
  Variant (8)..(9): xaa in position 8 to 9 is any amino acid
  Variant (10)..(10): xaa in position 10 is Phe, Ile, Leu, Met or Val
GXXGQXXXXX

SEQ ID NO: 49950 - protein, 11 aa, Artificial sequence
  Variant (2)..(2): xaa in position 2 is any or no amino acid
  Variant (4)..(4): xaa in position 4 is His, Trp or Tyr
  Variant (6)..(6): xaa in position 6 is any amino acid
  Variant (9)..(9): xaa in position 9 is any amino acid
  Variant (10)..(10): xaa in position 10 is Ala, Cys or Ser
AXAXTXVDXXE

SEQ ID NO: 49951 - protein, 8 aa, Artificial sequence
  Variant (7)..(7): xaa in position 7 is any amino acid
STDYVFXG

SEQ ID NO: 49952 - protein, 13 aa, Artificial sequence
  Variant (2)..(2): xaa in position 2 is any amino acid
  Variant (3)..(3): xaa in position 3 is Gly, Asn, Ser or Thr
  Variant (4)..(4): xaa in position 4 is any amino acid
  Variant (7)..(7): xaa in position 7 is any amino acid
  Variant (8)..(8): xaa in position 8 is Ser or Thr
  Variant (10)..(11): xaa in position 10 to 11 is any amino acid
PXXXYGXXKXXGE

SEQ ID NO: 49953 - protein, 10 aa, Artificial sequence
  Variant (2)..(2): xaa in position 2 is any amino acid
  Variant (3)..(3): xaa in position 3 is Ala, Cys, Gly or Ser
  Variant (5)..(5): xaa in position 5 is Leu or Val
  Variant (6)..(6): xaa in position 6 is any amino acid
  Variant (7)..(7): xaa in position 7 is Ala, Cys, Gly or Ser
  Variant (8)..(9): xaa in position 8 to 9 is any amino acid
RXXWXXXXXG

SEQ ID NO: 49954 - protein, 17 aa, Artificial sequence
  Variant (2)..(2): xaa in position 2 is any amino acid
  Variant (3)..(3): xaa in position 3 is any or no amino acid
  Variant (5)..(5): xaa in position 5 is any or no amino acid
  Variant (7)..(7): xaa in position 7 is any amino acid
  Variant (9)..(9): xaa in position 9 is any amino acid
  Variant (11)..(11): xaa in position 11 is Ser or Thr
  Variant (12)..(12): xaa in position 12 is any amino acid
  Variant (13)..(13): xaa in position 13 is Ala, Ser, Thr or Val
  Variant (14)..(15): xaa in position 14 to 15 is any amino acid
  Variant (16)..(16): xaa in position 16 is Ile or Leu
  Variant (17)..(17): xaa in position 17 is Ala, Asn or Val
VXXDXQXGXPXXXXXXX

SEQ ID NO: 49955 - protein, 9 aa, Artificial sequence
  Variant (2)..(2): xaa in position 2 is any amino acid
  Variant (5)..(6): xaa in position 5 to 6 is any amino acid
  Variant (8)..(8): xaa in position 8 is any amino acid
  Variant (9)..(9): xaa in position 9 is Leu or Met
AXRPXXSXX

SEQ ID NO: 49956 - DNA, 966 bp, Escherichia coli
  CDS (1)..(966)
atgacaaagtatgcattagtcggtgatgtgggcggcaccaacgcacgtcttgctctgtgtgatattgccagtggtgaaatctcgcaggctaagacctattcagggcttgattaccccagcctcgaagcggtcattcgcgtttatcttgaagaacataaggtcgaggtgaaagacggctgtattgccatcgcttgcccgattaccggagactgggtggcaatgaccaaccatacctgggcgttctcaattgccgaaatgaaaaagaatctcggttttagccatctggaaattattaacgattttaccgctgtatcgatggcgatcccgatgctgaaaaaagagcatctgattcagtttggtggcgcagaaccggtagaaggtaagcctattgcggtttacggtgccggaacggggcttggggttgcgcatctggtccatgtcgataagcgttgggtaagcttgccgggcgaaggcggtcacgttgattttgcgccgaatagtgaagaagaggccattatcctcgaaatattgcgtgcggaaattggtcatgtttcggcggaacgcgtgctttctggcccaggactggtgaatttgtatcgcgcaattgttaaagccgacaaccgcctgccagaaaatctcaagccaaaagatattaccgaacgcgcgctggctgacagctgcaccgattgccgccgtgcgttgtcgctgttttgcgtcattatgggccgttttggcggcaatctggcgctcaatctcgggacatttggcggcgtgtttattgcgggcggtatcgtgccgcgcttccttgagttcttcaaagcctctggtttccgtgccgcatttgaagataaagggcgctttaaagaatatgtccatgatattccggtgtatctcatcgtccatgacaatccgggtcttctcggttccggtgcacatttacgccagaccttaggtcacattctgtaa

SEQ ID NO: 49957 - protein, 321 aa, Escherichia coli
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEAIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDNPGLLGSGAHLRQTLGHIL

SEQ ID NO: 49958 - DNA, 1020 bp, Xylella fastidiosa 9a5c
  CDS (1)..(1020): transl_table=11
ttgctagtgacctcaatgattccgaaccctacccgagatgcacccaatatcccgtcctttgttgccgccgatgtcggcggcactcacgtgcgcgtcagcgtggttgcagccgcgcccacgtgtgccagtccaccgcaactgttggatgtgcgcacttaccgctgcgctgactatcccagcctcagcacaattctgaacgacttcctcggtacaagatcagcagtacgtgattgcgtcatcgccagtgccggttttcagcgcagcgatggtactgttatcactaccaacctaccgtggccgctatcaccacaccggctacgcgcagatctcgatctggcagaggtctctctggtcaacgactttgaggcgctggcctacgccacagaggatatggaggctgcgcaattgctgcacctcactggtccagccaaagcgcaggatgggccacgcctgttgcttggtccgggaaccggcctgggtgcagcactctggattcccaataacggacgccccattgtcctccctacggaagccggtcaagcagcattgccgagtacaactgaacttgaaatgcaactggtacgacacatgctgaacaaccgcacacatgtgccgattgagcatgctttatctgggccaggaatactcaatgtgtaccgcgccttgtgtgcgctacagtccgtcctcccccagcacgcaagcccagatgcgatcagtcacgctgcggcagcaggaacagacatgctgtcatcacagactctagaggtattctgcgacttcctcggcagcatcgttggtgatttggtcatgatgtacggtgcacaggggggtgtctatctggccggaggaatcctgccacagctgcgtgagccgctgctacgcagtcactttgtcgaacgcttcctcaataaaggccccatgggcgaggcattacagcacgtcccggtgcggctgatcgaacatgggcaactcggcatcgtaggtgcggcacgctggtacttaaataaaaaagcaacttaa

SEQ ID NO: 49959 - protein, 339 aa, Xylella fastidiosa 9a5c
MLVTSMIPNPTRDAPNIPSFVAADVGGTHVRVSVVAAAPTCASPPQLLDVRTYRCADYPSLSTILNDFLGTRSAVRDCVIASAGFQRSDGTVITTNLPWPLSPHRLRADLDLAEVSLVNDFEALAYATEDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 49960 - DNA, 1056 bp, Ralstonia solanacearum GMI1000
  CDS (1)..(1056): transl_table=11
atgtctattggtctgcatgaagtcggcgtgggcagcatggacgatgtgacggcctacccgcgcctggtcggggatgtcggcgggaccaacgcgcgcttcgcgctggagatggcgccgatgcggctggcccatatcggcgtgctggccggcgacgactacccgtcgctggaagcggccatgcgcgcctatctcgccgcgctgccgccggagatcgccgcggcgggcgtgcggcatgcggccatcggcatcgccaatccggtgctgggcgaccagatccgcatgaccaaccgcgactgggcgttttccaccgaggcgatgcgccagtcgctgggcttcgataccttcgtcgtgctcaacgatttcgccgcgctggcgcacgcgctgccctacctgggcgccgacgagctggaacaggtgggcggcagcacctgcgtggccgacgcgccgcgcgcgctgctggggccgggcacgggcctgggcgtggcgtcgctgctgccgacgcaggcagggcgcttcatcgccgtcgcgggcgaggggggccacgtcgcgtttgcgccgatgaacgacgaggaagtcgtcatctggcgcttcgcgcgcgagcgcttcggccatgtctcggccgagcggctgatctcgggcatggggctggagctgatctacgaggcgctcggcgcgtgcttcgacctgtggcagcagggccccgccgtgcgccgcgccgccgacatcaccgccatcgccctgggcgaaatggaagacaccgccggcgatcacgcccgctgccgctacgccgtcgatacgttctgcgccatgctcggcaccgtggcggccaacctggcggtcacgctgggcgcgcggggcggggtctatatcggcggcggcatcgtgccgcggctgggcgccgccttcgccaattcaccgttccggcggcggttcgaagacaagggccgcttctccggctatgtggcggcgatgccggtgtacgtcatccatgcgccgtacccggggctgatcggcctgtgcgcggcgatggatcacgccgtggccagcggccactga

SEQ ID NO: 49961 - protein, 351 aa, Ralstonia solanacearum GMI1000
MSIGLHEVGVGSMDDVTAYPRLVGDVGGTNARFALEMAPMRLAHIGVLAGDDYPSLEAAMRAYLAALPPEIAAAGVRHAAIGIANPVLGDQIRMTNRDWAFSTEAMRQSLGFDTFVVLNDFAALAHALPYLGADELEQVGGSTCVADAPRALLGPGTGLGVASLLPTQAGRFIAVAGEGGHVAFAPMNDEEVVIWRFARERFGHVSAERLISGMGLELIYEALGACFDLWQQGPAVRRAADITAIALGEMEDTAGDHARCRYAVDTFCAMLGTVAANLAVTLGARGGVYIGGGIVPRLGAAFANSPFRRRFEDKGRFSGYVAAMPVYVIHAPYPGLIGLCAAMDHAVASGH

SEQ ID NO: 49962 - DNA, 1035 bp, Xanthomonas campestris pv. campestris str. ATCC 33913
  CDS (1)..(1035): transl_table=11
gtggctgcaacctcgcactctgcttgcgcttctgctctgcccgttgtccccgctcccaccacgtttctggctgccgatgtcggcggcacgcatgtgcgtgtcggccgggtctcgcatggcgcggatgcgccgatcgagctctcgcagtaccgcacctaccgctgcgccgaccatgccagcctggacgcgatcctggctgatttcctgcgcgatagccgcgccgtcgatgcagtggtgatcgccagcgcaggtgtcgcgctggacgacggccgcttcatcagcaacaacctgccctggaccatcgcgccgcgtcagttgcgcgacacgcttggcgtgcgtgcggtgcatctggtcaacgacttcgaagcggtggcgtatgccgcgccgcagatggaacagcgtgcggtggtgcaactaagcggccccacgccgcggcatgcgcagcccggtggcccgatcctggtggtcggcccgggcaccgggctaggcgctgcggtgtggatcaacggcccgcgccagccgaccgtgctcgccaccgaagccggccaggtcgcactggcaagcaatgaccccgacaccgcgcaggtgctgcgcatcctggcgcgcgacgcatcgtatctgccgatcgagcatgtgctctccggccccgggttgcgcaacctgtatctggcgctgtgcgaactgcacgcggccacgcccatccacccgttgcccgccgacatcacccacgccgcgctccacagcgacgatgcactggcgcggcggtgcctgcagctgttctgcgcgctgctcggcagcgcggtcggcgacatggcgctggcgtacggcgcctccggcggcgtgtatctggccggcggcatcctgccgagcatcggccagtttctggctgcgagtgatttccgcgaacgcttcctcgccaagggccgcatgcgcccggtgctggagcgcattccggtcaagttggtcgaacacgggcaactcggcgtgctcggcgcggccagctggtatctgcaacaccacaccgaggtgtcgtaa

SEQ ID NO: 49963 - protein, 344 aa, Xanthomonas campestris pv. campestris str. ATCC 33913
MAATSHSACASALPVVPAPTTFLAADVGGTHVRVGRVSHGADAPIELSQYRTYRCADHASLDAILADFLRDSRAVDAVVIASAGVALDDGRFISNNLPWTIAPRQLRDTLGVRAVHLVNDFEAVAYAAPQMEQRAVVQLSGPTPRHAQPGGPILVVGPGTGLGAAVWINGPRQPTVLATEAGQVALASNDPDTAQVLRILARDASYLPIEHVLSGPGLRNLYLALCELHAATPIHPLPADITHAALHSDDALARRCLQLFCALLGSAVGDMALAYGASGGVYLAGGILPSIGQFLAASDFRERFLAKGRMRPVLERIPVKLVEHGQLGVLGAASWYLQHHTEVS

SEQ ID NO: 49964 - DNA, 1017 bp, Xanthomonas axonopodis pv. citri str. 306
  CDS (1)..(1017): transl_table=11
gtgagcgcaagcagtccaatggaagcggtggcctttccgcgccccgaaaccttcgttgccgccgatgtgggcggcacgcacgtgcgcctggcgctggtatgcgagagcaatgacgcgggcaagccgatcacggtgctggactatcgcaagtaccgctgcgccgactatccgggccttgccgacatcatggccgcgttcttcgcggaactgggttgtgcaccagtacgccggggcgtgatcgccagcgccggctacgcgctggaagacggtagcgtgatcaccaccaatctgccctgggtactggcgccggagcagattcgccgccagctcggcatgcaggccctgcatctggtcaacgatttcgaagcggtcgcctatgcggccaattacatgagcggcaaccaggtcatgcagttgtctggcccggtgcagggtgccgcaggcccggcgttggtgcttggtccgggcacgggcctgggcgcggcgctgtggatccccaacgatggtcatccggtggtgctgcccaccgaagccggccacgcggcactggcgccggccagcgatctggaaatggcgttgctgcaggaactgcggcgcacgcgcacccacgtggggaccgaaacgctgttgtccggcccgggcctgttgaatctgtacaccgcgctggcggccttgcgtggggacaccgtggtgcacgccagcccggccgatatcaccgcggccgcaatggccggcaacgatggattggcgcacgacgccttgcaggcgttttgcggatttatgggcagcgtggtcggcgacctgatgctgctgtatggcgtgcgcagtggcgtttatctggctggcggtttcctgccgcaaatcgccacctttatcgccgatggcgacttcgtcgcgcgcctgctcgacaagggcgccttgcgtcccgcgctggagcaggtgccggtgagcatcgtcgagcacggccagcttggcgtcatcggtgctgccagctggttcctgcagcgcggccgctga

SEQ ID NO: 49965 - protein, 338 aa, Xanthomonas axonopodis pv. citri str. 306
MSASSPMEAVAFPRPETFVAADVGGTHVRLALVCESNDAGKPITVLDYRKYRCADYPGLADIMAAFFAELGCAPVRRGVIASAGYALEDGSVITTNLPWVLAPEQIRRQLGMQALHLVNDFEAVAYAANYMSGNQVMQLSGPVQGAAGPALVLGPGTGLGAALWIPNDGHPVVLPTEAGHAALAPASDLEMALLQELRRTRTHVGTETLLSGPGLLNLYTALAALRGDTVVHASPADITAAAMAGNDGLAHDALQAFCGFMGSVVGDLMLLYGVRSGVYLAGGFLPQIATFIADGDFVARLLDKGALRPALEQVPVSIVEHGQLGVIGAASWFLQRGR

SEQ ID NO: 49966 - DNA, 1035 bp, Xanthomonas axonopodis pv. citri str. 306
  CDS (1)..(1035): transl_table=11
gtggctgcgacttcgcgttccgcttacgcctctgcctcgcccgatgtccccgttgccatcagcttcatcgctgccgatgtcggcggcacgcatgtgcgtgtcgggcacatgctgcaggcgcgcgatgcagccatcgagctttcgcattaccgcacctatcgctgcgccgagtacgccagtctccaggccatcctcgaggatttcctgcaacagcggcgcggcgtcgatgcggtggtcatcgccagtgccggcgtggcgctggacgatggcagcttcatcagcaacaacctgccatggacgatttcacccagccgcatcggtgctgcactggcagtgcgcaacgtgcacctggtcaacgatttcgaggcggtggcctacgcagcgccgcagatggaacaacgcgccgtgctgcagctgagcgggccgacaccgcgccatgcgcgtgccaacgggccgattctggtggtcggccccgggaccggtctgggtgcagcactatggatcgatgccaagccacgcgcgatcgtgctggccaccgaagccggccaggtcgcgctggccagcacccatccgcgcgagtacgccgtgctgcaatgcctgttacgtgaccggcactatttgccgctcgagcacgtgctctccggcccgggattacggcatctctacgatgcggtgtgcgagctgcatggcgcaacgccgcgtcatcgtctgcccgccgccgtgacgcacgcagcgctgcacgaagacgatgcgcttgcgcgcgagtgcctggagattttttgcggcctgctggggagcgcggtcggcgacatggcgctggcctacggcgctgccgggggcatctatctggccgggggcttcctgccgacgatcggccagttcctggctggcagcgcctttgccgagcgcttcctggacaagggaaacatgcgcgctgtgctcgaacgcattccggtcaaattggtcgagcacgggcaactgggcgtgctcggcgcggccaactggtatctgcagcaccacaccgacctgtcgtaa

SEQ ID NO: 49967 - protein, 344 aa, Xanthomonas axonopodis pv. citri str. 306
MAATSRSAYASASPDVPVAISFIAADVGGTHVRVGHMLQARDAAIELSHYRTYRCAEYASLQAILEDFLQQRRGVDAVVIASAGVALDDGSFISNNLPWTISPSRIGAALAVRNVHLVNDFEAVAYAAPQMEQRAVLQLSGPTPRHARANGPILVVGPGTGLGAALWIDAKPRAIVLATEAGQVALASTHPREYAVLQCLLRDRHYLPLEHVLSGPGLRHLYDAVCELHGATPRHRLPAAVTHAALHEDDALARECLEIFCGLLGSAVGDMALAYGAAGGIYLAGGFLPTIGQFLAGSAFAERFLDKGNMRAVLERIPVKLVEHGQLGVLGAANWYLQHHTDLS

SEQ ID NO: 49968 - DNA, 975 bp, Yersinia pestis KIM
  CDS (1)..(975): transl_table=11
ttgatgacgacttatgccctggtgggtgacgttggcggtacgaatgcccggttggcgctttgcgctgttgcaacgggcgagatattgcaagcaaagacatattcagggttggaatatgaaagtttagaggatgtaatcaaacaatatctatcagagcatcaagccaaggtcaccgatgcttgtatcgcgattgcctgcccgattaccggggattgggtcgcaatgaccaatcatacttgggcattttctattgccgccatgcaacagaatctgggtctggaccatttggaagtgatcaatgacttcaccgcagtctccatggctatccccgtgttacctgcccaagatgttctgcaatttggtggcacacagccacagcctggcaaaccggtggcagtgtatggcgcaggtactgggctgggggtagcacatttagtgaatgttgatcgccgttggattagtttagcgggagagggcgggcatgttgatttcgcgcctaatagtgaagaagaagaccagattctggccgtattgcgccaggagttggggcatgtttccgctgagcgggtgctatctgggccgggcttagtcaatttatatcgggcaattgtgatttctgatgcgcgcctaccagagaaactggcaccgaaagatattaccgcacgggcgctggcggatagctgtaccgattgtcgccgggcattatcactattttgcgtaattatgggccgctttgggggcaatttagcccttaacctcagtacgtttggtggcgtttatattgcggggggcatcgtgccgcgctttatggagttctttaaagcctctggttttcgcgctgcgtttgaagataaaggccgttttaaagatttcttacaagatattccggtgtatatgattactcatccacaacccggtttactgggggctggtgcctatttacgccaaaaattggggtatgagttgtcaagctaa

SEQ ID NO: 49969 - protein, 324 aa, Yersinia pestis KIM
MMTTYALVGDVGGTNARLALCAVATGEILQAKTYSGLEYESLEDVIKQYLSEHQAKVTDACIAIACPITGDWVAMTNHTWAFSIAAMQQNLGLDHLEVINDFTAVSMAIPVLPAQDVLQFGGTQPQPGKPVAVYGAGTGLGVAHLVNVDRRWISLAGEGGHVDFAPNSEEEDQILAVLRQELGHVSAERVLSGPGLVNLYRAIVISDARLPEKLAPKDITARALADSCTDCRRALSLFCVIMGRFGGNLALNLSTFGGVYIAGGIVPRFMEFFKASGFRAAFEDKGRFKDFLQDIPVYMITHPQPGLLGAGAYLRQKLGYELSS

SEQ ID NO: 49970 - DNA, 990 bp, Thermosynechococcus elongatus BP-1
  CDS (1)..(990): transl_table=11
gtggcaatgacggttgtccttggcgccgatgtcggcggcacaaaaacccttgtggagttgtgggaggtggggggtcgtgattggcagttgctctaccgggcgaaataccctagccgcgatttccctaacttgacagcccttttgcaaatgttcctcaaggaaagtcctgcccatccacagcgggcatgtctggggattccaggcccagtcattgaccaagtcgctcaggtaaccaatttgggctggcgggtcagtgctgccgaattagagacggcattacagattcctggcgtgacgctgctgaatgattttgcggccgtggcctatggcgcattggtgctaccgccgacggattttgttgttcttcaggagcggccgcgccgtccccaagcgcctattgccctactgggagccggtactggcttgggggaagcactgctcatttggcagggcgatcgctaccaagtcatgccccttgagggtggtcacaccgattttcctccccgcaacgaagaggaagtgggtctactgcgctatctctggcaaacctacgaacgagtctctgtggagcgggtggtctctggcccagggctggtggccatttacgactatctcaagagtgtccacttcgctgccgagtcagcaggggtggcagcagcaatggcaaggggagaggatcccgccgccgtcgtgagtcagtacggcctcgcgggggatcccctgtgtgcagaagccttgcggatgtttgtcgaagcctacggcgcagaggcgggcaaccttgccctcaaaagtttacccctcggcggggtacttattgctggggggattgcccccaaaattttggcaaaaatggccgatggcacctttctccaagggtttgtgaataagggacggtttcgccccctgatggagcagttgtacgttgctgtgatcatcaatcctgaggtgggattacggggcgcggtacatttagctgctcagggggtctag

SEQ ID NO: 49971 - protein, 329 aa, Thermosynechococcus elongatus BP-1
MAMTVVLGADVGGTKTLVELWEVGGRDWQLLYRAKYPSRDFPNLTALLQMFLKESPAHPQRACLGIPGPVIDQVAQVTNLGWRVSAAELETALQIPGVTLLNDFAAVAYGALVLPPTDFVVLQERPRRPQAPIALLGAGTGLGEALLIWQGDRYQVMPLEGGHTDFPPRNEEEVGLLRYLWQTYERVSVERVVSGPGLVAIYDYLKSVHFAAESAGVAAAMARGEDPAAVVSQYGLAGDPLCAEALRMFVEAYGAEAGNLALKSLPLGGVLIAGGIAPKILAKMADGTFLQGFVNKGRFRPLMEQLYVAVIINPEVGLRGAVHLAAQGV

SEQ ID NO: 49972 - DNA, 960 bp, Pseudomonas putida KT2440
  CDS (1)..(960): transl_table=11
atgaagcacctgctggttggtgatattggcggcaccaatgcccgttttgcgttgtggcgtgacaaccagctgcatgaagtaaatgttttcgccaccgtggactacaccaacccggagcaggccatcgaggcctacctggaaagccaaggtatcgcccgcggtggcctggcggcggtgtgcctggcggtggccggcccggtcgatggcgatgaatttcgcttcaccaacaaccactggcgcctgagtcgcacggcattttgcaagaccttgcaggtcgagcggctgttgctgatcaatgatttcaccgcaatggcactgggcatgacgcgtctgcgcgaaggcgagttccgcgaggtgtgccccggccaggccgacccctcgaggccggcactggtgatcgggccaggtactggcctgggtgtgggctcgctgctgcgcctgggcgaacagctctggaaggccctgccgggtgaaggcgggcatgttgacctgccggtaggcaatgctcgcgaagcggcaatccaccagcagatccacagtcagatcggtcatgtcagcgccgaggccgtgctcagtgggggtggcctggtgcggctgtaccaggcgatctgtgcgctggacggcgacacgcccaggcacaagaccccggcgcatatcaccgatgccgcgctgggcggggagccacgggcgctggcggtggtcgagcagttctgtcgtttccttgggcgagtggcgggtaataatgtgctgacgctgggcgcgcgaggcggggtctatattgtgggcggtgtgattccgcgctttgccgagctgttcctgcgtagcgggtttgccgcgagttttgccgacaaggggtgtatgagtggctatttcaccggggtgccggtgtggctggtgacggcggagttttccgggttggagggagcaggggtagcgttgcagcaggcgttggatcactga

SEQ ID NO: 49973 - protein, 319 aa, Pseudomonas putida KT2440
MKHLLVGDIGGTNARFALWRDNQLHEVNVFATVDYTNPEQAIEAYLESQGIARGGLAAVCLAVAGPVDGDEFRFTNNHWRLSRTAFCKTLQVERLLLINDFTAMALGMTRLREGEFREVCPGQADPSRPALVIGPGTGLGVGSLLRLGEQLWKALPGEGGHVDLPVGNAREAAIHQQIHSQIGHVSAEAVLSGGGLVRLYQAICALDGDTPRHKTPAHITDAALGGEPRALAVVEQFCRFLGRVAGNNVLTLGARGGVYIVGGVIPRFAELFLRSGFAASFADKGCMSGYFTGVPVWLVTAEFSGLEGAGVALQQALDH

SEQ ID NO: 49974 - DNA, 987 bp, Bradyrhizobium japonicum USDA 110
  CDS (1)..(987)
atgagtatcggcaagacaggaaaaattcttctcgccgatatcggcggcaccaatgcgcgctttgcgctgagccaaagcgaaccgggcaacggcgaccagaccggatcgatcgactatgtgaaggtcgccgacttcccgaccgtccaggaagccattgtcgacgtgctggcgcgccgggccggcggcgaaccgccccaacgagccgtgctggccgtcgcaggccccgtcaccaacaaccgctgcgtcatgaccaacagcccctgggtcatcgacggcaacgagctccagccaacgctcggcttcgacagcgtccatgtgctcaacgatttcgaggtggtcgcctggtccctgcccgccttgcggtccgccgatctgatcccgctcggcggacaagatggcctccccggagaaccgttgctggtggtcgggcccggaaccggctttggcgtctcctgtctggttgagcgctatggggcgcggctggccgtcgtcaccgaggctggccacgcgacgttgccggcagagaacgagcgcgaggaacgcgtgatcgcgtccttgcgccgacgtttcggccatgtctccatcgagcgcggcgcgctgtcgggctccggcttgcaaagcctctacgaggcactcgcggagatcgacggcgtccaggtgccgcaccgcgacgcggccgccatcaccaaggcggccctggatggcagctgcccggtcagccgcgcgacgctggagatgttctgcgccaccctgggctcggtcgcgggcaacctcgcggtgaccttcggtgcccgcggcggcgtctatatcgccggcgggatcgtgccgcgcttcccggagttccttgcggcctccgcgttccgcgcgcgcttcgaagccaaggggcgcttccaggactatttgcgcaacatcccgacccggctcgtcacgaagcccgatgccagcttcgtcgggctgaagatgttcgccgaccacaatcctgattga

SEQ ID NO: 49975 - protein, 328 aa, Bradyrhizobium japonicum USDA 110
MSIGKTGKILLADIGGTNARFALSQSEPGNGDQTGSIDYVKVADFPTVQEAIVDVLARRAGGEPPQRAVLAVAGPVTNNRCVMTNSPWVIDGNELQPTLGFDSVHVLNDFEVVAWSLPALRSADLIPLGGQDGLPGEPLLVVGPGTGFGVSCLVERYGARLAVVTEAGHATLPAENEREERVIASLRRRFGHVSIERGALSGSGLQSLYEALAEIDGVQVPHRDAAAITKAALDGSCPVSRATLEMFCATLGSVAGNLAVTFGARGGVYIAGGIVPRFPEFLAASAFRARFEAKGRFQDYLRNIPTRLVTKPDASFVGLKMFADHNPD

SEQ ID NO: 49976 - DNA, 978 bp, Bradyrhizobium japonicum USDA 110
  CDS (1)..(978)
atgatcaaggcgacgctggaaggacgagccgcgttgcttgcagatgttggagggaccaacgcccgcttcgcactgctgactgacggcgagctcggcgcgatcacacatatggcggtcaaggactacgctacctttcaggaggccctcgctgcctatctcggcgcttcggccagggccgagaggcctgctcatgcaatcctcgccgcctctggcgcggttcagaatgcccgctgcgcactcacgaacaattcctggatcgtcgacgcagaggaattgcgcggggcctatgggttttcggccgtccgtttgatcaacgactttgaagcggtcgcatgggccctgccccggcttggccccgacagtttgctgcagctcggcgggcggcagcaggtgccgggggcaccccttgccgcgatcggccccggcaccggcctgggaatggcggtgagcataccacaccccggcggacagatcgttctcgccagcgagggaggccatgccacgctggcaggcggttcgttgcgcgaggatgcggtgattgagcatttgcggcaacgcttcggacatgtgtcggccgaacgcattctgtcgggcgcggggctcgagaacctgtatgacgctctcgcctgcatcgacggcgcgacgccgccaaagcgccgcgcgtccgacattacgcgggccggaattgagggaacgtgtccgatcagccgctccgccgttgacatgttctgcgcgatgctggggtccgtcgcgggcaacctcgcgctcgcgctgaccgcgagaggcgggatattcatcggcggcggcatcttgcgccacctgccggactatcttgccgcgtcccagtttcgccagcgcttcgaggagaaggggcggctccgaaaattcctcgagccgataccggcctatctgatcctggacgacgacgtcgcattcgtcggcctccgtaacctgatggaggtcgaaggcattggctga

SEQ ID NO: 49977 - protein, 325 aa, Bradyrhizobium japonicum USDA 110
MIKATLEGRAALLADVGGTNARFALLTDGELGAITHMAVKDYATFQEALAAYLGASARAERPAHAILAASGAVQNARCALTNNSWIVDAEELRGAYGFSAVRLINDFEAVAWALPRLGPDSLLQLGGRQQVPGAPLAAIGPGTGLGMAVSIPHPGGQIVLASEGGHATLAGGSLREDAVIEHLRQRFGHVSAERILSGAGLENLYDALACIDGATPPKRRASDITRAGIEGTCPISRSAVDMFCAMLGSVAGNLALALTARGGIFIGGGILRHLPDYLAASQFRQRFEEKGRLRKFLEPIPAYLILDDDVAFVGLRNLMEVEGIG

SEQ ID NO: 49978 - DNA, 966 bp, Pseudomonas syringae pv. tomato str. DC3000
  CDS (1)..(966): transl_table=11
gtgaagttggccctggtcggtgatataggcggtaccaatgcacgttttgccatttgggaagacgacacgctgcattctgtccgggtgttcccgaccattgactacgcaggccccgaaaaggccatcgaagtctatctgcaggaccttgaattgcagcgcggtgacattggctatgtgtgcctggcggtcgccgggccggtcgatggcgatctgtttcagttcaccaacagccactggcaactgagccgtgaggcgttctgcgccgacctgaaagtcgatcacctgctgctgatcaacgacttcaccgccatggcgctgggcatgacccggctcaaggacgatgaatacctgacggtctgtcatggcgtcggcaagccggatcgcccgcgcgtggtggtcgggccgggcactgggctgggcatcggcacgctgatcaaactggaagacagccgctggatggccttgccgggcgagggcgggcatgccgacctgccaatcggcacggcgcgcgaggccctgctgtggacgcggctgatggccgagcacgaacatgtcagcgccgaagtggtgctcagtggtgcgggcctgttgttgctgtatcaggtcagttgcgcgctggacggcatggacgcagagctcaagtcgcctgctgcgatcacgtcggctgcgctggcaggcgatccggtcgcggcggcggtgcttgaacagttctgcgtgttcctcggcagagtggtcggcaacaacgttctgaccctgggcagtctgggcggggtctacatcgtgggtggcgtggtgccacgtttcacagaattcttcatgaacagcggcttcaagcgcgccatgggcgagaagggcgtgatgagcggctacttcaagaacctgccggtctggctggtcaccgccgagtacccagggcttatgggttcaggcgttgcgctgcaacaggcgttcggttcgcaaatttga

SEQ ID NO: 49979 - protein, 321 aa, Pseudomonas syringae pv. tomato str. DC3000
MKLALVGDIGGTNARFAIWEDDTLHSVRVFPTIDYAGPEKAIEVYLQDLELQRGDIGYVCLAVAGPVDGDLFQFTNSHWQLSREAFCADLKVDHLLLINDFTAMALGMTRLKDDEYLTVCHGVGKPDRPRVVVGPGTGLGIGTLIKLEDSRWMALPGEGGHADLPIGTAREALLWTRLMAEHEHVSAEVVLSGAGLLLLYQVSCALDGMDAELKSPAAITSAALAGDPVAAAVLEQFCVFLGRVVGNNVLTLGSLGGVYIVGGVVPRFTEFFMNSGFKRAMGEKGVMSGYFKNLPVWLVTAEYPGLMGSGVALQQAFGSQI

SEQ ID NO: 49980 - DNA, 1008 bp, Nitrosomonas europaea ATCC 19718
  CDS (1)..(1008): transl_table=11
atggatcagtacctgttgtctggcgacatcggtggaaccaagactctgttacgttctgccgtggtaagaggtgaagaggttgaattccatcatgagcatctctatgacagtcaccagtacgatgattttgacgccattctggcagattttctggagcgatccggctgccagccggttgctgcttgcctggcagtagccgggccgatcgttgaacaacaggttcatctgaccaatctgccctggatgatcagtgcagccggcattgcagaaaaattttcgattcccgccgtgaaaattatcaatgatttcgagggaacagcagcttccatagaaatattgccgcaggatgatctgattacattgcaggccggtaaaccttcttcttcggcaatgcgtgtcgtgctgggagcagggaccggtatgggcgttgcctggctggcctggcgcggccagtactatgagccccttgcgactgaggcgggacatatcgattttgcaccgaccagtgccattcagatcgaactgctccggtatctgatggtcaggtatcaccgtgtttcgatcgagcggctgctttccggccaggggttgacccacattttcaattttctgcaaacccgcgccactgaagggactcatctcaaaagtatcgaactgaacgtcgacgatggagccaccgtgactcgtctggcattcgaacatcactacccgattgccttgcaggcgctggatctgttcgtggaaatttacggtacttatgcgggcaacctggcgctggcggggttgtgccgcggtggtgtctatattgcgggagggatcgcaccacgtatcatccggattttgcagcaatccggtttcatcgaggcgttttgcaacaagggacgatacagtgcgctggtgcgtgatattcctgtgtatgtggtaatgaatccgaaggccggtctgctgggtgccggactgcttgcgcagcgcatgctgcagcatcagactgtatcatcccggcagtaa

SEQ ID NO: 49981 - protein, 335 aa, Nitrosomonas europaea ATCC 19718
MDQYLLSGDIGGTKTLLRSAVVRGEEVEFHHEHLYDSHQYDDFDAILADFLERSGCQPVAACLAVAGPIVEQQVHLTNLPWMISAAGIAEKFSIPAVKIINDFEGTAASIEILPQDDLITLQAGKPSSSAMRVVLGAGTGMGVAWLAWRGQYYEPLATEAGHIDFAPTSAIQIELLRYLMVRYHRVSIERLLSGQGLTHIFNFLQTRATEGTHLKSIELNVDDGATVTRLAFEHHYPIALQALDLFVEIYGTYAGNLALAGLCRGGVYIAGGIAPRIIRILQQSGFIEAFCNKGRYSALVRDIPVYVVMNPKAGLLGAGLLAQRMLQHQTVSSRQ

SEQ ID NO: 49982 - DNA, 1047 bp, Prochlorococcus marinus subsp. marinus str. CCMP1375
  CDS (1)..(1047): transl_table=11
atgaatttattagcagctgatataggaggaacaaaaacgttacttggggtttttagatatgagggacaaataaaacaattgtataaagcaaaatattcatctgaagattgggataattttgatttaatgctaaaagattttatagccaatcttccttcaaacataactacaccaaaatatgcatgtattggtgttgcgggtgcaattaataataaaattgttaaattaactaatttaaattggcaaataagtcaagaatccctttgcaagacacttaatactgatgaagttatcttgttaaatgatttttcttgcttggtatatgcaataccttatctgcaacaaaaacaatataagtacattcaatccttaaaaacaaatttagattatcaaaaggaaggttccatttttgcaattcttggagctggtacaggtcttggtatggcaagaggcataataactaaatcaggtcttaaagcaatccctagtgaaggcggacatagagaattctcccctcgaaataataaggaatgggaactatgccaatggcttaaaaaagatctaaaactaaccagattgtccatagaaagagtagtaagtggaactggtcttgcaaatattgctcgttggagattaagccaagaggatactaagtctcatccaatattaagcattatagaagccaacaattctcataatttcaacaacaagttactccctgaaagagtatcaatcgcagccaaaggaggcgatccaattatgcgagaagttctagaaatgtggcttagtgcttacggatctgcagctggagaccttgcattacaagaactatctacagaagggctttggattggaggtggaacggcgataaagcatttagatggcctttcatcagaaatatttctaaactccttgaaaaacaaaggtcgtttttcagaatatcttgagaaactaccaataatggtcttaatagacccagaggctgggctatttggagctgcatgtaaagctcatctaatgaccaagtctaatgtcaaaataaactga

SEQ ID NO: 49983 - protein, 348 aa, Prochlorococcus marinus subsp. marinus str. CCMP1375
MNLLAADIGGTKTLLGVFRYEGQIKQLYKAKYSSEDWDNFDLMLKDFIANLPSNITTPKYACIGVAGAINNKIVKLTNLNWQISQESLCKTLNTDEVILLNDFSCLVYAIPYLQQKQYKYIQSLKTNLDYQKEGSIFAILGAGTGLGMARGIITKSGLKAIPSEGGHREFSPRNNKEWELCQWLKKDLKLTRLSIERVVSGTGLANIARWRLSQEDTKSHPILSIIEANNSHNFNNKLLPERVSIAAKGGDPIMREVLEMWLSAYGSAAGDLALQELSTEGLWIGGGTAIKHLDGLSSEIFLNSLKNKGRFSEYLEKLPIMVLIDPEAGLFGAACKAHLMTKSNVKIN

SEQ ID NO: 49984 - DNA, 1038 bp, Prochlorococcus marinus subsp. pastoris str. CCMP1986
  CDS (1)..(1038): transl_table=11
atgaattttcttgcttgtgatctaggaggtacaaaagttcttttaggaattttcaaaaaggaagttaatacttgtactccaattttaattttaaaaaaaaaatatttatcttctgaatgggattcaattgacacaattttagaagatttcttaaaaaatgaatgcaaaaacattaatcatcctttttctgcttgtttcgcggtagcaggtcccatatctaataataatgcggaaataattaatttatcgtggaatatttctggcgatgaattaaaaaagaaatttaaatttaaaaattgcgagctagtaaacgattttgcagtgcaaatttatggaataccttttttgaaaaaaagtcaatattctgctattcaaaatggagaccggtcagtaggcgtcaataaagatttacatgcaatcgttggagcaggaactggtctaggcattgcaaaaggcataatatctggaaataaagtaaaagttttagctagcgaaggtggtcatgttgaatactcgccaaagtcagatttagaatgggaattaaagaattggctcaaatattctttaaaagttgaaagaatatcttgtgaaagaatcataagtgggactgggttatcaagaatagctgagtggagacttagcaaacctgatgccaaaaaccatcctctacaaaaatacttaaaagaattaaaaacttctgataatttaagaaaagaacttcctcaagaaatttgtaatctttctaatctaggggataagatgatgattgaagtggaaagaatatggttagatgcttacgcctcattattgggtgacgttgctcttcaagaattatgttatggagggttatggatttctggaggaaccgctccaaaacatttcataaactttaaatcaggtttatttatgaaacaattttcagataaaggaagattaaaagatattcttaaaaatatacctgtgaatgtaatcttagatgaagagtttggattatttagcgcagcctgcagagcaaaaatgctttcacaaaaagaataa

SEQ ID NO: 49985 - protein, 345 aa, Prochlorococcus marinus subsp. pastoris str. CCMP1986
MNFLACDLGGTKVLLGIFKKEVNTCTPILILKKKYLSSEWDSIDTILEDFLKNECKNINHPFSACFAVAGPISNNNAEIINLSWNISGDELKKKFKFKNCELVNDFAVQIYGIPFLKKSQYSAIQNGDRSVGVNKDLHAIVGAGTGLGIAKGIISGNKVKVLASEGGHVEYSPKSDLEWELKNWLKYSLKVERISCERIISGTGLSRIAEWRLSKPDAKNHPLQKYLKELKTSDNLRKELPQEICNLSNLGDKMMIEVERIWLDAYASLLGDVALQELCYGGLWISGGTAPKHFINFKSGLFMKQFSDKGRLKDILKNIPVNVILDEEFGLFSAACRAKMLSQKE

SEQ ID NO: 49986 - DNA, 1062 bp, Prochlorococcus marinus str. MIT 9313
  CDS (1)..(1062): transl_table=11
atgccgtccccgagaacctttctggcaggtgatttggggggcaccaaaaccttgcttgcgctctatagctgggacgaaaagcaactcaagcaacagcaccggcggaggtatttatccaatcagtggacttcgcttgaacccatgctgagccacttcatcgcccatttgccaggggagatggagcaacccaataacggctgcatcgctgttgcaggatcggttcgccatggtgaggcacgtatcaccaatctgccctggagcctgaaggagaaggacctttgctcagccacgggactgaagcatttggaactgattaatgactttggcgtattgatctacggcctaccctttctcaacgacgcgcagcaggtggagcttcagcgtccacagcagcatttgtctgcacaaggacccattgcagttctgggggcaggtactggacttggaatggcccgtggcctgcccacaaaagatgggatggtggcgctgcccagtgaaggcggacaccgtgaatttgctcctcgcagtgaatgcgagtggcaactttgtgagtggctcaaggccgatttgcagctcgaacgcctttcattggaacgtgttgtcagtggaacgggcctgggacacgtggcgcgctggcgcctacagcacagtgacgcagatggtcatcctctgcgaggtctggccgatgcttggcgccatggtgctaatgatcattgcgaccatttggatctgcctgctcttgctagtcaagccgcaagcgaaggcgattcaattcttcaagaagccttacagctctggctcgctgcttacggctctgctgcgggagatttagctctgcaggaactctgtgtcggaggcctctgggtgggtgggggtaccgctgcgaagcagcttcaaggtcttcgctcaagcacctttcttgaagccttccgcaacaaggggcgcttccgtccgtttctagagcaattgccagtgatggcagtgatcgatcccgaggtgggcctgttcagtgcagcctgcagagcacacatgcttgctgagcaaggtgggacactgacctaa

SEQ ID NO: 49987 - protein, 353 aa, Prochlorococcus marinus str. MIT 9313
MPSPRTFLAGDLGGTKTLLALYSWDEKQLKQQHRRRYLSNQWTSLEPMLSHFIAHLPGEMEQPNNGCIAVAGSVRHGEARITNLPWSLKEKDLCSATGLKHLELINDFGVLIYGLPFLNDAQQVELQRPQQHLSAQGPIAVLGAGTGLGMARGLPTKDGMVALPSEGGHREFAPRSECEWQLCEWLKADLQLERLSLERVVSGTGLGHVARWRLQHSDADGHPLRGLADAWRHGANDHCDHLDLPALASQAASEGDSILQEALQLWLAAYGSAAGDLALQELCVGGLWVGGGTAAKQLQGLRSSTFLEAFRNKGRFRPFLEQLPVMAVIDPEVGLFSAACRAHMLAEQGGTLT

SEQ ID NO: 49988 - DNA, 1035 bp, Synechococcus sp. WH 8102
  CDS (1)..(1035): transl_table=11
atgccccgtcccactcttctcgctggcgacatgggggggaccaagacccttcttgcgctctacgacctcgagggtgaaacgctgatcaaacgtcaccagcaacggtttgtctcagctgattggtcatcgctggagccgatgcttcaggcgtttgttgaggaacggcccaaggacgtccaggcgccaacccatggctgcatcgccgtggcaggccctgttcgcaatcggcaggcccggatcaccaacctcccctggcagctcaaggaagaggatctggctgccgccgcagggatgcagcaactggagctggtgaacgatttcggtgtgctgatctacggcctgcctcacttcggcgcggatcagcaggtggtgctgcaggaggggagtcaggacgacgggcccctggccatccttggagctgggaccggcctcggcatggctcgaggcgttcgcaccagcaacgggctgatggctctctccagcgagggtggacatcgcgaattcgcaccgcgcagcgatgaggaatggcaactggcctgctggctcaaacaggacctgggagtcgaccgcctgtcgatcgagcgggtggtgagcggcacagggcttggccacatcgcccattggctgctgcagcagccaggcgcacaatcccacccccttcgtcctgtggctgaggcctggcggcgaaatatggccagtgaccttccagctcaggtgtctctcgcggccgaagagggggaccctctgatgcgacatgcccttgacctgtggctgtcggcctacggctcagccacaggtgacctggccctgcaggaactctgcagcggtggtctctgggtgggaggcggcacggcctcaaaacaacgcaacggactgcaatccccgctgttccttgaggcaatgcgcgacaaaggtcggttcaaggacttcatcagcggtctgaaggtcaccgctgtgatcgatccggaggctggtctgttcagctctgcctgccgagcacggatgttggcggagtcgggtgggacactggcctga

SEQ ID NO: 49989 - protein, 344 aa, Synechococcus sp. WH 8102
MPRPTLLAGDMGGTKTLLALYDLEGETLIKRHQQRFVSADWSSLEPMLQAFVEERPKDVQAPTHGCIAVAGPVRNRQARITNLPWQLKEEDLAAAAGMQQLELVNDFGVLIYGLPHFGADQQVVLQEGSQDDGPLAILGAGTGLGMARGVRTSNGLMALSSEGGHREFAPRSDEEWQLACWLKQDLGVDRLSIERVVSGTGLGHIAHWLLQQPGAQSHPLRPVAEAWRRNMASDLPAQVSLAAEEGDPLMRHALDLWLSAYGSATGDLALQELCSGGLWVGGGTASKQRNGLQSPLFLEAMRDKGRFKDFISGLKVTAVIDPEAGLFSSACRARMLAESGGTLA

SEQ ID NO: 49990 - DNA, 1014 bp, Chromobacterium violaceum ATCC 12472
  CDS (1)..(1014): transl_table=11
ctgctcggcgacgtcggcggcagcaacgcgcgcttcgcgctggaaaccgcgcccggggtgattgaagacatcctgacgctgtccaatgagcgctacccgacgctggaggacgcgctgcgcgactacctggcccaggtcggcgcgcgccgcgtcgcccacgccgccatcggcatcgccaatccgctgaacggcgacctggtgcggatgaccaattgccattggtcgttttccatcgaagcgacgcgccgcgcgctgggcctctccacgctgctgctgctcaacgacttcaccgcgctggcgctggccctgcccaggctgccgcgccgggagctggcccaggtgggcggcggcgcgccgcggccggacgcgccgctggcgctgatcggccccggcaccgggctgggcgtgtcggcgctggtgccgcacgccggcggctggcgcgcgctggccggcgagggcggccacacctcgttcgcgccggccaacgaacgcgaaatcggcatctggcgctacgcgtccgcccgcttcggccacgtgtcgcacgagcggctgctgtccggctccggcctcagcctgctgcaccgggcgctgtgcgcgctggacggggcggaagaggccggcctggcgccggccgaagtcagcgcccgcggcctgtccggcgccgacgcgcgctgccgcgaagcactggaaatcttctgcgcgctgctgggttcggcggccgggaatctggccttgaccctcggtgcccgtggcggggtgtacataggtggtggtattgtgccgcgtttgagcggtttttttgaacaatccccatttcgccgccgtttcgaggacaaggggcggatgtcggcctatctggccgacatcccggtttacctgatcaccagcgcctacccggccctgccgggcgtggccgcccatctggcggaccacctggcgccgcgcagcgacccggccccggtggcagcgcccacccatcctcgcggcggcacagcaggagacatgcatgcttga

SEQ ID NO: 49991 - protein, 337 aa, Chromobacterium violaceum ATCC 12472
MLGDVGGSNARFALETAPGVIEDILTLSNERYPTLEDALRDYLAQVGARRVAHAAIGIANPLNGDLVRMTNCHWSFSIEATRRALGLSTLLLLNDFTALALALPRLPRRELAQVGGGAPRPDAPLALIGPGTGLGVSALVPHAGGWRALAGEGGHTSFAPANEREIGIWRYASARFGHVSHERLLSGSGLSLLHRALCALDGAEEAGLAPAEVSARGLSGADARCREALEIFCALLGSAAGNLALTLGARGGVYIGGGIVPRLSGFFEQSPFRRRFEDKGRMSAYLADIPVYLITSAYPALPGVAAHLADHLAPRSDPAPVAAPTHPRGGTAGDMHA

SEQ ID NO: 49992 - DNA, 984 bp, Gloeobacter violaceus PCC 7421
  CDS (1)..(984): transl_table=11
atgattcttgcgggtgatgtgggcggaaccaacacgcggctggccggcttcgagccggtcgcgggcaacttgatgccgatcgtctccgagacctatgccagccgggattactccagtctcgaccaaatcgtctatctttttatttctgagtaccatctgcgggtcgccgccgcctgcttcggggtggcggggccggtcaggcggggccgggccgagacgaccaacctgccctggtcgatcgacgcctccaccctggctgccgggctcaagctgccgacggtgggactgattaacgatctggaggccaacgcccacggcattgcgctgctgggaccggcggattttgccgtactcaacccgggcgcggcggatgcgatgggcaaccaggcggtgatcgccgccggaacggggcttggggaggcgggtttgttttgggatggcaggcggcatcggccctttgccaccgagggcggccacaccgattttgcgcccggcgacgcgctgcagatcgagttgctgcaccatctgcgggtgcgctttgcccatgtgagctgggagcgggtgctctccggtccgggactggtgaatatctatcaatttctgcgggacacccggcgcggggaggaacccaactggctcaccgaggagcttcgcaaccatcccaacccggcggcggtcatctcgcaggtggcgctcgcgggcaagtcctggttgtgcgaacaggccctcgatttgctgattgtcctgtacggtgcagaggcgggcaatctcgccctgaaggtcgccgccctaggcggggtgtttttggggggcggcatcgcccccaaactggtggagcggctcaaaggaccggcatttttggaggcgtttcttgccaaggggcgtctgcgcccgcttttagaggcgatgccggtgcgcgtcatcctcaacgatcgggccgccctgcttggagcggcccactgcgccatgcaaactttgatctag

SEQ ID NO: 49993 - protein, 327 aa, Gloeobacter violaceus PCC 7421
MILAGDVGGTNTRLAGFEPVAGNLMPIVSETYASRDYSSLDQIVYLFISEYHLRVAAACFGVAGPVRRGRAETTNLPWSIDASTLAAGLKLPTVGLINDLEANAHGIALLGPADFAVLNPGAADAMGNQAVIAAGTGLGEAGLFWDGRRHRPFATEGGHTDFAPGDALQIELLHHLRVRFAHVSWERVLSGPGLVNIYQFLRDTRRGEEPNWLTEELRNHPNPAAVISQVALAGKSWLCEQALDLLIVLYGAEAGNLALKVAALGGVFLGGGIAPKLVERLKGPAFLEAFLAKGRLRPLLEAMPVRVILNDRAALLGAAHCAMQTLI

SEQ ID NO: 49994 - DNA, 1020 bp, Desulfovibrio vulgaris subsp. vulgaris str. Hildenborough
  CDS (1)..(1020): transl_table=11
atggagaagggctgccgtatccttgccgcagacatcggcgggacacgcagccgctttgcctacttcgactatgccggaggggagcttggcatgggcgatgtcgtccgcatccccacggcggaggctaccgggttcgacgacctgcttggcagggtgcgcgcagccgcgcccggtgcatgggcgcgactgacgcgacagactgacaccgggaatgatgctccggatacgcccgatgcaagcgtcaccgccttcgccgcctttgccgtggcagggcctgtcgaggagggggcgcgttgtctgcctcccaacatcggttggcatatcgacctcgccaccacgcgtggtttgccgtgtgcagcgtcgctgctcaacgatttcgaggcgcagggatgggcctgtctgctgcccggggcgcaacagtgccttcagctactgcccggaaagccggacgcgacggcacctgtggctgtcgtcggggcaggcacggggcttggcaaatgccttctgcttccgggcacgccgcacagggtgctgccctcggagggagggcacgccacgttcgccttcgaggggcgtgccgaggccgaatacgccgcctttgctgccgaccgccttggcgtgggacgactgattggcgatgacgtgctttccgggcccgggctgtctctgttgtacgcctatcatcacggcgagacgctacccccgcacgaggtggcggcacgtctcaccggaagtgacgtcgtcgtcgagtggttcgcgcgtttctacgggcgcacctgccgtgactgggcgttgcatacccttgccagaggcggtgtgcgcatcgcggggggagtggcggctgccaaccccatgctggtgcagcatggggccttcgccgaggcgttcttcgattgccccacgcacacgcacctcttgcgcaccatccccgtctcactggtcaccaatgccgacgccggcctatggggggcggccatctttgccctgcttcatgccgggacaaggagaacgccacgatga

SEQ ID NO: 49995 - protein, 339 aa, Desulfovibrio vulgaris subsp. vulgaris str. Hildenborough
MEKGCRILAADIGGTRSRFAYFDYAGGELGMGDVVRIPTAEATGFDDLLGRVRAAAPGAWARLTRQTDTGNDAPDTPDASVTAFAAFAVAGPVEEGARCLPPNIGWHIDLATTRGLPCAASLLNDFEAQGWACLLPGAQQCLQLLPGKPDATAPVAVVGAGTGLGKCLLLPGTPHRVLPSEGGHATFAFEGRAEAEYAAFAADRLGVGRLIGDDVLSGPGLSLLYAYHHGETLPPHEVAARLTGSDVVVEWFARFYGRTCRDWALHTLARGGVRIAGGVAAANPMLVQHGAFAEAFFDCPTHTHLLRTIPVSLVTNADAGLWGAAIFALLHAGTRRTPR

SEQ ID NO: 49996 - DNA, 999 bp, Desulfotalea psychrophila LSv54
  CDS (1)..(999): transl_table=11
atgatacttgccggtgatatcggtggtacaaaaacaaatctagcgctttacacctgttcatgtccggcgggtaatggctcattgatcgatagctcagcaaagacctatttgaatgcagatttcgccagcggcgaagagttggtgtgtggctatctggcaggcatcgacactacaattaaaagggcggtattcgctgtggccgggccgatacgggatgggcaggtaaaaatcaccaatctgccttggctgataagtgtagaacagttaagcgttgcgacgggtatcgcgacaattcacctgatgaacgatttggaggcgaccgcgtacgctgtgccttttctttcgcgggacgagttgtacaccctcaatcaggggatatcggtagagaggggaaatattgctcttattgccccggggacaggactgggggagtccttcctgacatgggaagggacgcgttatagtgcccatgccacagaggggagtcatgtcgatttcgcccccaccaatgcgcttcagataaaactgctggattatctgctcaggggctatgagcatgtgagctatgaacggatctgttcgggaataggaattcccaatatctatggctttttgaaacacagccagaacattgaggagccggaatggctacgcgagcaactctcacaggagaaagaccacaccgctgtgatagtcaatgccgctctcgatgctcaacggccatgccccatctgcaggatgacagttgaaatttttctctcagttctcggtgcggaggcggggaatatcgctctgaaagttatggcggctggcggtgtgtatgtgggaggaggtattgttccccgcattctgtctttgttaggaaacggcctcttcatggaaacctttaacagtaaggggcgaatgtccgaactcctggtcgacgttccggtacatataattctcaatcctaaagttgcggtttttggcgctgcgcgttacgggatggaaatttgttga

SEQ ID NO: 49997 - protein, 332 aa, Desulfotalea psychrophila LSv54
MILAGDIGGTKTNLALYTCSCPAGNGSLIDSSAKTYLNADFASGEELVCGYLAGIDTTIKRAVFAVAGPIRDGQVKITNLPWLISVEQLSVATGIATIHLMNDLEATAYAVPFLSRDELYTLNQGISVERGNIALIAPGTGLGESFLTWEGTRYSAHATEGSHVDFAPTNALQIKLLDYLLRGYEHVSYERICSGIGIPNIYGFLKHSQNIEEPEWLREQLSQEKDHTAVIVNAALDAQRPCPICRMTVEIFLSVLGAEAGNIALKVMAAGGVYVGGGIVPRILSLLGNGLFMETFNSKGRMSELLVDVPVHIILNPKVAVFGAARYGMEIC

SEQ ID NO: 49998 - DNA, 1926 bp, Burkholderia mallei ATCC 23344
  CDS (1)..(1926): transl_table=11
atgtctactggtgcgcaaactaaggccgccgcggcgagccagcacgcggacgggccgcgcctattggccgacgtcggcggcacgaacgcgcgcttcgcgctcgagacgggcccgggagaaatcacgcagatccgcgtgtacccgggcgccgagtatccgacgctcaccgacgcgatccgcaagtatctgaaggacgcgaagatcggccgcgtgaatcacgcggcgatcgcgatcgcgaaccccgtcgacggcgatcaggtccggatgacgaatcacaactggagcttctcgatcgaggcgacgcgccgcgcgctcggcttcgatacgctgctcgtcgtcaacgatttcaccgcgctcgcgatggcgctgcccggcctgaccgatgcgcagcgcgtacagatcggcggcggcacgcgccgacagaacagcgtgatcggcctgatggggccgggcacggggctcggcgtgtcggggctcattcccgccgacgaccgctggatcgcgctcggcagcgaaggcggccacgcgacgttcgcgccgatggacgagcgcgaggatctcgtgctgcaatacgcgcgccgcaagtatcctcacgtgtcgttcgagcgcgtatgcgcgggcccgggcatggagatcatctatcgcgcgctcgccgcgcgcgacaagaagcgtatcgccgcgaacgtcgacacggccgacatcgtcgagcgcgcgcacgcgggcgatgcgctcgcgctcgaggcggtcgagtgcttctgcgcgattctcggcacgttcgccggcaacctcgcggtcacgctcggcgcgttgggcggcatctatatcggcggcggcgtcgtgccgaagctcggcgagctgttcatgcgctcgccgtttcgcgcgcgcttcgaggcgaagggccgcttcgaggcgtatctcgcgaacatcccgacctacctgatcaccgcggaatacccggcgtttctcggcgtatcggcgatcctcgccgagcaactgtcgaaccgcacgggcggcgcgtcgtcggccgtgttcgagcgcatccgccagatgcgcgacgcgttgacgcccgccgagcggcgcgtcgccgatctcgcgctcaaccatccgcgctcgatcatcaacgatccgatcgtcaacatcgcgcgcaaggccgacgtgagccagcccaccgtgatccgcttctgccgctcgctcggctgccaggggctgtcggacttcaagctgaagctcgcgacgggcctcaccggcacgatcccgatgagccacagccaggtgcatctgggcgacaccgcgaccgatttcggcgcgaaggtgctcgacaacacggtatcggcgatccttcagttgcgcgagcatctgaacttcgagcacgtcgagcaggcgatcgacatcctgaacaatgcgcggcgcatcgagttctacggcctgggcaattcgaacatcgtcgcgcaggacgcgcactacaagttcttccgcttcgggattccgacgatcgcgtacggcgacctgtacatgcaggcggcgtcggccgcgctcctcggcaagggcgacgtgatcgtcgcggtgtcgaagtcggggcgcgcgccggagctgttgcgcgtgctcgacgtcgcgatgcaggcgggcgcgaaggtgatcgcgatcacgtcgagcaacacgccgctcgccaagcgcgcgacggtcgcgctcgagaccgatcacatcgagatgcgcgagtcgcagttgtcgatgatctcgcggatcctgcatctcgtgatgatcgacatcctcgcggtcggcgtcgcgatccgccgcgccgcgccgaacgcggagctcgcggaggcgatggcgcgcgcgaaggcgcgcgcgggcgcgagcgcgggcgacgaggccgccgacgtgctcgactggctgagccacggcgcggcgcccgcggcgaaggactga

SEQ ID NO: 49999 - protein, 641 aa, Burkholderia mallei ATCC 23344
MSTGAQTKAAAASQHADGPRLLADVGGTNARFALETGPGEITQIRVYPGAEYPTLTDAIRKYLKDAKIGRVNHAAIAIANPVDGDQVRMTNHNWSFSIEATRRALGFDTLLVVNDFTALAMALPGLTDAQRVQIGGGTRRQNSVIGLMGPGTGLGVSGLIPADDRWIALGSEGGHATFAPMDEREDLVLQYARRKYPHVSFERVCAGPGMEIIYRALAARDKKRIAANVDTADIVERAHAGDALALEAVECFCAILGTFAGNLAVTLGALGGIYIGGGVVPKLGELFMRSPFRARFEAKGRFEAYLANIPTYLITAEYPAFLGVSAILAEQLSNRTGGASSAVFERIRQMRDALTPAERRVADLALNHPRSIINDPIVNIARKADVSQPTVIRFCRSLGCQGLSDFKLKLATGLTGTIPMSHSQVHLGDTATDFGAKVLDNTVSAILQLREHLNFEHVEQAIDILNNARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRAAPNAELAEAMARAKARAGASAGDEAADVLDWLSHGAAPAAKD

SEQ ID NO: 50000 - DNA, 1926 bp, Burkholderia pseudomallei K96243
  CDS (1)..(1926): transl_table=11
atgtctactggtgcgcaaactaaggccgccgcggcgagccagcacgcggacgggccgcgcctattggccgacgtcggcggcacgaacgcgcgcttcgcgctcgagacgggcccgggagaaatcacgcagatccgcgtgtacccgggcgccgagtatccgacgctcaccgacgcgatccgcaagtacctgaaggacgcgaaaatcggccgcgtgaatcacgcggcgatcgcgatcgcgaaccccgtcgacggcgatcaggtccggatgacgaatcacaactggagcttctcgatcgaggcgacgcgccgcgcgctcggcttcgatacgctgctcgtcgtcaacgatttcaccgcgctcgcgatggcgctgcccggcctgaccgatgcgcagcgcgtgcagatcggcggcggcgcgcgccggcagaacagcgtgatcggcctgatggggccgggcacggggctcggcgtgtcggggctcattcccgccgacgaccgctggatcgcgctcggcagcgaaggcggccacgcgacgttcgcgccgatggacgagcgcgaggatctcgtgctgcagtacgcgcgccgcaagtatcctcacgtgtcgttcgagcgcgtgtgcgcgggcccgggcatggagatcatctatcgcgcgctcgccgcgcgcgacaagaagcgcatcgccgcgaacgtcgacacggccgacatcgtcgagcgcgcgcacgcgggcgatgcgctcgcgctcgaggcggtcgagtgcttctgcgcgattctcggcacgttcgccggcaacctcgcggtcacgctcggcgcgttgggcggcatctatatcggcggcggcgtcgtgccgaagctcggcgagctgttcatgcgctcgccgtttcgcgcgcgcttcgaggcgaagggccgcttcgaggcgtatctcgcgaacatcccgacctacctgatcaccgcggaatacccggcgtttctcggcgtatcggcgatcctcgccgagcaactgtcgaaccgcacgggcggcgcgtcgtcggccgtgttcgagcgcatccgccagatgcgcgacgcgttgacgcccgccgagcggcgcgtcgccgatctcgcgctcaaccatccgcgctcgatcatcaacgatccgatcgtcgacatcgcgcgcaaggccgacgtgagccagcccaccgtgatccgcttctgccgctcgctcggctgccaggggctgtcggacttcaagctgaagctcgcgacgggcctcaccggcacgatcccgatgagccacagccaggtgcatctgggcgacaccgcgaccgatttcggcgcgaaggtgctcgacaacacggtatcggcgatccttcagttgcgcgagcatctgaacttcgagcacgtcgagcaggcgatcgacatcctgaacaatgcgcggcgcatcgagttctacggcctgggcaattcgaacatcgtcgcgcaggacgcgcactacaagttcttccgcttcgggattccgacgatcgcgtacggcgacctgtacatgcaggcggcgtcggccgcgctcctcggcaagggcgacgtgatcgtcgcggtgtcgaagtcggggcgcgcgccggagctgttgcgcgtgctcgacgtcgcgatgcaggcgggcgcgaaggtgatcgcgatcacgtcgagcaacacgccgctcgccaagcgcgcgacggtcgcgctcgagaccgatcacatcgagatgcgcgagtcgcagttgtcgatgatctcgcggatcctgcatctcgtgatgatcgacatcctcgcggtcggcgtcgcgatccgccgcgccgcgccgaacgcggagctcgcggaggcgatggcgcgcgcgaaggcgcgcgcgggcgcgagcgcgggcgacgaggccgccgacgtgctcgactggctgagccacggcgcggcgcccgcggcgaaggactga

SEQ ID NO: 50001 - protein, 641 aa, Burkholderia pseudomallei K96243
MSTGAQTKAAAASQHADGPRLLADVGGTNARFALETGPGEITQIRVYPGAEYPTLTDAIRKYLKDAKIGRVNHAAIAIANPVDGDQVRMTNHNWSFSIEATRRALGFDTLLVVNDFTALAMALPGLTDAQRVQIGGGARRQNSVIGLMGPGTGLGVSGLIPADDRWIALGSEGGHATFAPMDEREDLVLQYARRKYPHVSFERVCAGPGMEIIYRALAARDKKRIAANVDTADIVERAHAGDALALEAVECFCAILGTFAGNLAVTLGALGGIYIGGGVVPKLGELFMRSPFRARFEAKGRFEAYLANIPTYLITAEYPAFLGVSAILAEQLSNRTGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVEQAIDILNNARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRAAPNAELAEAMARAKARAGASAGDEAADVLDWLSHGAAPAAKD

SEQ ID NO: 50002 - DNA, 993 bp, Methylococcus capsulatus str. Bath
  CDS (1)..(993): transl_table=11
gtgctgctggcgggggacgtcggcgctaccaagacggtcctcgggctgttcgactgctggggcgacaggctggtcagtctgagcgaggcgattttcgccagcacggactatgcctcgctggagacggtggtggcggcgttcctggatgggcaggaggaacggaggcccgaagtcgcctgtttcggggtgccgggaccggtgagcgaaggccgctgcgaaatcaccaacctgccgtgggttctgtccgagcgggaacttgcggcggcgacgggggtgagtgcagtgcgcctgctgaacgacgtccaggccatggccctgggcatggcttaccggttgggcgaggacgattgggtggagctgaaccccggcgccggccgtccgcgatccggaaacgtcgcggtgatcgccgcggggacgggattgggcgaggccatcctgtattgggatggcgagcgctaccatgcgctgccgaccgaaggcggacacagcgatttcgcccccaacggaccgctggaagaagggttgctcgccttcctgcgggatcgcttctgcgggcatgtcagctacgagcggatactgtctggttcggggctggccaatctctacgactatctgcgtcacgccggcgtggcgccggaaagcgaggcactgcacgccgccctggccagcgctcccgaccgtgccccgatcatcgccgagtgggcactggaacggcgtgacgccctttgcaccgcggtgctcgatctcttcgcggcaatctacggggcggaagccgggaatctggccctcaagtcgctcgcgctcggtggcgtgatcctgggcgggggtatcgcgccgaaaatccttccggtcctgcaggcggggaggttcatggccgctttcacggcaaagggaaggctgtcccccctcctggggcggcttcccgtgcgggtcgccatccatccccagccggccctgctgggggcggcgcatgccgcctcggccatgctttga

SEQ ID NO: 50003 - protein, 330 aa, Methylococcus capsulatus str. Bath
MLLAGDVGATKTVLGLFDCWGDRLVSLSEAIFASTDYASLETVVAAFLDGQEERRPEVACFGVPGPVSEGRCEITNLPWVLSERELAAATGVSAVRLLNDVQAMALGMAYRLGEDDWVELNPGAGRPRSGNVAVIAAGTGLGEAILYWDGERYHALPTEGGHSDFAPNGPLEEGLLAFLRDRFCGHVSYERILSGSGLANLYDYLRHAGVAPESEALHAALASAPDRAPIIAEWALERRDALCTAVLDLFAAIYGAEAGNLALKSLALGGVILGGGIAPKILPVLQAGRFMAAFTAKGRLSPLLGRLPVRVAIHPQPALLGAAHAASAML

SEQ ID NO: 50004 - DNA, 1008 bp, Legionella pneumophila str. Lens
  CDS (1)..(1008): transl_table=11
atgaatttttttatgatgcctcatgatttagcgcagtatgctattgttgcggacataggcggtacttttgctcgtttcagtagagttaatcttgtcaatttgcagatggataaaattgaagtttctccttgtgccgagtttattagtcttgagtccgcgctattaacttataaaaaccggcattctttacaagaaataaaacatattgcaatagcgattgcgtgtccggtcatcgatgatttggtttctatgacgaattgtcattggcaattttcaataacagagttaaaacagagacttggccttgaagttctggaagtcatgaatgattttactgcgattgcgatgagtttacctgtattatcgactcaggatctggtgcagattggtaatggttacctggatgccagtaaagtgaaagtggtgttaggcgcagggaccggtttgggtgttgcttatttaattcctcatcaacatcactatagtgcttttgcaggggaaggggggcatgctgattggggagcaaaaactgagcaggaatggtttatctatcgttatttaaaaagtaaatactcccatgtatcttatgagcgcttgctgtctggccaaggactggaaaatttatatcaagctttagccgcgtatcatagtaaaaaagttgaatttttgtcagcagcgcaaattatatctttagcattaaatcaggaatgtttcatagctcataaggcagtagcccaatttttttcaagtttgggatcgtttgctggtgatttagcattaacttatggagcttttggtggtgtttatattgcaggagggattatgccgcgtttgctctccttggtacaccaaagcgactttagaatccaatttgaagacaaaggacgatttagtgattttaatgccttaattcccacttatgtcattgcagcctctcaaccaggtattttaggcgcgagcgtcagtttaaaacaaatattgacaggagcttctcatgtccatttctga

SEQ ID NO: 50005 - protein, 335 aa, Legionella pneumophila str. Lens
MNFFMMPHDLAQYAIVADIGGTFARFSRVNLVNLQMDKIEVSPCAEFISLESALLTYKNRHSLQEIKHIAIAIACPVIDDLVSMTNCHWQFSITELKQRLGLEVLEVMNDFTAIAMSLPVLSTQDLVQIGNGYLDASKVKVVLGAGTGLGVAYLIPHQHHYSAFAGEGGHADWGAKTEQEWFIYRYLKSKYSHVSYERLLSGQGLENLYQALAAYHSKKVEFLSAAQIISLALNQECFIAHKAVAQFFSSLGSFAGDLALTYGAFGGVYIAGGIMPRLLSLVHQSDFRIQFEDKGRFSDFNALIPTYVIAASQPGILGASVSLKQILTGASHVHF

SEQ ID NO: 50006 - DNA, 996 bp, Azoarcus sp. EbN1
  CDS (1)..(996): transl_table=11
atgcccactggctgctccgacacctacccccggctgatcggcgacatcggcggcacgcacgcccgctttgccgtcatcgactcgccgggcagcccgccgacgcgctttcgcacgctgtgctgtgacgatcacgccggactcctggaggccgtccaggcttacctgctgctggaacggggacttgccgggccgcgtgtcgccgcgttcggcatcgcgaatcccgtcgagggcgatcgggtacggatgacgaatcacgactggtcgttttcgatcgagcagctgcgcatcgagctcgggctcgcgcggctcgtggtcctcaacgacttcaccgcgctcgcgctgtcgctgccccgactgcaggccggtgaacggcgtcagatcggcggcggcaacgagtgcgccgggcggccggtcgcgctgatcggaccgggcaccggtctcggcgtgtcggggctggtgcgctgcggcaacggctacgcgccgctcgaaggcgaaggcggccacgtcacgctggcggcgtccacgccacgcgaagcggagctcatcgcagtgctcgccgcgcgcttcgaccacgtgtcggccgagcgggcgctgtcgggaccggggctgatcgccctgcacgacgcgatccggcagctcgcgggcgccccgccgctggccctcgaagcggacgagatcagcgcccgggcgatggccgcgagctgtccatggtgcgccgaggcgctgcaggtcttctgcgggatgctcggcagcgtcgccggcgacctcgcgctgacgctgggcgcattcggcggcgtgtatatcggggggggaatcgtgccgaagctcggcgacttcttcgatcgatcggatttccgccggcgcttcgaacagaaaggacggttttccgaatacctcgcgcgcatcccctgttacgtcatcctcgccgaatatcctgcgctgctcggcgccgcgacggcgctcgacaacgcgctcgccggcgaaacgggcacctga

SEQ ID NO: 50007 - protein, 331 aa, Azoarcus sp. EbN1
MPTGCSDTYPRLIGDIGGTHARFAVIDSPGSPPTRFRTLCCDDHAGLLEAVQAYLLLERGLAGPRVAAFGIANPVEGDRVRMTNHDWSFSIEQLRIELGLARLVVLNDFTALALSLPRLQAGERRQIGGGNECAGRPVALIGPGTGLGVSGLVRCGNGYAPLEGEGGHVTLAASTPREAELIAVLAARFDHVSAERALSGPGLIALHDAIRQLAGAPPLALEADEISARAMAASCPWCAEALQVFCGMLGSVAGDLALTLGAFGGVYIGGGIVPKLGDFFDRSDFRRRFEQKGRFSEYLARIPCYVILAEYPALLGAATALDNALAGETGT

SEQ ID NO: 50008 - DNA, 924 bp, Silicibacter pomeroyi DSS-3
  CDS (1)..(924): transl_table=11
atgaccgtcctggtggcagatgtggggggcaccaatacccgcgtcgcgctggccagcgccgggcagctggtgcatctggcccggttcgccaacgatgcctatggctctttcgccgaggtgctgacggcctatgcgcggggcagggacctgccgggtctgcgcggcgtctgtgtcgcggtggcgggcccggtggcgaatgggcgcgccgagctgaccaaccggaactggcatttcgatacggcagagctggccgcgccgctgccagggcagggcgatgttgcggcgcggctgatcaacgatctggtggcgctgggccatgccttgccggggctgacggcagcgcagcttgacgtgatccgcgcgggcgccgtacagccttcgaacgatcaggcgctggtggccgggctgggcaccggtttcaacacctgcctgctcaagggtggcgcggtggtcgaggcggaactgggccatgccagcctgccgctggccatcgccgaggaactgcgcgcgcagcttggcgacgcggcgggcgggtttcgcaccaacgaatgcctgttctcgggccggggcctgtcgcggctgcatgccatcctgtccggtcaggaccggcgcggacaggacatcctggcggattatgcaattggcgaggacccgcaggccgccgccacggtgactctgaccgcgcggctcttgggtctgttcgcccgcgaactggtgtttcagtacctgccgtttcgcggcatccactttgccggcggggccgcgcgcggcatcctcggctcggcggcgcgcgccgaattcctgtcggccttcgaggccgatgggcggtttgccgaccatctggaccgggtaccggtgcggctgatcgccgacgatgccgcagcgctcagcggcgcagcgcgactgatggaggaatgcgcatga

SEQ ID NO: 50009 - protein, 307 aa, Silicibacter pomeroyi DSS-3
MTVLVADVGGTNTRVALASAGQLVHLARFANDAYGSFAEVLTAYARGRDLPGLRGVCVAVAGPVANGRAELTNRNWHFDTAELAAPLPGQGDVAARLINDLVALGHALPGLTAAQLDVIRAGAVQPSNDQALVAGLGTGFNTCLLKGGAVVEAELGHASLPLAIAEELRAQLGDAAGGFRTNECLFSGRGLSRLHAILSGQDRRGQDILADYAIGEDPQAAATVTLTARLLGLFARELVFQYLPFRGIHFAGGAARGILGSAARAEFLSAFEADGRFADHLDRVPVRLIADDAAALSGAARLMEECA

SEQ ID NO: 50010 - DNA, 1038 bp, Synechococcus elongatus PCC 6301
  CDS (1)..(1038): transl_table=11
atgaccttgctattggccggggatatcggcggaaccaaaacgaatttaatgttggcgatcgcctctgattgcgatcgtttagaaccgctccatcaggccagttttgccagtgcggcctaccctgatttagtgccgatggtgcaggagtttttggctgccgcaccctccgccgaggtgcgatcgccagttgtggcttgttttggcattgccggccccgttgtccatggaaccgcgaagctgacgaacctgccttggcagctctctgaagcgcggctggcgaaggaattgggcattgcgcaggtggcgttgatcaatgattttgctgcgatcgcctacggcctacccggcttgaccgccgaagatcaagtcgttgtgcaagtcggtgaagccgatccggcggctccgatcgccattctgggggcaggaactggcttgggcgaaggcttcatcattcccacagcccaaggccgccaagtgtttggcagcgaaggttctcacgctgactttgcgccgcaaaccgaactggagtccgagttactgcattttctacgcaatttttacgcaatcgagcatatctcggtcgagcgagtggtctccggccaagggattgcagccatctacgccttcctgcgcgatcgccatcccgaccaagaaaatccagcccttggggcgattgcctcggcttggcaaacgggcggcgaccaagcccctgatctggcagcagccgtatcccaagcagccttgagcgatcgcgatccgctggccctacaagccatgcagatatttgtcagtgcttacggggcggaagccggcaacctcgcgttgaaattgctctcctacggcggggtctacgtcgccggcgggattgcgggcaaaatcctgccgctcttgactgatggcacttttctgcaagccttccaagccaagggacgggtgaaggggctgctgacgcggatgcctatcacgatcgtcacgaaccacgaagtcgggctgatcggggctggactgcgggcggctgcgatcgctactcaaccatga

SEQ ID NO: 50011 - protein, 345 aa, Synechococcus elongatus PCC 6301
MTLLLAGDIGGTKTNLMLAIASDCDRLEPLHQASFASAAYPDLVPMVQEFLAAAPSAEVRSPVVACFGIAGPVVHGTAKLTNLPWQLSEARLAKELGIAQVALINDFAAIAYGLPGLTAEDQVVVQVGEADPAAPIAILGAGTGLGEGFIIPTAQGRQVFGSEGSHADFAPQTELESELLHFLRNFYAIEHISVERVVSGQGIAAIYAFLRDRHPDQENPALGAIASAWQTGGDQAPDLAAAVSQAALSDRDPLALQAMQIFVSAYGAEAGNLALKLLSYGGVYVAGGIAGKILPLLTDGTFLQAFQAKGRVKGLLTRMPITIVTNHEVGLIGAGLRAAAIATQP

SEQ ID NO: 50012 - DNA, 969 bp, Gluconobacter oxydans 621H
  CDS (1)..(969): transl_table=11
atgagggaaatcgtagccgtcgatatcggtggaacgcacgcacggtttgcaatcgcgaccatcgaggatggcaaggtcgtctcactgggtgaggccacgacgctgaaatgcgcggaacatggcagtctggccttggcctgggaaacattcggccgttccctgaaccggacgcttccacgcgaagccggcattgccgtagcctgtccggtaagcggcgagatcctcaagctgaccaacaatccttggatcatccagccgagccagctcggcgcgcgcctgcatctcgacaatttcgtactcgtcaacgatttcggagccgtggctcacgccgtagcccaggtcgattcctcgcacatgaaacatctctgcggaccggacatcgaccttccgacggaaggcgccatcacgatcgtcggcccgggcacaggactgggtgcagcctgcctgcttcgccgcagtgaccgctattttgtcatggaaaccgaaggcggccatctggactatccgccgctcgacgaactcgaagacaagatcctcagcgccctgcgtctgcgttttcgccgcgtctctgccgagcggatcgtctccggaccgggcctgaccaatctgtacgaagtcattgccgagatgcagggctggcccatcaccctgcgtgataaccgcaccttgtggaaaaacgccctcgatggctccgatacggtcgccgtggctgccctggaacgcttctgcctcagcctgggcgccatttccggcgatctggcgctggcacatggcgcacgcggcgtcgtcatcggtggtggtctgggactgcgtctcgccgacagcctcggccattccggattcgccgaacgcttcgtcgcaaagggccgcttcgaggcgatgatgaccgaaatgccggtcaagatcatcacacatccacagcccggcctgttcggcgctgcggcagcatacgcggaagcgcatccgtaa

SEQ ID NO: 50013 - protein, 322 aa, Gluconobacter oxydans 621H
MREIVAVDIGGTHARFAIATIEDGKVVSLGEATTLKCAEHGSLALAWETFGRSLNRTLPREAGIAVACPVSGEILKLTNNPWIIQPSQLGARLHLDNFVLVNDFGAVAHAVAQVDSSHMKHLCGPDIDLPTEGAITIVGPGTGLGAACLLRRSDRYFVMETEGGHLDYPPLDELEDKILSALRLRFRRVSAERIVSGPGLTNLYEVIAEMQGWPITLRDNRTLWKNALDGSDTVAVAALERFCLSLGAISGDLALAHGARGVVIGGGLGLRLADSLGHSGFAERFVAKGRFEAMMTEMPVKIITHPQPGLFGAAAAYAEAHP

SEQ ID NO: 50014 - DNA, 1101 bp, Xanthomonas oryzae pv. oryzae KACC10331
  CDS (1)..(1101): transl_table=11
ttgctgacaacgttgtctaccccgtttgccgttcgtcggacaacgggcgacgacgccaggcgtcgccacagatcaggagaatgcgtgagcgcaagcagtccaatggaagcggtggcctttccgcgccccgaaaccttcgttgccgccgatgtgggcgggacgcacgtgcgcctggcgctggtgtgcgaaagcaatgacgcaggcaagccagtcactgtgctggactatcgcaagtaccgttgcgccgagtatccgggtcttgccgagatcatggccgccttcttcgcggaggtgggctgcgcgccggtgcgccgtggcgtgatcgccagcgccggttacgcattggacgacggcagcgtgatcaccgccaatctgccctgggtgctggcccccgaacagattcgccgccagctgggcatgcaggccttgtatctggtcaacgatttcgaagcggtcgcctacgcggccaattacatgagcggcaaccaggtcatgcagttgtcgggccccgcgcaaggcgccgcgggcccggcgttggtgctcggtccggggacgggcctgggtgcggcgctgtggattccccacggtgcccacccggtagtgctgccgaccgaggctggccacgcggccctggcacctgccagcgatctggaagtggaactgctgcaggaactgcggcgcacgcgtacccacgtgtgcaccgagacgctgttgtccggcccgggcctgttgaatctgtacaccgcgctgggcgcactgcgcggcgacgctgtgctgcatgccaaccccgccgagatcaccgctgccgcattggctggcaacgatgcactggcgcacgatgccttgcaggcgttctgcgggttcatgggcagcgtggtcggcgacctgatgctgctgtatggcgtgcgtagcggtgtctatctggctggcggcttcctgccgcagatcgccggctttatcgctgaaagcgatttcgtcgcacgcctgctcgacaagggcgcgttgcgtccggcgctggaacaggtgccggtgagcatcgtcgagcacggccagctcggcgtcatcggtgcggccagctggtttctgctgcacggccgctga

SEQ ID NO: 50015 - protein, 366 aa, Xanthomonas oryzae pv. oryzae KACC10331
MLTTLSTPFAVRRTTGDDARRRHRSGECVSASSPMEAVAFPRPETFVAADVGGTHVRLALVCESNDAGKPVTVLDYRKYRCAEYPGLAEIMAAFFAEVGCAPVRRGVIASAGYALDDGSVITANLPWVLAPEQIRRQLGMQALYLVNDFEAVAYAANYMSGNQVMQLSGPAQGAAGPALVLGPGTGLGAALWIPHGAHPVVLPTEAGHAALAPASDLEVELLQELRRTRTHVCTETLLSGPGLLNLYTALGALRGDAVLHANPAEITAAALAGNDALAHDALQAFCGFMGSVVGDLMLLYGVRSGVYLAGGFLPQIAGFIAESDFVARLLDKGALRPALEQVPVSIVEHGQLGVIGAASWFLLHGR

SEQ ID NO: 50016 - DNA, 987 bp, Neisseria gonorrhoeae FA 1090
  CDS (1)..(987): transl_table=11
atgtcttctacgccgaataaacacgccgattacccgaggctggttgccgacatcggcggcacaaacgcccgtttcgcattggaaaccgcgccgtgcgtgattgagaaagtcgccgtcctgccgtgtaaggaatacgacacggttaccgacgcggtgcgtgcctatctgaaccaaagtggtgcaacgggcgtacggcacgcggcatttgccatcgccaacccgattttgggcgactgggtgcagatgaccaaccaccattgggcgttttccatcgaaaccacccgtcaggctttggggctggacaccctcatccttttgaacgactttaccgcgcaggcattggcggtaacgcagacttcaagcaaagacctgatgcaggtaggcgggcaaaagcctgtcgaattcgcccccaaggccgttatcggccccggtaccggcttgggcgtgagcggattggtgcacagccccgcaggctgggtggcgttggcgggcgagggcgggcataccagtttcccgccgtttgacgatatggaagtgttgatttggcagtacgccaaaaacaaataccgccacgtttccgccgaacgtttcctcagcggcgcaggtttgagcctgatttatgaaacgctggcggtcaagcagaaagccgaaccggcaaaactgatgccgtctgaaattaccgaaaaggcattaaattgcgaatcgcccctgtgccggcaggcattggacattttctgcgcgatgctgggcacggtcgcttccaacctcgccctgactttgggcgcgcgcgggggcgtgtatttgtgcggcggcattatcccgcgaatgttggattacttcaaaacctcccccttccgcagccgctttgaaaacaaagggcgttttgaagcctaccttgccgcgattcccgtttatgtcgtcttgagcgaatttccgggtattgccggcgcggcggcggcgctcggcaaccacctgaaaaacgtctaa

SEQ ID NO: 50017 - protein, 328 aa, Neisseria gonorrhoeae FA 1090
MSSTPNKHADYPRLVADIGGTNARFALETAPCVIEKVAVLPCKEYDTVTDAVRAYLNQSGATGVRHAAFAIANPILGDWVQMTNHHWAFSIETTRQALGLDTLILLNDFTAQALAVTQTSSKDLMQVGGQKPVEFAPKAVIGPGTGLGVSGLVHSPAGWVALAGEGGHTSFPPFDDMEVLIWQYAKNKYRHVSAERFLSGAGLSLIYETLAVKQKAEPAKLMPSEITEKALNCESPLCRQALDIFCAMLGTVASNLALTLGARGGVYLCGGIIPRMLDYFKTSPFRSRFENKGRFEAYLAAIPVYVVLSEFPGIAGAAAALGNHLKNV

SEQ ID NO: 50018 - DNA, 966 bp, Salmonella enterica subsp. enterica serovar Choleraesuis str
  CDS (1)..(966): transl_table=11
atgacaaagtatgctttagtaggagatgtaggcggcacgaatgcgcgtcttgccctgtgtgatatcgccagtggagaaatctcgcaggccaaaacgtattccggcctggattatcccagtcttgaggccgtggtgcgcgtttatctcgatgagcatagcgtcagcgtggaagatggttgtatcgccatagcctgcccgattaccggtgactgggtagcgatgactaaccatacctgggctttttctattgcggaaatgaaaaaaaatctcggctttagccatctggaaatcatcaacgatttcaccgccgtgtcgatggcgatcccgatgctgaaaaaagagcatttaattcagttcggcggcggcgaaccggtagacggcaaacctattgcggtgtatggcgcgggaaccggcttgggcgtggcgcatctggtgcatgtggataagcgttggattagccttccgggcgaaggcgggcatgtcgattttgcgcctaatagcgaagaagaagctatgattctggaaatattgcgcgccgaaattggccacgtttccgccgagcgcgtgctgtctggcccggggctggtgaatctttaccgggcgattgttaagtccgacaaccgtttgccggagaatctgcgcccgaaagatattaccgaacgcgccctggcggataactgtatcgattgtcgccgcgcgttgtcgctcttttgcgtcatcatggggcgatttggcggcgatctggcgttaaccatggggacatttggcggcgtttatatcgctggcggtattgtcccgcgcttcctggaattttttaaagcgtctggcttccgtgggggctttgaagataaaggccgctttaaagattatgtacacggtattccggtctatctgattgtccatgataaccccggcttgttaggctccggcgcgcatctgcgccagacattaggtcatattctataa

SEQ ID NO: 50019 - protein, 321 aa, Salmonella enterica subsp. enterica serovar Choleraesuis str
MTKYALVGDVGGTNARLALCDIASGEISQAKTYSGLDYPSLEAVVRVYLDEHSVSVEDGCIAIACPITGDWVAMTNHTWAFSIAEMKKNLGFSHLEIINDFTAVSMAIPMLKKEHLIQFGGGEPVDGKPIAVYGAGTGLGVAHLVHVDKRWISLPGEGGHVDFAPNSEEEAMILEILRAEIGHVSAERVLSGPGLVNLYRAIVKSDNRLPENLRPKDITERALADNCIDCRRALSLFCVIMGRFGGDLALTMGTFGGVYIAGGIVPRFLEFFKASGFRGGFEDKGRFKDYVHGIPVYLIVHDNPGLLGSGAHLRQTLGHIL

SEQ ID NO: 50020 - DNA, 966 bp, Pseudomonas syringae pv. syringae B728a
  CDS (1)..(966)
atgaagttggccctggtcggtgatataggcggtaccaatgcacgttttgccatttgggaaaacagcacgctgcattctgtccgggtattcccgaccattgactacgcgggtccggagaaggccatcgaagtctatctgcaagacctggagctgcagcgcggcgatatcggtcatgtatgcctggcggtcgccggaccggtcgacggtgatttttttcagttcaccaacagccactggcaattgagccgcgaggcgttctgcgccgacctgcaggtcgatgaactgctgttgatcaacgacttcaccgccatggcgctgggcatgacccggctcaaggacgatgaatacctgacggtctgccacggtgtcggcaagcctgaccgcccgcgcgtggtggtggggccggggaccgggctgggcgtcggtacgctgatcaaactcgaaggcagtcgctggatggcgttgccgggcgagggcgggcatgccgatctgcccatcgggactgcgcgcgaggcgctgctgtggacacggctgatggccgagcacgagcatgtcagcgccgaggtcgttctcagcggtgccggcttgctgttgctgtatcaggtcagttgcgcgctggacgatatcgaaccggtgctcaaatcgcctgcggcgatcaccaccgccgcgctctcgggcgacccggtagccgcggcagtcctggagcaattctgcgtgtttctcggcagagtggtcggcaaccatgtgctggccctgggcagcctcggcggggtttatatcgtcggtggcgtggtgcctcgttttactgagttcttcatcaacagcgggttcaagcgcgccatggccgagaagggcgtcatgagcgactatttcaaaggtctgccggtgtggctggtaacggccgaataccctggcctcatggggtcgggcgtggccctgcaacaggcgtttggtgcgcagatctga

SEQ ID NO: 50021 - protein, 321 aa, Pseudomonas syringae pv. syringae B728a
MKLALVGDIGGTNARFAIWENSTLHSVRVFPTIDYAGPEKAIEVYLQDLELQRGDIGHVCLAVAGPVDGDFFQFTNSHWQLSREAFCADLQVDELLLINDFTAMALGMTRLKDDEYLTVCHGVGKPDRPRVVVGPGTGLGVGTLIKLEGSRWMALPGEGGHADLPIGTAREALLWTRLMAEHEHVSAEVVLSGAGLLLLYQVSCALDDIEPVLKSPAAITTAALSGDPVAAAVLEQFCVFLGRVVGNHVLALGSLGGVYIVGGVVPRFTEFFINSGFKRAMAEKGVMSDYFKGLPVWLVTAEYPGLMGSGVALQQAFGAQI

SEQ ID NO: 50022 - DNA, 954 bp, Rhodobacter sphaeroides 2.4.1
  CDS (1)..(954)
atggccgacgcgcccctttgcctcgtcgccgacatcggtggcacgaacacccgcgtggcgctggcggagggatcccggctgcggcccgaaacgacgcgccgcttccggaatgccgattatcctgctctggcgccggtcctgcgcgacttcctctccgtcgccggcagccccgagatcgacggcacctgcgtggccgccgcgggcccggtccgggacggggtggcccttctcacgaacctcgcctggaccgtcgacggcgccgaactgcagcgcgcgaccggcgcgccgcgcgtggcggtgctgaacgatcttcaggcgcagggccatgcgctgggccatctggatccggccaatctgcgcgtcctgatcccggggcctactccccgccgcgggggcccgatgctcgtcgtgggcgtcggcaccggcttcaacgcggcgcccgtccacgatgtcgcgggcctgcgcctggtggcggcctccgagtgcggccatgccgggatgcccgtccgcaccgcgcgcgacctccggctcgcggaattcgtccagacggcccacggtttcgccggcgtcgaggatgtgctgtcgggccgcggtctcgagcggctctatgccttcaccgccgctgaggccggcctcgaggaccgcaagtcggcggccgagatcatggcggccatcgccgaacccggcccggcgcgcgccgcggccgagctcttcgcccggctcctcggcgccgaggcgggcaatctcgccctgatccacctgcccttcggcggcctctatctctgcggcggcgtggcccgggccttcgccgcccatctgggcccgatgggctttgccgagaacttccgcgacaagggccgcttctcggccttcatggacgatttcccggtctgcatcgtcgaggacgattacgcggccctcaccggctgcgcagcctacctcgccaccctctga

SEQ ID NO: 50023 - protein, 317 aa, Rhodobacter sphaeroides 2.4.1
MADAPLCLVADIGGTNTRVALAEGSRLRPETTRRFRNADYPALAPVLRDFLSVAGSPEIDGTCVAAAGPVRDGVALLTNLAWTVDGAELQRATGAPRVAVLNDLQAQGHALGHLDPANLRVLIPGPTPRRGGPMLVVGVGTGFNAAPVHDVAGLRLVAASECGHAGMPVRTARDLRLAEFVQTAHGFAGVEDVLSGRGLERLYAFTAAEAGLEDRKSAAEIMAAIAEPGPARAAAELFARLLGAEAGNLALIHLPFGGLYLCGGVARAFAAHLGPMGFAENFRDKGRFSAFMDDFPVCIVEDDYAALTGCAAYLATL

SEQ ID NO: 50024 - DNA, 1005 bp, Xylella fastidiosa Dixon
  CDS (1)..(1005)
atgattccgacccctacccgagatgcacccaatatcccgtcctttcttgccgccgatgtcggcggcactcacgtgcgcgtcagcgtggttgcagccgcgcccacgtgtgctagtccaccgcaactgtttgatgtgcgcacttaccgctgcgctgactatcccagcctcagcacaattctgaacgacttcctcggtacaagatcagcagtacgtgattgcgtcatcgccagtgccggttttcagcgcagcgatggtactgttatcactaccaacctaccgtggccgctatcaccacaccggctacgcgcagatctcaatctggcagaggtctctctggtcaacgactttgaggcgctggcctacgccacggaggatatggaggctgcgcaattgctgcacctcactggtccagccaaagcgcaggatgggccacgcctgttgctcggtccgggaaccggcctgggtgcagcactctggattcccaataacggacgccccattgtcctccccacggaagccggtcaagcagcattgccgagtacaactgaacttgaaatgcaactggtacgacacatgctgaacaaccgcacacatgtgccgattgagcatgccttatctgggccaggaatactcaatgtgtaccgcgccttgtgtgcgctacagtccgtcctcccccagcacgcgagcccagatgcgatcagtcacgctgcggcagcaggaacagacatgctgtcatcacagactctagaggtgttctgcgacttcctcggcagcatcgttggtgatttggtcatgatgtacggtgcacaggggggtgtctatctggccggaggaatcctgccacagctgcgtgagccgctgctacgcagtcactttgtcgaacgcttcctcaataaaggccccatgggtgaggcattacagcacgtcccggtgcggctgatcgaacatggacaactcggtatcgtaggtgcggcacgctggtacttaaataagaaagcaacttaa

SEQ ID NO: 50025 - protein, 334 aa, Xylella fastidiosa Dixon
MIPTPTRDAPNIPSFLAADVGGTHVRVSVVAAAPTCASPPQLFDVRTYRCADYPSLSTILNDFLGTRSAVRDCVIASAGFQRSDGTVITTNLPWPLSPHRLRADLNLAEVSLVNDFEALAYATEDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 50026 - DNA, 1005 bp, Xylella fastidiosa Ann-1
  CDS (1)..(1005)
atgattccgacccctacccgagatgcacccaatatcccgtcctttcttgccgccgatgtcggcggcactcacgtgcgcgtcagcgtggttgcagccgcgcccacgtgtgctagtccaccgcaactgttcgatgtgcgcacttaccgctgcgctgactatcccagcctcagcacaattctgaacgacttcctcggtacaagatcagcagtacgtgattgcgtcatcgccagtgccggttttcagcgcagcgatggtactgttatcactaccaacctaccgtggccgctatcaccacaccggctacgcgcagatctcaatctggcagaggtctgtctggtcaacgactttgaggcgctggcctacgccacgcaggatatggaggctgcgcaattgctgcacctgactggtccagccaaagcgcaagatgggccacgcctgttgctcggtccgggaaccggcctgggtgcagcactctggattcccaataacggacgccccattgtcctccccacggaagccggtcaagcagcattgccgagtacaactgaacttgaaatgcaactggtacgacacatgctgaacaaccgcacacatgtgccgattgagcatgccttatctgggccaggaatactcaatgtgtaccgcgccttgtgtgcgctacagtccgtcctcccccagcacgcgagcccagatgcgatcagtcacgctgcggcagcaggaacagacatgctgtcatcacagactctagaggtgttctgcgacttcctcggcagcatcgttggtgatttggtcatgatgtacggcgcacaggggggtgtctatctggccggaggaatcctgccacagctgcgtgagccgctgctacgcagtcactttgtcgaacgcttcctcaataaaggccccatgggtgaggcattacagcacgtcccggtgcggctgatcgaacatgggcaactcggtatcgtaggtgcagcacgctggtacttaaataaaaaagcaacttaa

SEQ ID NO: 50027 - protein, 334 aa, Xylella fastidiosa Ann-1
MIPTPTRDAPNIPSFLAADVGGTHVRVSVVAAAPTCASPPQLFDVRTYRCADYPSLSTILNDFLGTRSAVRDCVIASAGFQRSDGTVITTNLPWPLSPHRLRADLNLAEVCLVNDFEALAYATQDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 50028 - DNA, 990 bp, Magnetospirillum magnetotacticum MS-1
  CDS (1)..(990)
atgagcgggagtgcatcaggatttgtcctggtcgccgatatcggtggcacacatgcccgcttcgccctggtgggcgaggacggggaggcggtcaatcctgtcgtgttgcgctgcgccgattacgacggcccggctccggccatcaaggcctatctttccgatcagggcgcgggcgccgcacccagacgcggtgctttcgccgtggcctcggtcattgacggcgatcgtatcgaactgaccaattcgccttggcgcttttccatctccgagacccaaagggccgtggggctggagcggctggaggtggtcaacgacttcaccgccgtggccctgtcggtacgccatctgaagcctgaacatctgttgaccatcggcggcggcgcggcgcaagcgggtctgcccattgccgtgctggggccgggaacggggctgggggtgtcggccttgattcctggcgaatccggtcggtggacagccctggccaccgagggcggacacgtcaccatggccgccgccagcgagcgcgaggcccgcatcctcgaccgcttgcgcacccagttcgaccatgtttccgccgagcgggtcctgtcgggccaggggctggtcaacctctatcaggcggtcgccgccctgtcggggcatcaggcggtgttctccacccccgacgtcatcaccaagcgcgggctggacggatcgtgtcccatcagccgcgaggcggtggagacattcttcgccatgatggggactgtggccggaaatctggctctgtctctgggggccaagggcggcgtgttcatcgcgggcggcatcctgccgcgcatggccgatgccttccgcgcctcctccttcaggacccgcttcgaggcccatgggcgtttccagccctatctggccgccatccccacctggctgatcacccatccgctgcccgcctttgttggacttgcggggttgatccggccaaaggccgaccatcggactttggcctag

SEQ ID NO: 50029 - protein, 329 aa, Magnetospirillum magnetotacticum MS-1
MSGSASGFVLVADIGGTHARFALVGEDGEAVNPVVLRCADYDGPAPAIKAYLSDQGAGAAPRRGAFAVASVIDGDRIELTNSPWRFSISETQRAVGLERLEVVNDFTAVALSVRHLKPEHLLTIGGGAAQAGLPIAVLGPGTGLGVSALIPGESGRWTALATEGGHVTMAAASEREARILDRLRTQFDHVSAERVLSGQGLVNLYQAVAALSGHQAVFSTPDVITKRGLDGSCPISREAVETFFAMMGTVAGNLALSLGAKGGVFIAGGILPRMADAFRASSFRTRFEAHGRFQPYLAAIPTWLITHPLPAFVGLAGLIRPKADHRTLA

SEQ ID NO: 50030 - DNA, 1026 bp, Nostoc punctiforme PCC 73102
  CDS (1)..(1026)
atgactttattactagcaggagacatcggcggtacgaaaactattttgcaattggttgaaacatcagattcacaaggtttacatactatttatcaggaaagttaccacagtgctgattttcccgatttagtacctatagtgcagcagtttttaatcaaagctaatacaccaataccagaaaaggcttgttttgcgatcgcagggcccattgtcaaaaatactgccaaactgaccaatttagcctggttcctagataccgaacgtctacaacaagaattgggtatcccacatatttatttgattaacgacttcgccgccgttggctatggcatttcaggtttacaaaaacaagacttgcacccgttgcaagttgggaaacctcaacccgaaaccccgattggaattattggtgctggtactggcttagggcaaggatttttaattaagcagggaaacaactatcaagtttttccttcagaaggtggacacgctgacttcgcgcctcggaacgagatagagtttcaattgttgaaatacctgctggataaacatgatatccagcgcatttctgtagaacgggtagtttctggaatgggaattgtggcgatttaccaatttttgcgcgatcgcaaatttgccgccgaatcaccagatatcgcccaaatcgtcagaacttgggaacaagaagccggacaggaagagaaaagtgtcgatcccggtgctgctattggtacagctgcactagaaaaacgcgatcgcctttccgaacaaaccttgcaattatttatagaagcttatggtgcagaagccggcaatctcgcccttaaactcctaccttatggtggcttatacattgctggtggaattgcgcctaaaattctccccttaatccaaaatagcggtttcttattaaacttcacccaaaaaggcaggatgcgccccctcctggaagagatacctgtgtatattatcctcaacccacaagtggggctaataggtgctgctttatgtgctgctaggttataa

SEQ ID NO: 50031 - protein, 341 aa, Nostoc punctiforme PCC 73102
MTLLLAGDIGGTKTILQLVETSDSQGLHTIYQESYHSADFPDLVPIVQQFLIKANTPIPEKACFAIAGPIVKNTAKLTNLAWFLDTERLQQELGIPHIYLINDFAAVGYGISGLQKQDLHPLQVGKPQPETPIGIIGAGTGLGQGFLIKQGNNYQVFPSEGGHADFAPRNEIEFQLLKYLLDKHDIQRISVERVVSGMGIVAIYQFLRDRKFAAESPDIAQIVRTWEQEAGQEEKSVDPGAAIGTAALEKRDRLSEQTLQLFIEAYGAEAGNLALKLLPYGGLYIAGGIAPKILPLIQNSGFLLNFTQKGRMRPLLEEIPVYIILNPQVGLIGAALCAARL

SEQ ID NO: 50032 - DNA, 990 bp, Desulfovibrio desulfuricans G20
  CDS (1)..(990)
atggaacgcattctcgcagtggacatagggggaaccaacagccggtttgcggcctttgtgctgcaggctgacggtacgctgaaatttgaagacagcttatggctttccactcagggcgcgcagtcttttccggcgttgctggcagagctggaaaaccgcgggttttcgctgctgccgcgtgatgcggacgtcatggtgctggctgtggcaggtgctgtcgaaaaaaaagggcgctattgcaaaatatccaatgcatcgtgggcggttgatctggatgaagtggcacagacgttcggtatcgcccgcggtcgtctgatcaatgattttgaagcgcaggcttacgcctgcctgtccgaagccgtgcatgacgctgttacggtgcagcacggtgttgcagaggacggcgcccccatagccgtggtgggggggggaaccggactgggcaagtgtctgctggtgtgtgacggggtggggcgttatatcaccgtgccgtcagagggcgggcattcagtctttccttttgtaggcagagaagaactggaatttgcggaatttatactgcgtgagacaggaagaccgcaggttatcggcgatctggtggtcacaggaacaggcctgcggctgctccaccagtttcataccggcgaacggctgtcatcgcgtgaagtaagccgcaagctggaaggcgactccgttgttcttgagtggtttgcccgtttttacggcagagcctgtcacgattatgtgctggaaaccatggcactgggggggctgtatatcgccggcgggcttgcttcgggtaatccgggacttgtcacccaccacgcgtttgtacaggagtttgtgcagagcgatgtgcacgggcatcttttgcgcaaagtgcctgtgcgtctgaaccgcaatgaagaatcgggcctgtggggcgcggccgtgtgcggcgtgcagatgctgagaaccggccgccttgtacgctccgccggcggagcctga

SEQ ID NO: 50033 - protein, 329 aa, Desulfovibrio desulfuricans G20
MERILAVDIGGTNSRFAAFVLQADGTLKFEDSLWLSTQGAQSFPALLAELENRGFSLLPRDADVMVLAVAGAVEKKGRYCKISNASWAVDLDEVAQTFGIARGRLINDFEAQAYACLSEAVHDAVTVQHGVAEDGAPIAVVGGGTGLGKCLLVCDGVGRYITVPSEGGHSVFPFVGREELEFAEFILRETGRPQVIGDLVVTGTGLRLLHQFHTGERLSSREVSRKLEGDSVVLEWFARFYGRACHDYVLETMALGGLYIAGGLASGNPGLVTHHAFVQEFVQSDVHGHLLRKVPVRLNRNEESGLWGAAVCGVQMLRTGRLVRSAGGA

SEQ ID NO: 50034 - DNA, 996 bp, Pseudomonas aeruginosa UCBPP-PA14
  CDS (1)..(996)
atgaataacgacaacaagagaagcgccggcggcctcggcctggtcggcgatatcggcggcaccaatgcgcgtttcgcgctctggcgcgggcagcgcctggaatccatcgaggtgctcgcctgcgccgactacccacggcctgaactggccgtgcgcgactacctggcgcggatcggcgaatcggtggcgaacatcgactcggtctgcctggcctgcgccggtccggttggggcggcggatttccgtttcaccaacaaccactgggtgatcaatcgcgccgcgttccgcgaggagctggggctggatcacctgctgctggtcaacgacttcagcaccatggcctgggccgcctcgcggctgggcgcggacgagctggtgcaggtccgggccggcagcgcccaggcggatcgcgcccggctgatcatcggtcccggcaccggccttggcgtcggcagcctgctgccgctgggcgggggacgttgggaagtgctgccctgcgagggcgggcatgtcgacctgccggtcacttcgccgcgcgacttcgcgctctggcagggcctgcaggcgcgctacggacacgtctccgccgagcgcgcactgtccggcaacggcctgctcgccctctatgaaatcagctgtgccctggacggggtcgccgtccgcgcgagcagtgcggcggaagtcggtgccctggccatggccggcgacgcccaggcggacgccgtgctggagcacttcttcctgtggctggcgcgggtcgccggcaacgcggtgctcaccgtcggcgcgctcggtggcgtctacattaccggcggcatcgtcccgcgtttcctcgagcgcttcatcgccagcggtttcgccgaggccttcgccaggcgtggcaagaccagtggcgcttacctgcaggacgtaccggtgtgggtcatgaccgccgaacatccgggcctgctcggcgccggcgtcgccctgcagcaggccctggacgccgagggctga

SEQ ID NO: 50035 - protein, 331 aa, Pseudomonas aeruginosa UCBPP-PA14
MNNDNKRSAGGLGLVGDIGGTNARFALWRGQRLESIEVLACADYPRPELAVRDYLARIGESVANIDSVCLACAGPVGAADFRFTNNHWVINRAAFREELGLDHLLLVNDFSTMAWAASRLGADELVQVRAGSAQADRARLIIGPGTGLGVGSLLPLGGGRWEVLPCEGGHVDLPVTSPRDFALWQGLQARYGHVSAERALSGNGLLALYEISCALDGVAVRASSAAEVGALAMAGDAQADAVLEHFFLWLARVAGNAVLTVGALGGVYITGGIVPRFLERFIASGFAEAFARRGKTSGAYLQDVPVWVMTAEHPGLLGAGVALQQALDAEG

SEQ ID NO: 50036 - DNA, 930 bp, Dechloromonas aromatica RCB
  CDS (1)..(930)
atgctgctcggcggcgatctcggcggcaccaagacgctgctggcactggccgaagtgattgatggccgcatcgagattgtccgccagcaacgctacgccagcctggattacgccagcttcgacgacctgctggctgaatttatcgccgggcacccggccatcaataccgcctgcttcggcgtcgccggcccaaccgatgggcgccatgccaagctgacctacctgccctggcaactgaccgccagcgagctggagcaaaagttcgccatcggccgcgtctcactgatcaacgattttgccgctgctgcgaacggcctacccttggtcgacgaccaggacatcctgaccctgcacaccggccagcccgaagaacacgccccgcgtgtcattctcggcgccggcactggcctcggcgtggccgggctgatctgggaaagcgaccgttatcgcgtcatccccggcgaaggcggtcacttcggcttctcgccgcaaaccgcacagcaaggcgaactctgggcctggctactggctcaaaacggccgggttactgtcgaagacatcgtttccggccctggcctgtcacggatttttgctttcctttccggtcaaacgcgtgcaccggaggaaatcggacgagccgccctcgccggtatcgatccgtcagccaatgcggcgttacagctctggcttgaatgctatggcgccttcgccggcgacctcgccatgcactggctggcccgaggcggcgtctatctggccggcggcatcgccgccaaactattgcctcacatcgatgccagctccttcacggcagccttcctggccaaacgcgagcacagcgaactggtcaagagcatgcccatccggctgctgaccgtggaagacctcggcctgcgcggcacattggcgcgagccgcccaacaagactga

SEQ ID NO: 50037 - protein, 309 aa, Dechloromonas aromatica RCB
MLLGGDLGGTKTLLALAEVIDGRIEIVRQQRYASLDYASFDDLLAEFIAGHPAINTACFGVAGPTDGRHAKLTYLPWQLTASELEQKFAIGRVSLINDFAAAANGLPLVDDQDILTLHTGQPEEHAPRVILGAGTGLGVAGLIWESDRYRVIPGEGGHFGFSPQTAQQGELWAWLLAQNGRVTVEDIVSGPGLSRIFAFLSGQTRAPEEIGRAALAGIDPSANAALQLWLECYGAFAGDLAMHWLARGGVYLAGGIAAKLLPHIDASSFTAAFLAKREHSELVKSMPIRLLTVEDLGLRGTLARAAQQD

SEQ ID NO: 50038 - DNA, 1029 bp, Anabaena variabilis ATCC 29413
  CDS (1)..(1029)
atgaccttattgttagcaggagatatcggcgggacgaaaactattttgcgattggtagaagtatcaaattcgtcggaactgcacaatatttatgaggaaagttaccagagtggggattttcccgatttagtgccgatggtgcagcaatttttagtcaaggctaatatacctagtcatcccgaaaaggcttgctttgcgatcgccggcccagtggtgaataatactgccaagctgaccaacttagtctggtttttggatactgaacggctagcacaagaattaagtatccccttcatttccctcattaatgattttgctgctgttggctatgggatttttgggttaagtaaacaagatttgttcaccttacaagctggtaaacatcaaactgaagcgcctattgctattattggtgctggtactggattaggacaaggatttttaattaaacagggaaaccagtatcaagttttcccatcggaaggtggacacgctgactttgccccccgcaacgagttagagtttcagttattgaaatatctgctggataaacatgatatccagcgtgtttctgtggaacgggtggtttctggacagggggttgtcgccatttatcaatttttacgcgaccgcaaattagcgatagaatccccagaaattgcccaagttgtccgcacttgggaacaacaagcaggacaggctgaaaaaaccgttgatcctggtgcagctattggtaaagccgcagtccaaggaagcgatcgcctttccgaacaaaccctacaattatttattgatgcctatggcgcagaagcgggaaatcttgccctcaaactcctaccatacggcggtttgtacattgcgggtgggattgcgcctaaagtcttgccattgattgaaaatagcaatttcttgcttaatttcagccaaaaaggcagaatgcgtcctctgctagaagaaatacccgtgcatatcattcttaacccacaagtgggactcataggtgctgctttgtgtgctgctaggttataa

SEQ ID NO: 50039 - protein, 342 aa, Anabaena variabilis ATCC 29413
MTLLLAGDIGGTKTILRLVEVSNSSELHNIYEESYQSGDFPDLVPMVQQFLVKANIPSHPEKACFAIAGPVVNNTAKLTNLVWFLDTERLAQELSIPFISLINDFAAVGYGIFGLSKQDLFTLQAGKHQTEAPIAIIGAGTGLGQGFLIKQGNQYQVFPSEGGHADFAPRNELEFQLLKYLLDKHDIQRVSVERVVSGQGVVAIYQFLRDRKLAIESPEIAQVVRTWEQQAGQAEKTVDPGAAIGKAAVQGSDRLSEQTLQLFIDAYGAEAGNLALKLLPYGGLYIAGGIAPKVLPLIENSNFLLNFSQKGRMRPLLEEIPVHIILNPQVGLIGAALCAARL

SEQ ID NO: 50040 - DNA, 1032 bp, Ralstonia eutropha JMP134
  CDS (1)..(1032)
atgagcaacgccatggctgcttccgccgtgcccgatgacaccgcctatccgcgtttgctggccgacgtgggcgggaccaatgtgcgcttcgcactggaaacggcgccgatgcagatcggcgccgtgaccgcgctgaaggtggccgaccatccgtcgctggaagcggccatgcgccactaccgcgatgcgctgtctgcctcgggtgccaagttgccgcgccatgctgccatcggtctcgcgaatccggtcacgggcgaccacgttcgcctgaccaaccacgactgggccttctcgatcgaagccacgcggcaagcgctcgggctgcagacgctcgtggccatcaacgatttcacgtcgctggcgctgggcttgccttaccttggcgcgaacgatctcgtgcagatccgctccggccaagccgtggccactgcgccgcgtgcgctgatcgggcctggcaccgggttgggcgtgtcggggctggtgcccgcgccgggcggtggcgccgtggcgctggcgggggagggcggccatatcgaactcatgcccgtgaccgacgacgagtggatcgcctggcgcgccacgcacgcgagccttgggcgggtgtcggcggagcggttgttgtcaggcatggggctgtcgcagatccatgccgcgctgtccgcagaaacgggtacgcgcgtggacgtgccgctgacgcccgagcaggtcacgacgggtgccttcgcacggcacgatccgctctgcgagcgcaccatggcggtgttttttggcctgctcggatctgtcgcagcggacatcgcgctggtaatgggcgcgcttggcggcgtgtatctcggtggcggcatcctgccgcgcttcgtgccagcgctgcaggcgtcggccttcaatgcgcgcttcgtcgccaagggccgcatgcgcggctatctcgacaagctgcctgtctacgtgattaccgcgagctatcccgcgctgccgggcctggcgcgcgcgctggccgatacgctcagtcacggccgcccacatatcggataa

SEQ ID NO: 50041 - protein, 343 aa, Ralstonia eutropha JMP134
MSNAMAASAVPDDTAYPRLLADVGGTNVRFALETAPMQIGAVTALKVADHPSLEAAMRHYRDALSASGAKLPRHAAIGLANPVTGDHVRLTNHDWAFSIEATRQALGLQTLVAINDFTSLALGLPYLGANDLVQIRSGQAVATAPRALIGPGTGLGVSGLVPAPGGGAVALAGEGGHIELMPVTDDEWIAWRATHASLGRVSAERLLSGMGLSQIHAALSAETGTRVDVPLTPEQVTTGAFARHDPLCERTMAVFFGLLGSVAADIALVMGALGGVYLGGGILPRFVPALQASAFNARFVAKGRMRGYLDKLPVYVITASYPALPGLARALADTLSHGRPHIG

SEQ ID NO: 50042 - DNA, 975 bp, Rhodospirillum rubrum
  CDS (1)..(975)
atggctgagccgttcattcccggattgatcgccgatatcggcggcaccaacgcccgcttcgccctgaccacccccgagggcggctggcgcgacgaacgggtttaccgctgcgccgcctttcccggcccggccgaggcggcggcccattatctggccgaggtgctgaccgcctttgaaccgcgccccgatcgcggggcgatctgcgtcgcctgtccggtcaacggcgatcatctggctttgaccaaccatggggcgtggtcgttctcgatcagcgcggtcgccgaccgcttgggtttggcgcctttccatgcggtcaatgacttcatcgccaacgccctggccatcccccgccttggcccctccgggctgatcgagatcggcggcggcgccggacttaccggggcgccgatcgccgcaatcggcccgggcaccggtctgggggtggcgatcctcatccccggtcgcggcggcaaccgcaccagccccctggccaccgagggcggccatgtcaccctgcccgccgtgaccgaccgcgaggcggtgatcatcagcgccctgcgcgccattcacggccacgcctcggccgagcgggcgatttccggccccggtctggtttggctgagcgaggcgatccgcgccgccgatggcttggagccggttgccgaaaccccgccctcggtgatggaaaagggcttggcgcgcagctgcccggtttgcgccgaagccgtcgacaccttttacgcgctgctgggcacggtggcgggcaatctggtgctgagcaccggcgcccagggcggcgtttacctgatgggaggtatcctgccccgacacccagaggccttgcgaacctcggccttcctggcgcgcttccacgaaaagggccgcttccgcgattaccttgatgtcgtccccattcgcttggtcacccacccctatccggccttcatcggtctggccgggctggtcagcgattag

SEQ ID NO: 50043 - protein, 324 aa, Rhodospirillum rubrum
MAEPFIPGLIADIGGTNARFALTTPEGGWRDERVYRCAAFPGPAEAAAHYLAEVLTAFEPRPDRGAICVACPVNGDHLALTNHGAWSFSISAVADRLGLAPFHAVNDFIANALAIPRLGPSGLIEIGGGAGLTGAPIAAIGPGTGLGVAILIPGRGGNRTSPLATEGGHVTLPAVTDREAVIISALRAIHGHASAERAISGPGLVWLSEAIRAADGLEPVAETPPSVMEKGLARSCPVCAEAVDTFYALLGTVAGNLVLSTGAQGGVYLMGGILPRHPEALRTSAFLARFHEKGRFRDYLDVVPIRLVTHPYPAFIGLAGLVSD

SEQ ID NO: 50044 - DNA, 969 bp, Novosphingobium aromaticivorans DSM 12444
  CDS (1)..(969)
atgcaggtagttgccgtcgatattggcggaacccacgcccgcttcgcgattgccgaagtcgcggaaggccgcgtggtctcgcttggcgaggccgttacgctcaagacggcggagcatggctcgttccagcttgcctgggaggatttcgagcgcgttcgtggagagccattgcccaaggccgcggctattgccgtcgccgggcctgtcggcggcgagatcatcaagttcacgaacaatccgtggatcatccgcccggcgttgatcccggagaagctgggggcggagcaatatgtcgtcgtcaacgacttcgccgccgtggcccatgctgtcgcgcaggcggaccagagccactttctacacctgagcggcccggacgaaccgctgcccgccagcggcgtgaccagcgtggtcggaccagggacagggctcggcgtggcgcagttgtggcgtgacgggaacaactaccgggtccagcccaccgaaggcgggcacatcgacttcgcgccgctagattcgatcgaggacgcgatccttgccggtctgcgcaagcgccaccgccgcgtttcggcggaacgcgtcgtggccgggccgggcatcgtcgatatctacgaggcgcttgctctgatcgaaggacgaccgtttacaccccggtctgaccgcgagttgtgggaactcgggacttccggagcggacagccttgccgccgctgcagtagacaggttctgcctctcgctcggcagcgtggcaggcgatcttgccctggctcacggcgccaacggcgtcgtcatggccggcgggcttggcctgcggatcaaggacacgctggttcggtctggcttctcggacaggttcagggcaaaagggcggttcgaggccctcatggcggccattccggtcaagctgatcacgcatccgcagcccggcctgttcggtgcggcagcggcctttgcgcaagcgcatacgtcgtga

SEQ ID NO: 50045 - protein, 322 aa, Novosphingobium aromaticivorans DSM 12444
MQVVAVDIGGTHARFAIAEVAEGRVVSLGEAVTLKTAEHGSFQLAWEDFERVRGEPLPKAAAIAVAGPVGGEIIKFTNNPWIIRPALIPEKLGAEQYVVVNDFAAVAHAVAQADQSHFLHLSGPDEPLPASGVTSVVGPGTGLGVAQLWRDGNNYRVQPTEGGHIDFAPLDSIEDAILAGLRKRHRRVSAERVVAGPGIVDIYEALALIEGRPFTPRSDRELWELGTSGADSLAAAAVDRFCLSLGSVAGDLALAHGANGVVMAGGLGLRIKDTLVRSGFSDRFRAKGRFEALMAAIPVKLITHPQPGLFGAAAAFAQAHTS

SEQ ID NO: 50046 - DNA, 960 bp, Microbulbifer degradans 2-40
  CDS (1)..(960)
atgtatccctatatcgttgcagacattggcggcactaacgcgcgttttgctttagtaacaggcaaaaaaggtaatgcgtttaatttagagcagattcaaatattaaacggcagtgaattcccgcgtttgcaggatgcaatgcagcattacattgatacccttggtggtgaaaaaccaaaggctgcttgtgtggctattgccggccccattgatggcgataatgcgcgcatgaccaatttaaattgggagtttagccaagcggcggtgaaggcagagtttgggtttgataaatacgatacccttaacgactttggcgcattggctgtggcaaccagcagcttgcaagccgataacttaatagaaattaaagccggcacaatggacccaaaaggcaacaaggccattttgggccctggcactggtttaggagtggcaggtttggcgtgtgcaggcgatagttggttgcctattcctagtgaaggtggccacgtaaatgttgcgccagcaacgcagttagagtgcgaagttattcgcgcagctatggccgaacacgggcatgtatctgcagaaacgtttatatccggcccaggccttgtgcgtttgtatcgtgcattggctaccgttcgcggtgaaacgccaaaaaactacgagccaaaagatattaccgcaggtgcgctagatggcactgacgacttgtgcaaagaaacgttggatttattttgcagctttatcggttcgctatcaggtaatttggcactaacttacggcgcaaaaggcggggtgtatttagcgggtggtgtgttgccgcgcttcattgattattttaaatctagtgattttgttaagcgcttttctgaaaagggtgtaatgagccactatgtggaaaatattcccgttaatttaattagctacgagtacaccgcatttgttggtgcggctgcctggttggatcaactttaa

SEQ ID NO: 50047 - protein, 319 aa, Microbulbifer degradans 2-40
MYPYIVADIGGTNARFALVTGKKGNAFNLEQIQILNGSEFPRLQDAMQHYIDTLGGEKPKAACVAIAGPIDGDNARMTNLNWEFSQAAVKAEFGFDKYDTLNDFGALAVATSSLQADNLIEIKAGTMDPKGNKAILGPGTGLGVAGLACAGDSWLPIPSEGGHVNVAPATQLECEVIRAAMAEHGHVSAETFISGPGLVRLYRALATVRGETPKNYEPKDITAGALDGTDDLCKETLDLFCSFIGSLSGNLALTYGAKGGVYLAGGVLPRFIDYFKSSDFVKRFSEKGVMSHYVENIPVNLISYEYTAFVGAAAWLDQL

SEQ ID NO: 50048 - DNA, 1056 bp, Trichodesmium erythraeum IMS101
  CDS (1)..(1056)
atgacattgttagttgcaggtgacattggtggtacgaaaactatactacaattggtagaggtaaaccgagaagaatcaaaagcttccgtggaactacgtaaactttatgaaaatcgttacttgagtaacgattttcccgatttagtacctatagtaaaaaagttccttgaagaagctagtgaaaaattaggagaaaaacaaaaacctgaaaaagcttgttttgccattgccggtccagttgtcaacaacatagttaaattgactaatttgccttggataatagatgccaaacttatggaaaatgagttaggtatatctcaaattagtttgattaatgattttgaagcagtaggatatggaattttaggtttaaatactaaggatcttgaaactttacaaccaggtgaacctaaaagtgatactccaatagctgtaattggtgctggtacaggattaggacaatgttttttgattcgagcagcaggggttattaaagtatatcctacagaaggaggtcatacagattttaaggcacgctcacagttagaatttgacctattaaaatatttgaagaaattacataatataaagcgagtctctgtagaaagagtagtttcgggaatgggaattgtcgcaatttatcaatttttacgcgatagcctatttgctacagaatctccagaaataggagatcaaattagacagtgggaaaaagaagtaggttcaaatcaaattactgtagacccaggagcagtgatcggtaaagctgctttagaaaaaagtgaccccttgtgcgagcaaaccttgaagatgtttatagaagcttatggggcagaagcgggaaatttggcactgaaacttttaccctatagtggtttatacatagcagggggtattgctgctaaaattatcccacttataaattcaggtagttttatggaagcttttaaggataaagggcgaatgaaacccttattagaaaaaatacctgttcatgttattttaaatcctcacgtgggattaattggtgcagcaattcgtgcttctaatttatag

SEQ ID NO: 50049 - protein, 351 aa, Trichodesmium erythraeum IMS101
MTLLVAGDIGGTKTILQLVEVNREESKASVELRKLYENRYLSNDFPDLVPIVKKFLEEASEKLGEKQKPEKACFAIAGPVVNNIVKLTNLPWIIDAKLMENELGISQISLINDFEAVGYGILGLNTKDLETLQPGEPKSDTPIAVIGAGTGLGQCFLIRAAGVIKVYPTEGGHTDFKARSQLEFDLLKYLKKLHNIKRVSVERVVSGMGIVAIYQFLRDSLFATESPEIGDQIRQWEKEVGSNQITVDPGAVIGKAALEKSDPLCEQTLKMFIEAYGAEAGNLALKLLPYSGLYIAGGIAAKIIPLINSGSFMEAFKDKGRMKPLLEKIPVHVILNPHVGLIGAAIRASNL

SEQ ID NO: 50050 - DNA, 999 bp, Thiobacillus denitrificans ATCC 25259
  CDS (1)..(999)
atggagtggatcgcaggcgacatcggaggaacgaagagctggctcgtgtggatcgggccgcctggcgacggcctgcacccgcgcttcgagcgcgtctacccgagcgccgacttcgtctcggccgaagccctgctgcggcagtttctcgccgactcggggatacagggacggcccgacggcctgatcctggccgtcgccggcccgtcgcaggccgagcacgtcaagctcaccaacctcgactggtggatcgacgcggccgagctccagctcgcgctcggcattccccaggtccacatcgtcaacgatttcgaggctgccgccgcgggactcgcgaccctggtgccggccgactacgtcgagatcaacccggggcagcccgacccgctcggcgtgcgcgcgatcacgggcgccgggaccgggctcggcctggccttcctcgtccatgacccggcagggcgggaaacgagctacccgaccgaaggcggccacgtcgactttgcgcccgccaacgccatgcaggatcggctgctgaagcgactgcgcaagcaatacggtcacgtctcctgggagcgcgtcgtctccgggtcggcgatgtccgagctctatgcattctgctgcgtcgaacttggcaccacgccgtgctcggcgtcgtgcgacggcgcctgcctcgtcgctgcggcggcggcggacgacatcgcggccgaggctgcgctcgatctctttgtcgacctctacggcgcctgggtcggcaacgtcgccttgctctaccgtccgcgcggcgggctctacatcgccggcggcgtcagcgcgcacctgcagaagcgcatcgcggcgccgcgcttcatggccgcggcgctcgacaaggggcgcatgcgtcgcgtcgtcgaaagcacaccgatatttctgatcacgagcccgcggctcggcgtgcagggcgcgctggccctgcgcgaagccgcggcgcacagccggcgcgaccgccggacccatgaacgataa

SEQ ID NO: 50051 - protein, 332 aa, Thiobacillus denitrificans ATCC 25259
MEWIAGDIGGTKSWLVWIGPPGDGLHPRFERVYPSADFVSAEALLRQFLADSGIQGRPDGLILAVAGPSQAEHVKLTNLDWWIDAAELQLALGIPQVHIVNDFEAAAAGLATLVPADYVEINPGQPDPLGVRAITGAGTGLGLAFLVHDPAGRETSYPTEGGHVDFAPANAMQDRLLKRLRKQYGHVSWERVVSGSAMSELYAFCCVELGTTPCSASCDGACLVAAAAADDIAAEAALDLFVDLYGAWVGNVALLYRPRGGLYIAGGVSAHLQKRIAAPRFMAAALDKGRMRRVVESTPIFLITSPRLGVQGALALREAAAHSRRDRRTHER

SEQ ID NO: 50052 - DNA, 981 bp, Chloroflexus aurantiacus
  CDS (1)..(981)
atgtatctggccggtgacatcggcggcacaaagacaattctggccctctttgatcaggcgaccgggccacatcatccggtttttgaacagacatttgccagtgcgcgttatcccgatttagagacgatgatcgctgagtttcgcgaacaacatccggttcccattgagggcgcagcgtttggcgtcgccgggccggtggtcagcggacgggccagtatcacgaatctgagctggacaattgacgctgccagattgagtacagtgttaaacggcgcaccggtacgcctgttaaacgatctggaagcgattgcccaatcggttccgattctcgaacctgctgatctggagacacttactgcggggcaagccattgctggtggcgcaattggggtcatcgcccctggtaccggtctgggtgaggcatttctcacctgggacggggtgcgctatcgcccgcacccctctgaaggcggtcacacgacattcgcgccccgcaatcaggttgaaaaagatctgctcgattacctgcatcaacggtacaatcacgtcagctacgaacgtgtctgctcgggcattggcataccgaatttgtacgcttttgtacgtgatcgactgctccaacgcgaaacgccggcggtcgccgagcaactggccgctgccagtgatcccacaccggtcattgtccaggccgggatggcaaccgaacagatgtgcctggtatgccgtaccacccttgaactgttcgttgacattctggcagccgaagccggcaatctggcgttaaaggtactggcgaccggcggcgtatacattggcggtggtttaccaccacggatgctgccattgatcaagcgtgaacgattcctacaggtcttccgtgataaaggacgtttcagtgaattgctgagccaggtgccgattcacgtcattctcgaaccgaaagccggtctcctcggcgcggcagcagcagcaatgagttga

SEQ ID NO: 50053 - protein, 326 aa, Chloroflexus aurantiacus
MYLAGDIGGTKTILALFDQATGPHHPVFEQTFASARYPDLETMIAEFREQHPVPIEGAAFGVAGPVVSGRASITNLSWTIDAARLSTVLNGAPVRLLNDLEAIAQSVPILEPADLETLTAGQAIAGGAIGVIAPGTGLGEAFLTWDGVRYRPHPSEGGHTTFAPRNQVEKDLLDYLHQRYNHVSYERVCSGIGIPNLYAFVRDRLLQRETPAVAEQLAAASDPTPVIVQAGMATEQMCLVCRTTLELFVDILAAEAGNLALKVLATGGVYIGGGLPPRMLPLIKRERFLQVFRDKGRFSELLSQVPIHVILEPKAGLLGAAAAAMS

SEQ ID NO: 50054 - DNA, 972 bp, Erythrobacter litoralis HTCC2594
  CDS (1)..(972): transl_table=11
atggacctcgtcgccgtcgatatcgggggaacccacgcccgcttcgccattgccactgtcgcggaggacggcgcgatcacgctcggcgaaccggagacgctccacaccgaagatcacgccagcttccagaccgcgtgggaggattttcgcgatcgcatgggcggcagcctgcccgacgcgatcagcatggccgtcgccgggccggtcaagaccgacatcatccgcttcaccaacaatccctggatcatccgtccgccgctgattgccgaaaagctcggttgcgggcgctacaccatcgtcaacgatttcgaagccgtggcgcatgctgcggcccgcgcaccagcggaacagtttatccatctcgcagggccggagcaggacctgcccgctaaaggcaccatcagcgtgcttggccctggcaccggactaggcgtcgctcatttctggcgcgacggagacggcggctaccgcgtgcaggcgaccgagggcgggcatggcgatttcgccccgctcgattccatcgaggatgcgatcctcgcccgcctgcgcaagcggcacatgcgcgtgtcggacgaacgcgtagtttcgggaccggccatcgtcgacatctaccacacgctcgctgccatggagggccgcgcggtgcaggagctcgacgatgtcgagatctggacccgcggtaccagcggcgacgacagcctcgccgccgccgctgtcgaccgcttctgtctcgctctcggcagtgtcgcgggcgatatcgcgttgatccaaggcgcgagcggcgtcgtgatagcaggtggcctcggctatcgcatccgtgagacactgaccgcttccggtttcgaggaccgctttcgcgccaagggacgctttgccggcctgatggcgacgctgccggtcaagctgatcgtccatccccaacccggcctgttcggcgcggccgcagcctttgcaagggaacatctatcgtga

SEQ ID NO: 50055 - protein, 323 aa, Erythrobacter litoralis HTCC2594
MDLVAVDIGGTHARFAIATVAEDGAITLGEPETLHTEDHASFQTAWEDFRDRMGGSLPDAISMAVAGPVKTDIIRFTNNPWIIRPPLIAEKLGCGRYTIVNDFEAVAHAAARAPAEQFIHLAGPEQDLPAKGTISVLGPGTGLGVAHFWRDGDGGYRVQATEGGHGDFAPLDSIEDAILARLRKRHMRVSDERVVSGPAIVDIYHTLAAMEGRAVQELDDVEIWTRGTSGDDSLAAAAVDRFCLALGSVAGDIALIQGASGVVIAGGLGYRIRETLTASGFEDRFRAKGRFAGLMATLPVKLIVHPQPGLFGAAAAFAREHLS

SEQ ID NO: 50056 - DNA, 969 bp, Azotobacter vinelandii AvOP
  CDS (1)..(969): transl_table=11
atgactctgacaatggtcggtgatatcgggggtaccaacgcgcgtttcgccttgtggcgcgatgagcggatcgaatcggtgcggacgctgcccgcggccgacttcgccacgccggaactggcgatcgagcattacctgtcctccctcggactgtcgtcgggcgatctctccagcctgtgcctgggttgcgccgggccggtgtccggcgaggatttccgcttcaccaacaaccattggaccctgaaccgcagcgccttccgtcgggcgctgggactggacaacctcctgctgatcaacgacttcaccgccatggcgctgggcatgacgcgtctgcgcgaggacggacgcatccagatctgtcccggcgcgtcggagcccggcaacccgtctctggtgatagggccgggcaccggcctgggcgtcagcaccctggtgcccgacggcggcgaccgttggcgggtgctgccgggcgagggcgggcatgtcgatctgccggtcggcagcctgcgcgaggcggcgctgtggcagcaactgttcgccgacctgggccatgtacgcgccgaggatgtgctcagcggcagcggtctggtgcgactctaccgggcggtctgcaccctggacggccatgcgccgcacctcggcactcccgcggagatcagcacggccgccctggccggcgatccggtcgcggtggaggtcctgagcctgttctgcatctggctcggccgggtcgccggcaacggcgtgctgaccacgggggcgcgtggcggtgtgtatatcgtcggtggggtgattccgcgcttcgccgccttcttccagtccagcggcttcgccagcagcctgtgcagcaagggttgcatgagccattacctcaacggcgtgccggtctggctggtgaccgccgaatatcccggcctggagggtgccggcgtggccctgcagcaggcgctggagcccgccgccgcctga

SEQ ID NO: 50057 - protein, 322 aa, Azotobacter vinelandii AvOP
MTLTMVGDIGGTNARFALWRDERIESVRTLPAADFATPELAIEHYLSSLGLSSGDLSSLCLGCAGPVSGEDFRFTNNHWTLNRSAFRRALGLDNLLLINDFTAMALGMTRLREDGRIQICPGASEPGNPSLVIGPGTGLGVSTLVPDGGDRWRVLPGEGGHVDLPVGSLREAALWQQLFADLGHVRAEDVLSGSGLVRLYRAVCTLDGHAPHLGTPAEISTAALAGDPVAVEVLSLFCIWLGRVAGNGVLTTGARGGVYIVGGVIPRFAAFFQSSGFASSLCSKGCMSHYLNGVPVWLVTAEYPGLEGAGVALQQALEPAAA

SEQ ID NO: 50058 - DNA, 1110 bp, Azotobacter vinelandii AvOP
  CDS (1)..(1110): transl_table=11
atgggcggcgcgggagagcgtcgcggccccggaggatgccggcatcggttgcggccgcgagctgttcgctttcatgcgcgcggccttcagttcggcggaagagggcgcctgcgtgttcaccgagcggctcggagcgctcgaatgaagctggccctgatcgccgacatcggcggaacccacgtacgtttcgccctctggcgggacggccggccgcaggcgctgcgagtgctggccacgggcgactatcccggccccgaggaggcgatccgcgcctacctcgccgcgctggaattaccgctggcggcgctggagacggcctgcctggcctgtgccggtcccgtgcatggcgatcggttcagcctgaccaacaatcactggcggttcggccgcctggcgctcacccatgcgctgggtctgcgccagttgctggtgatcaacgacttcgccgccatggccctcggcatgacccgcctggccgagcacgagcggctgaccatccggccggggcaggctgccgtcggcagcccccggctggtgctggggccgggcaccgggctcggtgtcagcgccctgctgccggatggtccgggaaactggcgggtgctgccgggcgagggcgggcatgtcgatctgccgctcggcaattcgcgcgaggtggcgttgtggcagttgctgcagcgcgatctcggccacgtttccgcggagagcgtgctctgcggcagcggcctgctgcggctgtaccgcgtcagttgcaggctcgacggacagcagccgcgactcgactcggccgctgcggtgagcgccgcggcattggccggcgaggccggcgcgatggcggtgctggagcagttctgctgctggctgggacgggtcgccggcaaccatgcgctgaccctgggggcgcgcggcggcgtttatctggccggtggcatcctgccgcatttcgccgctttcctgcgcgacagcggcttctcccgctgcttcgtcgacaagggggtgatgagcggctatctgcaggacatcccggtatggctggcggtggccgagcagcccggcctgctgggcgccgggctggcgctggacgcctgggcgaagcgccagcccgcctga

SEQ ID NO: 50059 - protein, 369 aa, Azotobacter vinelandii AvOP
MGGAGERRGPGGCRHRLRPRAVRFHARGLQFGGRGRLRVHRAARSARMKLALIADIGGTHVRFALWRDGRPQALRVLATGDYPGPEEAIRAYLAALELPLAALETACLACAGPVHGDRFSLTNNHWRFGRLALTHALGLRQLLVINDFAAMALGMTRLAEHERLTIRPGQAAVGSPRLVLGPGTGLGVSALLPDGPGNWRVLPGEGGHVDLPLGNSREVALWQLLQRDLGHVSAESVLCGSGLLRLYRVSCRLDGQQPRLDSAAAVSAAALAGEAGAMAVLEQFCCWLGRVAGNHALTLGARGGVYLAGGILPHFAAFLRDSGFSRCFVDKGVMSGYLQDIPVWLAVAEQPGLLGAGLALDAWAKRQPA

SEQ ID NO: 50060 - DNA, 1929 bp, Burkholderia vietnamiensis G4
  CDS (1)..(1929): transl_table=11
atgtctactggtgcgcaaagtaaggccgtcgtcgcgggtcagcatgccgacggcccgcgcctgctcgcggatgtcggcggcaccaacgcgcgtttcgcgctggaaaccggcccgggtgagatcacgcagatccgcgtctatccgggcgccgattatccgacgctcaccgacgcgatccgcaagtatctgaaggacgtgaagatcgcccgcgtgaaccacgcggcgatcgcgatcgcgaacccggtcgacggcgaccaggtcacgatgaccaaccacgactggagcttctcgatcgaggcgacgcgccgcgcgctcggcttcgacacgctgctcgtcgtcaacgacttcaccgcgctcgcgatggcgctgcccggcctcaccgatgcgcagcgcgtgcagatcggcggcggcacgcggcgccagaacagcgtgatcgggctgctcggcccgggcaccgggctcggcgtgtcgggcctgatcccggcggacgaccgctggatcgcgctcggcagcgaaggcggccacgcttcgttcgcgccgcaggacgagcgcgaggatctcgtgctgcagtacgcgcgcaagaagtttccgcacgtgtcgttcgagcgggtgtgcgcgggccccggcatcgagatcatctatcgcgcgctcgccgcgcgcgacaagaagcgcgtcgccgcgagcgtcgacacggccgacatcgtcgagcgcgcgcacgcgggcgaagcactcgcgctcgagacggtcgaatgcttctgcggcattctcggctcgttcgcgggcagcgtcgcgctcacgctcggcgcgctcggcggcgtctacatcggcggcggcgtcgcgctcaagctcggcgagctgttcacgcgctcgtcgttccgcgcgcgcttcgaggcgaagggccgcttcgcgcactatctgcagaacatcccgacctacctgatcaccgccgaatatccggcgttcctcggcgtgtcggcgatcctcgcggagcagttgtcgaaccgctcgggcggtgcgtcgtcggcggtgttcgagcggattcgccagatgcgcgacgcgctgacgccggccgagcgccgcgtcgccgatctcgcgctgaaccatccgcgctcgatcatcaacgacccgatcgtcgatatcgcgcgcaaggccgacgtgagccagccgacggtgatccgcttctgccgctcgctcggctgccaggggctgtcggacttcaagctgaagctcgcgaccggcctcaccggcacgattccgatgagccacagccaggtgcatctcggcgacacggccaccgacttcggcgcgaaggtgctcgacaacacggtgtcggcgatcctgcagctgcgcgaacacctgaacttcgagcacgtcgagaacgcgatcgagatcctgaacggcgcgcgccgcatcgagttctacgggctcggcaactcgaacatcgtcgcgcaggacgcgcactacaagttcttccgcttcgggattccgacgatcgcctacggcgacctgtacatgcaggccgcgtcggccgcgctgctcggcaagggggacgtgatcgtcgcggtgtcgaaatcggggcgcgcgcccgagctgctgcgcgtgctcgacgtcgcgatgcaggcgggcgcgaaggtgatcgcgattacgtcgagcaacacgccgctcgcgaagcgcgcaaccgtggcgctcgaaaccgaccacatcgagatgcgcgagtcgcagttgtcgatgatctcgcggatcctgcatctggtgatgatcgacatcctcgcggtcggcgtcgcgatccgccgcgcgtcgaccgccggcgaactgccggaagccgtcgcgcaggcgcgtgcgcgcgcgagcgacgacgaaacggccgacgtgctcgactggctgagccacggcgcgtcgccggcggcgaaggacgtcgcgcgcgactga

SEQ ID NO: 50061 - protein, 642 aa, Burkholderia vietnamiensis G4
MSTGAQSKAVVAGQHADGPRLLADVGGTNARFALETGPGEITQIRVYPGADYPTLTDAIRKYLKDVKIARVNHAAIAIANPVDGDQVTMTNHDWSFSIEATRRALGFDTLLVVNDFTALAMALPGLTDAQRVQIGGGTRRQNSVIGLLGPGTGLGVSGLIPADDRWIALGSEGGHASFAPQDEREDLVLQYARKKFPHVSFERVCAGPGIEIIYRALAARDKKRVAASVDTADIVERAHAGEALALETVECFCGILGSFAGSVALTLGALGGVYIGGGVALKLGELFTRSSFRARFEAKGRFAHYLQNIPTYLITAEYPAFLGVSAILAEQLSNRSGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVENAIEILNGARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRASTAGELPEAVAQARARASDDETADVLDWLSHGASPAAKDVARD

SEQ ID NO: 50062 - DNA, 1929 bp, Burkholderia cenocepacia AU 1054
  CDS (1)..(1929): transl_table=11
atgtctactggtgcgcaaagtaaggcggtcgtcgcgggtcagcatgccgacggcccgcgcctgctcgcggacgtcggcggcaccaacgcgcgcttcgcgctggaaaccggccccggcgagatcacgcagatccgcgtgtatcccggcgccgactatccgacgatcaccgacgcgatccgcaagtatctgaaggatgtgaagatcagccgcgtgaaccacgcggcgatcgcgatcgcgaacccggtcgacggcgaccaggtcacgatgaccaaccacgactggagtttctcgatcgaggcgacgcgccgcgcgctcggcttcgacacgctgctggtcgtcaacgacttcaccgcgctcgcgatggcgctgccgggcctgaccgatgcccagcgcgtgcaggtcggcggcggcgcacgtcgccagaacagcgtgatcggcctgctcgggcccggtaccgggctcggcgtgtcggggctgattccggccgatgaccgctggatcgcgctcggcagcgaaggcggccacgcatcgttcgcgccgcaggacgagcgcgaggacctggtactgcagtacgcgcgcaagaagtttccgcacgtgtcgttcgaacgcgtgtgcgcgggccccggcatggagatcatctatcgcgcgctcgcggcgcgcgacaagaagcgcgtcgccgcgaccgtcgacacggtcgagatcgtcgagcgcgcgcatgcgggcgacgcgctcgcgctcgagacggtcgaatgcttctgcgggattctcggcgcgttcgcgggcagcgtcgcgctaacgctcggcgcgctaggcggcgtgtacatcggcggtggcgtcgcgctgaagctgggcgagctgttcacgcgctcgtcgttccgcgcgcgcttcgaggcgaagggccgcttcacgcactacctcgaaaacatcccgacctacctgatcaccgccgaatatccggcgttcctcggcgtatcggcgatcctcgcggagcagttgtcgaaccgttcgggcggcgcgtcgtcggccgtgttcgagcgaatccgccagatgcgcgacgcactgacgccggccgagcgccgcgtcgccgatctcgcgctgaaccatccgcgctcgatcatcaacgatccgatcgtcgacatcgcgcgcaaggccgacgtgagccagccgaccgtgatccgcttctgccgctcgctcggctgccaggggctgtcggacttcaagctgaagctcgccaccggcctcaccggcacgatcccgatgagccacagccaggtgcatctcggcgatacggccaccgacttcggcgcgaaggtgctcgacaacacggtgtccgcgatcctgcagctgcgcgagcacctgaatttcgagcacgtcgagaacgcgatcgagatcctgaacggcgcgcgccgcatcgagttctacgggctcggcaactcgaacatcgtcgcgcaggacgcgcactacaagttcttccgcttcggcattccgacgatcgcgtacggcgacctgtacatgcaggccgcgtcggccgcgctgctcggcaagggcgacgtgatcgtcgcggtgtcgaagtcgggccgcgcgcccgagctgctgcgcgtgctcgacgtcgcgatgcaggccggcgcgaaggtgatcgcgatcacgtcgagcaacacgccgctcgcgaagcgcgcgaccgtcgcgctcgaaaccgaccacatcgagatgcgcgagtcgcagttgtcgatgatctcgcgaattctgcatctgctgatgatcgacatcctcgcggtcggcgtcgcgatccgtcgcgcgtcgacgaacggcgaactgcccgaagccgtcgcgcaggcgaaagcgcgcgccagcgacgacgaaacggccgacgtgctcgactggctgagccacggcgcgtcgccggcggcgaaggacgtcgcgcgggactag

SEQ ID NO: 50063 - protein, 642 aa, Burkholderia cenocepacia AU 1054
MSTGAQSKAVVAGQHADGPRLLADVGGTNARFALETGPGEITQIRVYPGADYPTITDAIRKYLKDVKISRVNHAAIAIANPVDGDQVTMTNHDWSFSIEATRRALGFDTLLVVNDFTALAMALPGLTDAQRVQVGGGARRQNSVIGLLGPGTGLGVSGLIPADDRWIALGSEGGHASFAPQDEREDLVLQYARKKFPHVSFERVCAGPGMEIIYRALAARDKKRVAATVDTVEIVERAHAGDALALETVECFCGILGAFAGSVALTLGALGGVYIGGGVALKLGELFTRSSFRARFEAKGRFTHYLENIPTYLITAEYPAFLGVSAILAEQLSNRSGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVENAIEILNGARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLLMIDILAVGVAIRRASTNGELPEAVAQAKARASDDETADVLDWLSHGASPAAKDVARD

SEQ ID NO: 50064 - DNA, 1863 bp, Burkholderia pseudomallei 1655
  CDS (1)..(1863)
ttggccgacgtcggcggcacgaacgcgcgcttcgcgctcgagacgggcccgggagaaatcacgcagatccgcgtgtacccgggcgccgagtatccgacgctcaccgacgcgatccgcaagtacctgaaggacgcgaagatcggccgcgtgaatcacgcggcgatcgcgatcgcgaaccccgtcgacggcgatcaggtccggatgacgaatcacaactggagcttctcgatcgaggcgacgcgccgcgcgctcggcttcgatacgctgctcgtcgtcaacgatttcaccgcgctcgcgatggcgctgcccggcctgaccgatgcgcagcgcgtacagatcggcggcggcgcgcgccggcagaacagcgtgatcggcctgatggggccgggcacggggctcggcgtgtcggggctcattcccgccgacgaccgctggatcgcgctcggcagcgaaggcggccacgcgacgttcgcgccgatggacgagcgcgaggatctcgtgctgcaatacgcgcgccgcaagtatcctcacgtgtcgttcgagcgcgtgtgcgcgggcccgggcatggagatcatctatcgcgcgctcgccgcgcgcgacaagaagcgcatcgccgcgaacgtcgacacggccgacatcgtcgagcgcgcgcacgcgggcgatgcgctcgcgctcgaggcggtcgagtgcttctgcgcgattctcggcacgttcgccggcaacctcgcggtcacgctcggcgcgttgggcggcatctatatcggcggcggcgtcgtgccgaagctcggcgagctgttcatgcgctcgccgtttcgcgcgcgcttcgaggcgaagggccgcttcgaggcgtatctcgcgaacatcccgacctacctgatcaccgcggaatacccggcgtttctcggcgtatcggcgatcctcgccgagcaactgtcgaaccgcacgggcggcgcgtcgtcggccgtgttcgagcgcatccgccagatgcgcgacgcgttgacgcccgccgagcggcgcgtcgccgatctcgcgctcaaccatccgcgctcgatcatcaacgatccgatcgtcgacatcgcgcgcaaggccgacgtgagccagcccaccgtgatccgcttctgccgctcgctcggctgccaggggctgtcggacttcaagctgaagctcgcgacgggcctcaccggcacgatcccgatgagccacagccaggtgcatctgggcgacaccgcgaccgatttcggcgcgaaggtgctcgacaacacggtatcggcgatccttcagttgcgcgagcatctgaacttcgagcacgtcgaacaggcgatcgacatcctgaacaacgcgcggcgcatcgagttctacggcctgggcaattcgaacatcgtcgcgcaggacgcgcactacaagttcttccgcttcgggattccgacgatcgcgtacggcgacctgtacatgcaggcggcgtcggccgcgctcctcggcaagggcgacgtgatcgtcgcggtgtcgaagtcggggcgcgcgccggagctgttgcgcgtgctcgacgtcgcgatgcaggcgggcgcgaaggtgatcgcgatcacgtcgagcaacacgccgctcgccaagcgcgcgacggtcgcgctcgagaccgatcacatcgagatgcgcgagtcgcagttgtcgatgatctcgcggatcctgcatctcgtgatgatcgacatcctcgcggtcggcgtcgcgatccgccgcgccgcgccgaacgcggagctcgcggaggcgatggcgcgcgcgaaggcgcgcgcgggcgcgagcgcgggcgacgaggccgccgacgtgctcgactggctgagccacggcgcggcgcccgcggcgaaggactga

SEQ ID NO: 50065 - protein, 620 aa, Burkholderia pseudomallei 1655
MADVGGTNARFALETGPGEITQIRVYPGAEYPTLTDAIRKYLKDAKIGRVNHAAIAIANPVDGDQVRMTNHNWSFSIEATRRALGFDTLLVVNDFTALAMALPGLTDAQRVQIGGGARRQNSVIGLMGPGTGLGVSGLIPADDRWIALGSEGGHATFAPMDEREDLVLQYARRKYPHVSFERVCAGPGMEIIYRALAARDKKRIAANVDTADIVERAHAGDALALEAVECFCAILGTFAGNLAVTLGALGGIYIGGGVVPKLGELFMRSPFRARFEAKGRFEAYLANIPTYLITAEYPAFLGVSAILAEQLSNRTGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVEQAIDILNNARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRAAPNAELAEAMARAKARAGASAGDEAADVLDWLSHGAAPAAKD

SEQ ID NO: 50066 - DNA, 960 bp, Chromohalobacter salexigens DSM 3043
  CDS (1)..(960): transl_table=11
atgacccgaccggcactgatcggcgatatcggcggcaccaatgcgcgcttcgccctggtgacgccgggggcgttcgaccttcatgacatcagaaccctgccctgcgcgcattatccttcgctgtccgacgcgattcgcgcctacctcaaggaggtgggcgccgagatgccgacggaagcctgcctcgccttcgcctgccccgtgcacgacgacgaggtccgcatgaccaacaatgcctggcgcttctccaaacgccaggtcgccgaggaattcggcttcaccctgttcaaggtcatcaacgacttcaccgcccaggccctgggcgtgccccacgtggcggacgacgaactcgtcgcgctcggggacggcgaggccgcgccggggtgcacgcgcttgatcttcggccccggcacgggccttggcatggcggggctctttcccggtcagcatgactggattccgctgcctaccgaaggcggccatatctccttcgcccccaccgatcaacacgaacgtgacctgctggcctattttcaggcacgctacgggcgcgtctcggtggagcgcattctctgcggccaggggcttctggacctgtaccgcgcgcatgctcaactggccaagcaggtcgcgcgctacaacaccccggcggaggtcaccggcgcggcccgggccggcgatcccctggcacgcaacgccctcgagcgattcctcaagattctcggcgacgtcagtggcgacgctgccctgatgctcggcgcgcgcggcggggtctatctgtgcggtggcattctgccgcgactgctcgactggctgccgcacagccacttccgcgatgctttcgccgacaaagggcgcatgcacgcgtacactgcccacattcccgtgtgggtggtcacggcaccctggaatgggctgctgggcgcctgcgaagcattacacaacgaggaggtgacatga

SEQ ID NO: 50067 - protein, 319 aa, Chromohalobacter salexigens DSM 3043
MTRPALIGDIGGTNARFALVTPGAFDLHDIRTLPCAHYPSLSDAIRAYLKEVGAEMPTEACLAFACPVHDDEVRMTNNAWRFSKRQVAEEFGFTLFKVINDFTAQALGVPHVADDELVALGDGEAAPGCTRLIFGPGTGLGMAGLFPGQHDWIPLPTEGGHISFAPTDQHERDLLAYFQARYGRVSVERILCGQGLLDLYRAHAQLAKQVARYNTPAEVTGAARAGDPLARNALERFLKILGDVSGDAALMLGARGGVYLCGGILPRLLDWLPHSHFRDAFADKGRMHAYTAHIPVWVVTAPWNGLLGACEALHNEEVT

SEQ ID NO: 50068 - DNA, 1047 bp, Crocosphaera watsonii WH 8501
  CDS (1)..(1047): transl_table=11
atgtctatattactcgctggcgatattggcggaactaaaactattttacgtttagttagttccgagaattctaaaaatagtgaaagtttacctcaacaaaccaccttatatgaaaactcctatcccagtcaagactacgatgatctcgttcccattgttcaagaattttatcaagaagctaagcaggaattaaaagaagaaatttctgtaaaaaatgcttgttttggtatcgctggtcccgtagttaataatacctcaaaattaacaaatttaaactggccagaattgacaggcgatcgcctagagaaaaaactatctctagaaagagttaatctaatcaatgattttgctgctattggttacggtattctagggttaaaaccagatgatttacataccttacaaggagcagaagcaaaacccaatactcctataggtgtgttgggtgcagggactggtttaggggaatgctttttaactccttcagaaagtggtaattatagtgtcttctctactgagggatcccatggagactttgccccacgaagcgaattagaatttgaattattaacctatattcgagataaatatagtttatccagagtttccatagaaaggatcgtgtctggaatgggaattagtgcaatttatcaatttttacgccataagtatcctgaaaaagaatccgataaattaaagaaaatttttcaaatttgggaaaatgaaaaaaatattgatctctctgctgaagtatctaaagcagctttagaaaatagggatagtttatgtcaacaaacaatggaaatatttatttcagcttacggcgcagaagcaggtaatttagctttaaaattgttaccttataatggtttatacatagcaggaggaattgcagctaaaatactaccattaatgcaaacaggaacctttatggaatcttttcaagctaaaggacgtatgagttcactattaactgaaatccccgttaatattatcttaaatcctaaagttggtttaattggggctgctttaagggctgcaaaataa

SEQ ID NO: 50069 - protein, 348 aa, Crocosphaera watsonii WH 8501
MSILLAGDIGGTKTILRLVSSENSKNSESLPQQTTLYENSYPSQDYDDLVPIVQEFYQEAKQELKEEISVKNACFGIAGPVVNNTSKLTNLNWPELTGDRLEKKLSLERVNLINDFAAIGYGILGLKPDDLHTLQGAEAKPNTPIGVLGAGTGLGECFLTPSESGNYSVFSTEGSHGDFAPRSELEFELLTYIRDKYSLSRVSIERIVSGMGISAIYQFLRHKYPEKESDKLKKIFQIWENEKNIDLSAEVSKAALENRDSLCQQTMEIFISAYGAEAGNLALKLLPYNGLYIAGGIAAKILPLMQTGTFMESFQAKGRMSSLLTEIPVNIILNPKVGLIGAALRAAK

SEQ ID NO: 50070 - DNA, 1017 bp, Desulfuromonas acetoxidans DSM 684
  CDS (1)..(1017): transl_table=11
gtgagtcgccggtttgtcgagttgttgattggaatgacaatgatcttgttggcaggtgatattggggggaccacatctcgttttcaatggttggacagtgagactccagagtctcagtccacgttgttctactatccgagcaaacgcttttcctcatttacggcactcttgaccaccctgttgtctgacagtggcatcactcaagtggatgtggcctgttttgggctgcccggtccagtgcagggctgccaggttgctttgaccaatctgccgtggaccattgatgcttgtgagctacaggagcaattgcctctgaaagagatttccctggtcaatgattttcaggcggctgcgctgggcattgatgcgttacgcgaagagaaaattctttgcctgcatcccggcgagtttgatccggcaggaaaccggctggtggttggtgccggaaccggtttgggcgtggcgccggtttatcagcttgaaggccatttttacccgcaatcttccgaaggggggcatatcgcctttgctccggttactgacgaacaatcgcggctcatggattggctgcatcgggaacggagccatatctcttatgaagacttgttgtccggcgaaggtttggggcgattgtaccgcttccattttcagcaacgcaacaatcgtcagccgacgcttttctccgccgcaatgattcacgaactggccgagcagggcgatgaagtcgccatcgccgctttacgcatgtttgtcaatatttacggtcagtttattggtgatgtggccctgatttggccggcgcgggccgggatctatatcgctggcggcattgctggaaagattatccgctggatgacccctgaggattttacctggtatttcctggccaaagaatcgatgaaccgtgtggttgaaaaaatgcctgtttatctggtcaaagatgagttgctcggtctcaaaggggcgatgcgatctgcccgacggttggccgggctggagagtgaaggagaggtatga

SEQ ID NO: 50071 - protein, 338 aa, Desulfuromonas acetoxidans DSM 684
MSRRFVELLIGMTMILLAGDIGGTTSRFQWLDSETPESQSTLFYYPSKRFSSFTALLTTLLSDSGITQVDVACFGLPGPVQGCQVALTNLPWTIDACELQEQLPLKEISLVNDFQAAALGIDALREEKILCLHPGEFDPAGNRLVVGAGTGLGVAPVYQLEGHFYPQSSEGGHIAFAPVTDEQSRLMDWLHRERSHISYEDLLSGEGLGRLYRFHFQQRNNRQPTLFSAAMIHELAEQGDEVAIAALRMFVNIYGQFIGDVALIWPARAGIYIAGGIAGKIIRWMTPEDFTWYFLAKESMNRVVEKMPVYLVKDELLGLKGAMRSARRLAGLESEGEV

SEQ ID NO: 50072 - DNA, 948 bp, Jannaschia sp. CCS1
  CDS (1)..(948): transl_table=11
atggttcccgcagctctttcgctggtggccgatatcggtggcaccaacacccgtgtggccctggcccatggggccgaggtccaggtcgatagcgtgcggcgctaccgcaatgccgagtttgatggaataggctctgtcatcgcccggtatctgggcgacagtagccagaatcatacctttattacaggggtttgcgtcgcaatggcggggcctgtccatgacggggtcggcaccctgaccaatctggactggcgcatcgacaaggcagttctggcagaggcgttgagtgccgagcgcgtcgccgtgttgaacgatttgcaggcccagggccacgcgattggccacatcgcggccaccgatctggcggaggttttgccgcagccggaggtggcggcaacggcggcgaaactggtcatcggcctgggcaccgggttcaacgcctgcccggtgtttgacaccgccgccggccgcttcgtgccgccgtcggaagccgggcatgtgagcctgcccacatctattgccgagctgcacccgatgctgagcaagctgtcggattcccgcggatatccgtcggtggaagaggtgctgtcggggcgcggtgtcagccagttgcacgcggccctccacggggaagtcattgatcccgctgatattttatctcgtatcggcgatggtgaggcacaggcctgcgataccggcgcgctgtttgtgaaggtgttgggggacgttgcgggcaatctggtgctgtcgcatctgcccttcggcggcgtgttccttgtgggcggcgtgacgcgggcctttgcgccctatctggaccagttcggatttgtggaggcgttccggtccaagggccggttttcgaccttcatggagcagtttggcgtgtcggtcgtcagcgacgattatgccgcgctgacgggctgcgcgagccatctgtcgcggggctga

SEQ ID NO: 50073 - protein, 315 aa, Jannaschia sp. CCS1
MVPAALSLVADIGGTNTRVALAHGAEVQVDSVRRYRNAEFDGIGSVIARYLGDSSQNHTFITGVCVAMAGPVHDGVGTLTNLDWRIDKAVLAEALSAERVAVLNDLQAQGHAIGHIAATDLAEVLPQPEVAATAAKLVIGLGTGFNACPVFDTAAGRFVPPSEAGHVSLPTSIAELHPMLSKLSDSRGYPSVEEVLSGRGVSQLHAALHGEVIDPADILSRIGDGEAQACDTGALFVKVLGDVAGNLVLSHLPFGGVFLVGGVTRAFAPYLDQFGFVEAFRSKGRFSTFMEQFGVSVVSDDYAALTGCASHLSRG

SEQ ID NO: 50074 - DNA, 1086 bp, Desulfitobacterium hafniense DCB-2
  CDS (1)..(1086): transl_table=11
ttgccttatgcaggcattgaaaaaggccaactatacttggctggagacattggcggaaccaaaactctcctaggactttattccctggaaggcactgagcttgtcttagtcagggaaaggaatttccccagtaaagactggcaggacttaacagcgcttatacaaggatttttagatgaaatagccctaacgcctgaagacataaccggaggctgcctcagcctggccgggcccatcactcaagacaaatgttttctcaccaatttgaatcgggtgattgattgccctgacttgcggtcctccctgccattgcgcaggcccctgcttttggtcaacgaccttgaggctatggggcagggccttatggatttaagaggggaagatttaatttgtctcaacccttccgcagagagtccttcctcttcccttgcctcgtctcctgccctttccctcgccaggccctcacttaaccgggcactgatcgcccccggtacaggcttgggtcaggccatgatcctggctgacgggcgggtttgcgccacagaaggcgcccatggggactatgccccccgcaccgagcaggaagtacggttgtggcgctttctggcccaacgatacggtcatgtcagctatgagagagtcctctccggtcccgggctggcagatctctatcgttttctgtactgggaggctctttccccctctctccctggcccggcctctgactctatccctgctcctgattctagccttactcctgccgagatcacaaaaaaagccctcgacggaatctgtacactctgtacagaaacattggagctctttgtgaaaattctgggggcggaagcaggcaatctcgctttaaggactttggcctatggaggaatctatctgggcgggggcatcccccctaaaatcctgcccaagcttcaggaagatggcttcatggaggcctttctcgctaaaggccgtttgagagagcttttatcccagatccctatctatgtgatccttaatgaaaggactcctttgctgggagccgcccgtttggcggtggcagccgggtatccttttacatgctcttaa

SEQ ID NO: 50075 - protein, 361 aa, Desulfitobacterium hafniense DCB-2
MPYAGIEKGQLYLAGDIGGTKTLLGLYSLEGTELVLVRERNFPSKDWQDLTALIQGFLDEIALTPEDITGGCLSLAGPITQDKCFLTNLNRVIDCPDLRSSLPLRRPLLLVNDLEAMGQGLMDLRGEDLICLNPSAESPSSSLASSPALSLARPSLNRALIAPGTGLGQAMILADGRVCATEGAHGDYAPRTEQEVRLWRFLAQRYGHVSYERVLSGPGLADLYRFLYWEALSPSLPGPASDSIPAPDSSLTPAEITKKALDGICTLCTETLELFVKILGAEAGNLALRTLAYGGIYLGGGIPPKILPKLQEDGFMEAFLAKGRLRELLSQIPIYVILNERTPLLGAARLAVAAGYPFTCS

SEQ ID NO: 50076 - DNA, 972 bp, Sphingopyxis alaskensis RB2256
  CDS (1)..(972): transl_table=11
atgcgcgaacagatcgtcacggtcgatattggcggcacgcacgcccgttttgctatcgccgagatcgagggtgggcgcgtccgttcgctgggcgaagcgacgacgctgcatacaaaggatcatgcgagcttccagacagcgtggcaggatttcgaaggccggcaaggcggcaccctgccacgcgcggtcgcgatcgcgatcgccggcccgacgcgcggcgaaatcatccgcttcaccaacaatccgtggattatccgtcccgcgctgatcggcgaaaagctgaatgtcgaccgccatatactcgtcaatgatttcgaggcggtgggccatgccgtcgcgcaggccgacgagagctatttcgggcggctgaccggccccgacgagccgctgccggccaccggcacgatcagcgtcatcggacccggcaccgggcttggcgtcgcgcatatctggcgcgatgagagcggctatcgcgtgcaggcgaccgagggcgggcatatcgacttcgcaccgctcgacagcatcgaggacgcgatcctcgcgcggctacgcaagcggcaccgccgcgtatcggtcgagcgcgtcgtgtctggccccggcatcgtagacatttacgaaacgctcgccgcactcgaaggacgcgcggtgacaccgctcgacgacaaggcgatctgggccgctgcgctgagcggcggggacagtcttgccgcggcggctgccgatcgcttctgcctctcgctcggcagcgtcgcgggtgatctcgcgctggcgcagggggcgagcggggtggttatcgcgggcggtctgggtctgcgcattcgcgatagcctggtgcgatcgggctttccggaacgctttatcgaaaaggggcggttcgaggggttcatggcggcgctgccggtaaagctcatcacgcatccgcagccggggctgttcggcgctgcggctgcctttgctcgccagcatggctga

SEQ ID NO: 50077 - protein, 323 aa, Sphingopyxis alaskensis RB2256
MREQIVTVDIGGTHARFAIAEIEGGRVRSLGEATTLHTKDHASFQTAWQDFEGRQGGTLPRAVAIAIAGPTRGEIIRFTNNPWIIRPALIGEKLNVDRHILVNDFEAVGHAVAQADESYFGRLTGPDEPLPATGTISVIGPGTGLGVAHIWRDESGYRVQATEGGHIDFAPLDSIEDAILARLRKRHRRVSVERVVSGPGIVDIYETLAALEGRAVTPLDDKAIWAAALSGGDSLAAAAADRFCLSLGSVAGDLALAQGASGVVIAGGLGLRIRDSLVRSGFPERFIEKGRFEGFMAALPVKLITHPQPGLFGAAAAFARQHG

SEQ ID NO: 50078 - DNA, 1011 bp, Ralstonia metallidurans CH34
  CDS (1)..(1011): transl_table=11
atgacggatcgcgcgatgtcctatccccggatcctggccgacgtgggcggcaccaacgtgcgctttgccatggagacggcgccgatgcggatcggcgagatcaccgcatacaaggtggccgagcacgcctcgctcgaagccgcgatgcggctctacatgctgacgcgtagcggcgcggcccggccgcgccatgcggccatcggcctggccaatccggtcactggtgaccaggtcaagctgaccaaccacaactgggcgttctccgtcgaggccatgcgccgcgcgctcgatctcgacacgctggtggccatcaacgacttcacctcgctggcgctggcgctgccgtatctgcccgacgccagccttgtgcaggtacgcgacggcacggcggtggccacggcgccccgggccttgatcgggccgggaaccggccttggcgtatccggcctgattcccgcgccgggtggcgcggtggcgctggcgggcgagggcggacacatcgagatcatgccggtcaccgacgacgagtggatcgcctggcgcgccgcccacgatcagtttgggcgcgtgtcggcggagcggctgctgtcgggtatgggtctctcgcatattcatgccgcgctgtccgcagaaatgggtacgcctctggaggtgccgctggcaccggcgcaggtgacggacggcgcgatgcgcgcgggcgacccggtatgccgccgcgctttcgacgcgttctgcgggatgctcggctcggttgccgccgatgtcgcgctggtgctcggcgcacgtggtggcgtctatctcggcggtggtatcgttccacgctttgtcgatgccctacgggcgtcgacgttcgcggagcgctttgtcgccaagggccgcatgggcagtttccttgccgatgtgccggtgtacgtgatcacggccgagtatccggcgctgccgggcctggctcgcgcactggcggatcggcttgaagccgacgcgcgccgcgccgagacctctcaatcctga

SEQ ID NO: 50079 - protein, 336 aa, Ralstonia metallidurans CH34
MTDRAMSYPRILADVGGTNVRFAMETAPMRIGEITAYKVAEHASLEAAMRLYMLTRSGAARPRHAAIGLANPVTGDQVKLTNHNWAFSVEAMRRALDLDTLVAINDFTSLALALPYLPDASLVQVRDGTAVATAPRALIGPGTGLGVSGLIPAPGGAVALAGEGGHIEIMPVTDDEWIAWRAAHDQFGRVSAERLLSGMGLSHIHAALSAEMGTPLEVPLAPAQVTDGAMRAGDPVCRRAFDAFCGMLGSVAADVALVLGARGGVYLGGGIVPRFVDALRASTFAERFVAKGRMGSFLADVPVYVITAEYPALPGLARALADRLEADARRAETSQS

SEQ ID NO: 50080 - DNA, 1029 bp, Mesorhizobium sp. BNC1
  CDS (1)..(1029): transl_table=11
atggcgtattccaccgaccatgacgtggtgctcgatttcccgattttgatcggtgacatcggcggcaccaatgcgcgcttcgccattgtcgtggactcctatgccgagccgcgggaatttcccgtcgtacagacggccgatttcgcaacgatagaggacgccatccagacggcgatccttgaccagacgcatctcattccgcgctccgccgtcctggcggttgcgggacccgtgaacggagacgaaatcgatctcaccaattcaaattgggtggtccggccgcgcgagatgatggcccatctgggtttcagcgatatcgtcgtactcaacgatttcgaggcgcaggcgctggctgtcgtggcgcttggggaagagcatctggaaaagattggcggcaacgtcgccgaaaccgtcgggagccgcgtcgtcctggggccggggaccggcctcggcgtggctggcctggtgcacgcgcgccgaacctggatccccgttccgggcgagggcggccatatggatcttggaccaaggacagcgcgcgacgagcagatcttcccgcatctggagcggatcgaggggagggtttccggcgaacaggtgctttgcgggcgcggtctcgtcaacctctaccgtgcgatcgcaaaggcggatgccaaggaggctgctttctcctcgcccgctgagattacgacggccgggctggcgcaggccgatgagatcgcggttgagaccctgaacctcttcgtgacctatctcggcagggtcgcgggtgatctcggtcttgtgttcatgagccggggcggagtgttcctgacaggaggcatcgcccagaagatcgtgccggcgctgaagaacagcctgttccgcgccgcctttgaagacaaggcgccgcacaatgaactgatggcgtccatgccggtttatgtcatcacccatccgctggccgcgctgcacgggcttgcggcctatgcccgaacgccagcgcgcttcggcgtcgaaacggcgggccggcgctggcgcttgcgctga

SEQ ID NO: 50081 - protein, 342 aa, Mesorhizobium sp. BNC1
MAYSTDHDVVLDFPILIGDIGGTNARFAIVVDSYAEPREFPVVQTADFATIEDAIQTAILDQTHLIPRSAVLAVAGPVNGDEIDLTNSNWVVRPREMMAHLGFSDIVVLNDFEAQALAVVALGEEHLEKIGGNVAETVGSRVVLGPGTGLGVAGLVHARRTWIPVPGEGGHMDLGPRTARDEQIFPHLERIEGRVSGEQVLCGRGLVNLYRAIAKADAKEAAFSSPAEITTAGLAQADEIAVETLNLFVTYLGRVAGDLGLVFMSRGGVFLTGGIAQKIVPALKNSLFRAAFEDKAPHNELMASMPVYVITHPLAALHGLAAYARTPARFGVETAGRRWRLR

SEQ ID NO: 50082 - DNA, 963 bp, Silicibacter sp. TM1040
  CDS (1)..(963): transl_table=11
atgtggaatctgatcgctgacgtcggcggaacaaacatgcggctggcggccgtgaatgcggagggggagatcctcgagcaagcccggtatgacagcaagggcacgcagaaccttgaagaggcctgtgcagattttgcagcccatcgcggcagcgcgcctggccgtgccgtcattgcggcggcaggtgtggtgcggggcggctccgttcagttgaccaacgccaaccagagtttttccgaacgcgggattgccgtagccctgcaaaccgagcgggtcaaagttctgaatgactttgaagccgctgcctggtcactggcttcggtgagtgcgggggatgtgaccgtgctgcaggggcaggcggtgtttcccaaggaaccctgtctgatcatcggcccgggcaccgggcttggcgtgggggccctgatttgggccaatggcgaaccctgcgttgtccccggcgaaggggggcatgttgccatcggcccgcgcacggccgatgaggtcgcgatctttgaggcgttgcgcgaggaatggcccgagatcggcatggggccggggcttgcggtagaggccgaaggcatcctctcgggcacagggttgccttacttttaccgcgcggttgcgcgcagcatggagctgaccgcgccgctcacgactggggcggagatttttcagtccgcgcaggcccggctcgacaccgcagcggtgcgtgcggtgtcgctctttgcgcagtatctcgccggagtcgcgggggatctcggtctcgtcttcgcggccaaagggggcgtgttcgtcaccgggggcgttgccgccgcaaacccgtggatctttgatgcggcctttgtggaggcgttcaacgcgggtgggcgccacaccgcgtggcgcgaagagctgccgctgcatctctatcatcagcccaatttcggcctgatcggcgcgcgcaattatctgcgcgcccgctga

SEQ ID NO: 50083 - protein, 320 aa, Silicibacter sp. TM1040
MWNLIADVGGTNMRLAAVNAEGEILEQARYDSKGTQNLEEACADFAAHRGSAPGRAVIAAAGVVRGGSVQLTNANQSFSERGIAVALQTERVKVLNDFEAAAWSLASVSAGDVTVLQGQAVFPKEPCLIIGPGTGLGVGALIWANGEPCVVPGEGGHVAIGPRTADEVAIFEALREEWPEIGMGPGLAVEAEGILSGTGLPYFYRAVARSMELTAPLTTGAEIFQSAQARLDTAAVRAVSLFAQYLAGVAGDLGLVFAAKGGVFVTGGVAAANPWIFDAAFVEAFNAGGRHTAWREELPLHLYHQPNFGLIGARNYLRAR

SEQ ID NO: 50084 - DNA, 951 bp, Nitrobacter hamburgensis X14
  CDS (1)..(951): transl_table=11
atgaccgccttgcgggtaatcggcgacatcggcgggacctacgcccgattcgctgtcgcagaacgcggaaagtacagtgagcttcagcatctgagcgtgagcaaatacgctgccttgaaggacgcactcggcgagtatttggctgcgctgcctcgcgacctgcgacccaccagaggagcgcttgcagttgccggtcctgtgtccggagatgaggtgaaactgaccaacctcaactggtctttctcaataaccgcactcaaggccgacttgggtatgagctcactcgtcgttgtcaacgatttcgccgctaccgcaatgtcggttccttatctcccggaagccgactgctatccgataggaccgcctcaatcgaagacgagcggcccggtcggcgtcatcggacccggtactggtctcggggttagcgcgctggttccggacgccggcagatggatcttgctacctggcgaaggcggacattcgacgttgccgccggctacgcaagcggaaagtctcatcgttgaagtacttcgaacccattggccgcatgtctcggcggagcgcgcactctcgggcgcgggcctggtgaatctctatcaggcactctgttcaatagaaggcaaacgtcctgatccgttatcgccggcagatgtgaccgatcgggcaatgcggggaagcgatccgacctgcgtgaaagcattcgaggttttctgttcaatgctggggacagtggccggcgatctagcgctcaccataggcgcaacgggtggcatctacatcgcaggtgggattctgctccgcttcaaggaggcatttgcctcctctccgtttcgggaccgtttcgaagacaagggtcggttccaagactatcttcgcagaattccgactctccttattctagaggaatcgcccgcgcttctaggtcttgccaatcttccacttgagccgtga

SEQ ID NO: 50085 - protein, 316 aa, Nitrobacter hamburgensis X14
MTALRVIGDIGGTYARFAVAERGKYSELQHLSVSKYAALKDALGEYLAALPRDLRPTRGALAVAGPVSGDEVKLTNLNWSFSITALKADLGMSSLVVVNDFAATAMSVPYLPEADCYPIGPPQSKTSGPVGVIGPGTGLGVSALVPDAGRWILLPGEGGHSTLPPATQAESLIVEVLRTHWPHVSAERALSGAGLVNLYQALCSIEGKRPDPLSPADVTDRAMRGSDPTCVKAFEVFCSMLGTVAGDLALTIGATGGIYIAGGILLRFKEAFASSPFRDRFEDKGRFQDYLRRIPTLLILEESPALLGLANLPLEP

SEQ ID NO: 50086 - DNA, 1065 bp, Paracoccus denitrificans PD1222
  CDS (1)..(1065): transl_table=11
gtgatcgacggaaaaacccgcgccgacccgccggggttcccgaaaagttctggcagggatgcgaatgtgagcgctagcaggatcgtgccggatggcttagaagggcccgaacgaggctacgcggcaaaggggggggaaggcatggcgatcctgttggcggatgtgggcggcaccaatgcgcggatggcgctggcgcgggacggcgcgcttgcgtccgggaccatcacccggtttcgcggcgacgaccatgccagcttcgacgaggtggtgacgaagttcctggcccagcagggcagcccgcggatcgacgcggtctgcgtcgccgtcgccggcccggtctggggtgacgaggcgcggctgaccaatcgcgactggaccttttccgaggcgcggctttgcgcgctgtccggcgccccgcgcgcccggctgatcaacgacctgaccgccctgggctatgccacgcccgcgctggacggcgaggcggcgggtttcctgcgcgcggcgcccgagggtgcgttgtcgaacggccagcggctggtggtgaatgccggcaccggcttcaacgtctgcgcggtcaaggtgctgccggacggcgggatcgcctgcctcgaggccgaggaaggccatacccgcctgccgctttcggtggccgatccgctggccgaggcactgggcgatgccggccgtgcgattgattcggtcgaggagctgttcgccggccgcggccttgcccggctgcacgcgctgcgcatgggcacgccgcagggccgggccgaaaccgtggttgccgccgccgccgaaggcgatggcgcggccgaggaaacgctggcgctttatgcccggctgttcgggctcctctgccgcgaacttgccttgcgattcatgccgatggacgggatgttcctggccggcagtgtcgcccgctcctgtaccgatcggttcgaaattttcgagcgcgccttcctctccgacccgctgatggcgcggattccgcaggcggtcccggtcggcgtgatccgcgacgacatggccgcgctgcatggctgtctggccgcaatccgctga

SEQ ID NO: 50087 - protein, 354 aa, Paracoccus denitrificans PD1222
MIDGKTRADPPGFPKSSGRDANVSASRIVPDGLEGPERGYAAKGGEGMAILLADVGGTNARMALARDGALASGTITRFRGDDHASFDEVVTKFLAQQGSPRIDAVCVAVAGPVWGDEARLTNRDWTFSEARLCALSGAPRARLINDLTALGYATPALDGEAAGFLRAAPEGALSNGQRLVVNAGTGFNVCAVKVLPDGGIACLEAEEGHTRLPLSVADPLAEALGDAGRAIDSVEELFAGRGLARLHALRMGTPQGRAETVVAAAAEGDGAAEETLALYARLFGLLCRELALRFMPMDGMFLAGSVARSCTDRFEIFERAFLSDPLMARIPQAVPVGVIRDDMAALHGCLAAIR

SEQ ID NO: 50088 - DNA, 957 bp, Pseudomonas fluorescens
  CDS (1)..(957): transl_table=11
gtgaaactggccctggtcggtgatatcggtggcaccaacgcgcgcttcgcgttgtggaaagaccaacaactggaggcgatcgaagtccacgccaccgcggactacagctgcccggaagacgccatcaaggcctacctgcgggaccaggggctggccctgggtgccataggttcggtgtgcctgtcggtggccggcccggtcagcggcgatgagtttcgcttcaccaacaaccactggcgcctgagccgccaggctttctgccaggctttgcaggtggaccaactgctgttggtcaatgacttctcggccatggccctgggcatgacccgcctgcagccggatgaatttcgcgtggtctgcgaaggcgttgccgagcccttgcgcccggccgtggtgatcggcccgggcacgggcctcggggtgggcaccctgctgaacttcggcgacggtcgttacatggccttgccgggagagggcgggcatgtcgacctgcccttgagcagtgcgcgggaaacccagctctggcagcacattcacgacgagatcggccatgtcagcgccgagaccgccctcagcggtggcggcctgccccgggtgtatcgggcgatctgtgcggtggacggccatgagccgcggctcgagactccggaggccatcaccgcggccggcctggccggcgacccgatcgcccgggaagtgctggagcagttcagctgctggctgggccgggtggcgggcaacaacgtgctgaccaccggggggcgtggcggggtgtacatcgtcggtggggtgattccgcgctttgccgatttcttcatccacagcggctttgccaagagctttgccgacaagggttgcatgagcgattacttcaagggcatcccagtgtggctggtgaccgcgccctattccgggctcaccggtgccggcgtggccctggagcaggcccagggctga

SEQ ID NO: 50089 - protein, 318 aa, Pseudomonas fluorescens
MKLALVGDIGGTNARFALWKDQQLEAIEVHATADYSCPEDAIKAYLRDQGLALGAIGSVCLSVAGPVSGDEFRFTNNHWRLSRQAFCQALQVDQLLLVNDFSAMALGMTRLQPDEFRVVCEGVAEPLRPAVVIGPGTGLGVGTLLNFGDGRYMALPGEGGHVDLPLSSARETQLWQHIHDEIGHVSAETALSGGGLPRVYRAICAVDGHEPRLETPEAITAAGLAGDPIAREVLEQFSCWLGRVAGNNVLTTGGRGGVYIVGGVIPRFADFFIHSGFAKSFADKGCMSDYFKGIPVWLVTAPYSGLTGAGVALEQAQG

SEQ ID NO: 50090 - DNA, 1032 bp, Giardia lamblia ATCC 50803
  CDS (1)..(1032)
atgccatattcgctttctggtgacctgggcggcactaagtgctttcttgccattcacgacctcgatgtcctgaagaccgatcctcgtgccgctcctctccttgagcacgagctcctttgcaaagactatcaatctacgggagacctcatcaacgatttcctcaagcgctgggatagggagacgcccatcgttggctgcctcggcgtagctggtcccgtaaccaatggacgagtgtgcattacaaacttagactggaacgagagcgaagaggagctgcagaacacgacaggcgtgggcaaaatgaagcttatcaacgactttgcggccatcggctacgggcttctggctatccgtcctgacgactatctcgactttgacgcaagaaacggctccgtgagtacccctactgtcgttccggacaactcgaccgggatcgtctcctacgcaggtgctgggacaggctttggcgttggatttgtcgctgatggagtcgcatacgcagctgagggcgggcacacgacgttttctcccatggaagccgaagaccatgcacttgcgcaattcatcaaggaaaagtacaacacggatcatgtcagtttcgagcgcgttgtctctggtcttggtcttcgcaatatgcacgacttcttctggaagaatttgagtggtctggcgagtcctgtgctccgagaacacgtgctctccagagaccacgacatcgacatgggcttccttgccaaatgtgcggagacaggggataagtatgcactcaagattttcaagaaattcttttactattacggcttctaccttggcaacatctgtgtcctcttcaggcccaaggattacttcattgccggtgggattctggccaaggatctcaaccttgtttgcggaccctgccgtgaggatttctgtcgtgggctgtacacaaaggggcgaatgtcccacctgccaaatggagtgtcgttccatgttgtgacaaaccagaagctcggcattgttggagctgcttatttctgtactaagatgtag

SEQ ID NO: 50091 - protein, 343 aa, Giardia lamblia ATCC 50803
MPYSLSGDLGGTKCFLAIHDLDVLKTDPRAAPLLEHELLCKDYQSTGDLINDFLKRWDRETPIVGCLGVAGPVTNGRVCITNLDWNESEEELQNTTGVGKMKLINDFAAIGYGLLAIRPDDYLDFDARNGSVSTPTVVPDNSTGIVSYAGAGTGFGVGFVADGVAYAAEGGHTTFSPMEAEDHALAQFIKEKYNTDHVSFERVVSGLGLRNMHDFFWKNLSGLASPVLREHVLSRDHDIDMGFLAKCAETGDKYALKIFKKFFYYYGFYLGNICVLFRPKDYFIAGGILAKDLNLVCGPCREDFCRGLYTKGRMSHLPNGVSFHVVTNQKLGIVGAAYFCTKM

SEQ ID NO: 50092 - DNA, 1035 bp, Agrobacterium tumefaciens
  CDS (1)..(1035): transl_table=11
atggaacaggcaatgccgaagacgtccgataccgaatatctgtcctttccgatccttcttggcgacatcggcggcaccaatgcccgcttttccatcctgatcgattcctttgctgaaccggtgcacctcaccacggtgaagacggcggaatatcctggtatcgatgacgcgatccagcaggcggttctggacaagacctctcttcagccggtctcgaccattcttgcaattgccggcccgatcgaaggcgacgagattccgttgaccaactgccactgggtcgtcaagccgaaggacatgctggccaagctcggcctgaaggacgtcatcgtcatcaacgactttgaggcgcaggctctggcgattgcggctcttgacgacgacaaccgggagcctatcggctccggtaaaaaggacatgctggcgtcgcgcgtcgttcttggaccgggcacggggcttggcgtcgccgggctggtctatgcccgccatatgtggtttccggtgcctggcgaaggcgggcatatcgatatcggcccgagaagcgcgcgcgactatgtggttttcccccatatcgaaaccatcgagggccgcgtcgccggcgaacagatcctgtgcggacgcgggctggtcaatctttatcgggccatctgcaaagccgacggcatcgagcctgtcttttccgatccggccgacatcacctcgcaggggctttcgggccagaacgcgcaggcaaaagaaacgctgtcgctgttcagcacctatctcggccgcgtggcgggcgaccttgcgctgatcttcatggccaagggcggcgtttatctggccggcggtatttcgcagaagatcatccctgcgctgaagagcccggaattccgggcggcgttcgaagacaaggcgccgcacagcgctctgatgcggaccattccgacattcgtcgtcacccatcctcaggcggccctttccggcctcgccacctatgcgagaacgcctgccgatttcggtcttgcgctggacgggcggcgctggagggcttga

SEQ ID NO: 50093 - protein, 344 aa, Agrobacterium tumefaciens
MEQAMPKTSDTEYLSFPILLGDIGGTNARFSILIDSFAEPVHLTTVKTAEYPGIDDAIQQAVLDKTSLQPVSTILAIAGPIEGDEIPLTNCHWVVKPKDMLAKLGLKDVIVINDFEAQALAIAALDDDNREPIGSGKKDMLASRVVLGPGTGLGVAGLVYARHMWFPVPGEGGHIDIGPRSARDYVVFPHIETIEGRVAGEQILCGRGLVNLYRAICKADGIEPVFSDPADITSQGLSGQNAQAKETLSLFSTYLGRVAGDLALIFMAKGGVYLAGGISQKIIPALKSPEFRAAFEDKAPHSALMRTIPTFVVTHPQAALSGLATYARTPADFGLALDGRRWRA

SEQ ID NO: 50094 - DNA, 1029 bp, Anabaena sp
  CDS (1)..(1029): transl_table=11
atgaccttattgttagcaggagatatcggcgggacgaaaacgattttgcgattggtagaaatatcaaattcgtcggaactgcacaatatttatgaggaaagttaccagagtggggattttccagatttagtgccgatggtgcagcaattcttagtcaaggctaatatacctagtcaccccgaaaaggcttgctttgcgatcgctggccctgtggtgaataatactgccaaactgaccaatttagtctggtttttggacactgaacggctagcacaagaattaagtattcccttcatttccttaattaatgattttgctgctgttggctatgggatttttgggttaaataaacaagacttgctgaccttacaagctggtaaacatcaaccagaagcacctattgctattattggtgctggcactggattaggacaaggatttttaattaaacagggaaaccagtatcaagttttcccctcggaaggtggacacgccgactttgccccccgcaacgagttagagtttcagttgttgaaatatctgctggataaacatgatatccagcgcgtttctgtggaaagggtggtttctggacaggggattgtcgccatttatcaatttttacgcgatcgcaaactcgctacagaatcgccagaaattgctcaagttgtccgcacttgggaacaacaagcaggacaggctgaaaaaaccgttgatcctggtgcggctattggtaaagccgcagtccaaggaagcgatcgcctttcggaacaagccctacaattatttatcgatgcttacggtgcagaagcgggaaatcttgccctcaaactcctaccatacggcggcttgtacattgcgggtgggattgcgcctaaaatcctacctttgattgaaaatagcaattttttgcttaatttcagccaaaaaggcagaatgcgtcctctgctagcagaaataccggtgcatattattctcaatcaacaagtgggactcataggtgctgctttgtgtgctgctaggttataa

SEQ ID NO: 50095 - protein, 342 aa, Anabaena sp
MTLLLAGDIGGTKTILRLVEISNSSELHNIYEESYQSGDFPDLVPMVQQFLVKANIPSHPEKACFAIAGPVVNNTAKLTNLVWFLDTERLAQELSIPFISLINDFAAVGYGIFGLNKQDLLTLQAGKHQPEAPIAIIGAGTGLGQGFLIKQGNQYQVFPSEGGHADFAPRNELEFQLLKYLLDKHDIQRVSVERVVSGQGIVAIYQFLRDRKLATESPEIAQVVRTWEQQAGQAEKTVDPGAAIGKAAVQGSDRLSEQALQLFIDAYGAEAGNLALKLLPYGGLYIAGGIAPKILPLIENSNFLLNFSQKGRMRPLLAEIPVHIILNQQVGLIGAALCAARL

SEQ ID NO: 50096 - DNA, 1032 bp, Brucella abortus
  CDS (1)..(1032): transl_table=11
atgcaagcgattatcgacgccgaacagagtttcaagtttccggttctcgtcggcgatatcggcggcaccaatgcccgtttttctatcctcgtggattcaaacgcggagccgaaggagtttcccgtgctccagacggcggattatgccacaatagacgaagcgatccagcacgccattctggatcagacggccatccagccgcgctctgtcattctggccgtggcaggcccggtggacggcgacgagatcgacctcaccaattgcgactgggtcgtgcgtcctaaaaagatgatcgctgatctgggctttgaagacgtgaccgtcctcaatgatttcgaggcgcaggcccttgccgtggtttcgctggaaggccaccatatggaacagatcggcggcaaaccggaggaggctgttgccacccgcgtcgtgctcggccccggcacgggccttggcgtggcaggtctgtttcgcacacgtcatgcatgggttccggttcccggtgaaggcggtcatatcgatatcggtccacgcaccgaacgcgactaccagattttcccgcatatcgaacgcatcgaagggcgtgtcaccggcgagcaaattcttagcgggcggggcctgcgcaacctctatctgggcatctgcgccgccgacaagatcacgcccacccttgagacgccagtagacattacatccgccggactggacggcagcaatccacaagccgcagaaacgcttgacctcttcgccacctatctggggcggcttgcgggcgaccttgcgctcattttcatggcgcatggcggcgtttatctttcgggtggcatcccggtgcgcatcctttccgccctcaaggccggttcgttccgcgcaaccttcgaggacaaggccccgcacaaggccatcatgcgcgacataccggtccgcgttatcacatatcaactggcggccttaaccgggctttccgctttcgcccgcaccccctcgcgctttgaagtttcgaccgagggccgccgctggcgcatgcgccgctag

SEQ ID NO: 50097 - protein, 343 aa, Brucella abortus
MQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLFRTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRATFEDKAPHKAIMRDIPVRVITYQLAALTGLSAFARTPSRFEVSTEGRRWRMRR

SEQ ID NO: 50098 - DNA, 1032 bp, Brucella melitensis
  CDS (1)..(1032)
atgcaagcgattatcgacgccgaacagagtttcaagtttccggttctcgtcggcgatatcggcggcaccaatgcccgtttttctatcctcgtggattcaaacgcggagccgaaggagtttcccgtgctccagacggcggattatgccacaatagacgaagcgatccagcacgccattctggatcagacggccatccagccgcgctctgtcattctggccgtggcaggcccggtggacggcgacgagatcgacctcaccaattgcgactgggtcgtgcgtcctaaaaagatgatcgctgatctgggctttgaagacgtgaccgtcctcaatgatttcgaggcgcaggcccttgccgtggtttcgctggaaggccaccatatggaacagatcggcggcaaaccggaggaggctgttgccacccgcgtcgtgctcggccccggcacgggccttggcgtggcaggtctggtttgcacacgtcatgcatgggttccggttcccggtgaaggcggtcatatcgatatcggtccacgcaccgaacgcgactaccagattttcccgcatatcgaacgcatcgaagggcgtgtcaccggcgagcaaattcttagcgggcggggcctgcgcaacctctatctgggcatctgcgcggccgacaagatcacgcccacccttgagacgccagtagacattacatccgccggactggacggcagcaatccacaagccgcagaaacgcttgacctcttcgccacctatctggggcggcttgcgggcgaccttgcgctcattttcatggcgcatggcggcgtttatctttcgggtggcatcccggtgcgcatcctttccgccctcaaggccggttcgttccgcgcagccttcgaggacaaggccccgaacaaggccatcatgcgcgacataccggtccgcgttatcacatatcaactggcggccttaaccgggctttccgctttcgcccgcaccccctcgcgctttgaagtttcgaccgagggccgccgctggcgcatgcgccgctag

SEQ ID NO: 50099 - protein, 343 aa, Brucella melitensis
MQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLVCTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRAAFEDKAPNKAIMRDIPVRVITYQLAALTGLSAFARTPSRFEVSTEGRRWRMRR

SEQ ID NO: 50100 - DNA, 1032 bp, Brucella suis
  CDS (1)..(1032)
atgcaagcgattatcgacgccgaacagagtttcaagtttccggttctcgtcggcgatatcggcggcaccaatgcccgtttttctatcctcgtggattcaaacgcagagccgaaggagtttcccgtgctccagacggcggattatgccacaatagacgaagcgatccagcacgccattctggatcagacggccatccagccgcgctctgtcattctggccgtggcaggcccggtggacggcgacgagatcgacctcaccaattgcgactgggtcgtgcgtcctaaaaagatgatcgctgatctgggctttgaagacgtgaccgtcctcaatgatttcgaggcgcaggcccttgccgtggtttcgctggaaggccaccatatggaacagatcggcggcaaaccggaggaggctgttgccacccgcgtcgtgctcggccccggcacgggccttggcgtggcaggtctggttcgcacacgtcatgcatgggttccggttcccggtgaaggcggtcatatcgatatcggtccacgcaccgaacgcgactaccagattttcccgcatatcgaacgcatcgaagggcgtgtcaccggcgagcaaattcttagcgggcggggcctgcgcaacctctatctgggcatctgcgccgccgacaagatcacgcccacccttgagacgccagtagacattacatccgccggactggacggcagcaatccacaagccgcagaaacgcttgacctcttcgccacctatctggggcggcttgcgggcgaccttgcgctcattttcatggcgcatggcggcgtttatctttcgggtggcatcccggtgcgcatcctttccgccctcaaggccggttcgttccgcgcagccttcgaggacaaggccccgcacaaggccatcatgcgcgacataccggtccgcgttatcacatatcaactggcggccttaaccgggctttccgctttcgcccgcaccccctcgcgctttgaagtttcgaccgagggccgccgctggcgcatgcgccgctag

SEQ ID NO: 50101 - protein, 343 aa, Brucella suis
MQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLVRTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRAAFEDKAPHKAIMRDIPVRVITYQLAALTGLSAFARTPSRFEVSTEGRRWRMRR

SEQ ID NO: 50102 - DNA, 996 bp, Caulobacter crescentus
  CDS (1)..(996): transl_table=11
atggacggcaatcacagcggcgggctcggcctcgtcggcgacatcggcggtacgaacgcccgcttcgccctggtcgagttcgacggtcaggacccgcgcctgatcgagccgacggcctataggggcgaggactacggcacggccgaggacgccatcgaggagtatctccgcaaggtcggtgtcaagcatcctgaccaggcggtggtcgctgtggccgggccgatcgaccacggtcaggtccacatgaccaatctggactggcggatctccgaggacggcctgcgccgcgcaggcggttttcggaacgccaagctgatcaacgacttcaccgcccaggcgctggccgcgccgcgcgttggccctaaggacctgcgccagatcggcgaattgccgacgtcgggggagggcgatctggcgatcctgggtccaggcaccggcttcggcgtcgcaggccttgtccgtcgccatggccaggagatcccgctggccaccgagggtggtcacgtcgccttcgcgccggtcgatgacgtcgagatcgaggtgctccgcgccctgacccggcgcctggacggcggtcgggtgtcggtcgagcggatcctgtcgggtcccggcatggaggacctccatgtggatctggcggccgctgaagggcgcggtgtcgaggcgctgaccgccaagcagatcaccgagcgggccgtagagggctgcgccgacagcctggcgacggtgaaccgtttctgcgccatcctgggctcaacggcgggcgacatcgctctgaccttgggcgcacgcggcggtgttttcatcgccggcggcatcgcaccacgcatcatcgacattctggagaagagcccgttccgcgagcgcttcgacagcaaggggcgtctgtccggcttcacccgttcgatcccgacgcacgtgatcctgcatccgcacaccgccctgatcggtgcggcggtggcgctcacgccggagggccgtgcggcggtgtcgtag

SEQ ID NO: 50103 - protein, 331 aa, Caulobacter crescentus
MDGNHSGGLGLVGDIGGTNARFALVEFDGQDPRLIEPTAYRGEDYGTAEDAIEEYLRKVGVKHPDQAVVAVAGPIDHGQVHMTNLDWRISEDGLRRAGGFRNAKLINDFTAQALAAPRVGPKDLRQIGELPTSGEGDLAILGPGTGFGVAGLVRRHGQEIPLATEGGHVAFAPVDDVEIEVLRALTRRLDGGRVSVERILSGPGMEDLHVDLAAAEGRGVEALTAKQITERAVEGCADSLATVNRFCAILGSTAGDIALTLGARGGVFIAGGIAPRIIDILEKSPFRERFDSKGRLSGFTRSIPTHVILHPHTALIGAAVALTPEGRAAVS

SEQ ID NO: 50104 - DNA, 966 bp, Escherichia coli O6
  CDS (1)..(966): transl_table=11
atgacaaagtatgcattagtcggtgatgtgggcggcaccaacgcacgtcttgctctgtgtgatattgccagtggtgaaatctcgcaggctaagacctattcagggcttgattaccccagcctcgaagcggtcattcgcgtttatcttgaagaacataaggtcgaggtgaaagacggctgtattgccatcgcttgcccaattaccggtgactgggtggcaatgaccaaccatacctgggcgttctcaattgccgaaatgaaaaagaatctcggttttagccatctggaaattattaacgattttactgctgtatcgatggcgatcccgatgctgaaaaaagagcatctgattcagtttggtggcgcagaaccggtagaaggtaagcctattgcggtttacggtgccggaacagggcttggggttgcgcatctggtccatgtcgataagcgttgggtaagcttgccaggagaaggcggtcacgttgattttgcgccgaatagtgaagaagagggcattatcctcgaaatattgcgtgcggaaattggtcatgtttcggcggaacgcgtgctttctggccctggactggtgaatttgtatcgcgcaattgttaaagccgacaaccgcctgccagaaaatctcaagccaaaagatattaccgaacgcgcgctggctgacagctgcaccgattgccgccgcgcgttgtcgctgttttgcgtcattatgggccgttttggcggcaatctggcgctcaatctcgggacatttggcggcgtgtttattgcgggtggtatcgtgccgcgcttccttgagttcttcaaagcctctggtttccgcgccgcatttgaagataaagggcgctttaaagaatatgtccatgatattccggtgtatctcatcgtccatgacaatccgggccttctcggttccggtgcacatttacgccagaccttaggtcacattctctaa

SEQ ID NO: 50105 - protein, 321 aa, Escherichia coli O6
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEGIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDNPGLLGSGAHLRQTLGHIL

SEQ ID NO: 50106 - DNA, 966 bp, Erwinia carotovora
  CDS (1)..(966): transl_table=11
atgacgcactttgttttagtgggcgatgtcggcggcaccaatacgcgtttggcgctgtgtgacgccatgacgggcgaattgtcgcaaattgagacgtattccgggctggatttcccttctctggaaggggcgatccgcgattatctcgattcgcggcaggtcacggtgcaggatgcctgtatcgcgattgcctgcccgattaccggtgactgggtagcgatgacgaaccacacctgggcattttccatcgctgaaatgaaagcgagtctgggtttacgccactttgaggttatcaacgattttaccgcagtttccatggcggttccggtgatggggcgtgagagtttgctccagttcggtggtggggaacctgtgccgggtaagcccgttgccgtgtatggcgcaggcacggggctcggtgtcgctcatctggttcatgttgccaaccaatgggtcagcctgccgggtgaaggtgggcatgtggatttcgcggccaatagcgatgaagaagacaacattctgactattttgcgccaatcgttggggcatgtttccgcggagcgcttgctgtctggtcaggggctggtgaatatttaccgcgccatcgtgctatctgacgatcgtacaccggaggcgctggagccgaaggatattaccgaacgtgccgtcaacaatactgacgtggattgtcgtcgcgcgctgtcgctattctgcgtcatcatggggcgcttcggtggtaatttggcgctgaatttaggcacgtttggcggcgtttatattgctggcggcatcgtaccgcgctttctggaattttttaaagcctctggctttcgtgcggcttttgaagataaagggcgatttaaaggctatatgcaggatatccccgtgtatctgattacgcatgaacagccgggattaatgggggcaggggcttatctgcgacaggtgctgggcagcgcgctgtaa

SEQ ID NO: 50107 - protein, 321 aa, Erwinia carotovora
MTHFVLVGDVGGTNTRLALCDAMTGELSQIETYSGLDFPSLEGAIRDYLDSRQVTVQDACIAIACPITGDWVAMTNHTWAFSIAEMKASLGLRHFEVINDFTAVSMAVPVMGRESLLQFGGGEPVPGKPVAVYGAGTGLGVAHLVHVANQWVSLPGEGGHVDFAANSDEEDNILTILRQSLGHVSAERLLSGQGLVNIYRAIVLSDDRTPEALEPKDITERAVNNTDVDCRRALSLFCVIMGRFGGNLALNLGTFGGVYIAGGIVPRFLEFFKASGFRAAFEDKGRFKGYMQDIPVYLITHEQPGLMGAGAYLRQVLGSAL

SEQ ID NO: 50108 - DNA, 1011 bp, Helicobacter pylori J99
  CDS (1)..(1011): transl_table=11
atgccaaaaactgaaacttacccaagactattagccgatattggcggcacaaatgcgcgttttggtttggaagtcgccccacgacagattgaatgcgttgaagtcttgaggtgcgaagattttgagagcttgagtgatgcggtgcgattttacctttctaaatgcaaagaaagccttaaactgcaccctatttatggctcttttgctgtggctacgcccattatgggggattttgtccaaatgacgaacaaccactggactttttctattgaaacgacacggcaatgtttgaatttaaaaaaactgcttgtcatcaatgattttgtcgcgcaagcctatgccattagcgcgatgcaagaaaacgatctagcccaaataggcgggattaagtgtgaaatcaacgctcctaaagcgattttagggccaggaaccgggcttggggtaagcactcttatccaaaacagcgatggctctttgaaagtcttgcccggcgaaggtgggcatgtgagctttgccccttttgatgatttagaaattttagtgtggcaatacgcccgctctaaattcaaccatgtgagcgcggaaaggtttttgagcggtagcggcctggtgttgatttatgaagccctgtctaaacgcaaaggcttagaaaaagtggcgaagttgagcaaggctgaattaaccccacaaatcattagcgaacgcgctttgaatggggattaccctatatgccgattgaccttggacactttttgctccatgcttggcacgctcgctgctgatgtggctctcactttgggggctagagggggggtgtatttgtgtggggggattatcccacgattcattgattattttaaaacttcgccctttagagcgcgttttgaaacgaaagggcgcatgggagcgtttctcgcttccatccctgtgcatgtcgtgatgaaaaaaactcccggacttgatggggcgggcattgcgttagaaaattatttactgcatgatagaatatag

SEQ ID NO: 50109 - protein, 336 aa, Helicobacter pylori J99
MPKTETYPRLLADIGGTNARFGLEVAPRQIECVEVLRCEDFESLSDAVRFYLSKCKESLKLHPIYGSFAVATPIMGDFVQMTNNHWTFSIETTRQCLNLKKLLVINDFVAQAYAISAMQENDLAQIGGIKCEINAPKAILGPGTGLGVSTLIQNSDGSLKVLPGEGGHVSFAPFDDLEILVWQYARSKFNHVSAERFLSGSGLVLIYEALSKRKGLEKVAKLSKAELTPQIISERALNGDYPICRLTLDTFCSMLGTLAADVALTLGARGGVYLCGGIIPRFIDYFKTSPFRARFETKGRMGAFLASIPVHVVMKKTPGLDGAGIALENYLLHDRI

SEQ ID NO: 50110 - DNA, 1011 bp, Helicobacter pylori
  CDS (1)..(1011): transl_table=11
atgccaaaaactgaaacttacccaagactcttagccgatattggcggcacgaacgcgcgctttggcttggaagtcgccccacgacagattgaatgcattgaagtcttgaggtgcgaagattttgagagcttgagcgatgcggtacgattttacctttctaaatgcaaagaaagccttaaactgcaccctatttatggctcttttgctgtggctacgcccattatgggggattttgtccaaatgactaacaaccactggactttttctattgaaacgacgcggcaatgtttgactttaaaaaaattgcttgtcatcaatgattttgtcgcgcaagcctatgccattagcgcgatgcaagaaaacgatctggctcaaataggcgggattaagtgcgaaatcaacgctcctaaggcgattttagggccaggaacggggcttggggtaagcactcttatccaaaacagcgatggctctttaaaagtcttgcccggtgaaggagggcatgtgagctttgccccttttgatgatttagaaattttagtgtggcaatacgcccgttctaaattcaaccatgtgagcgcggaaaggtttttgagtgggagcggtttggtgctgatttatgaagccctgtctaaacgcaaaggtttagaaaaagtggcgaagttaagcaaggctgaattaaccccacaaattattagcgaatgcgctttgaatggggattaccctatatgccgattgaccttggacactttttgctccatgcttggcacgctcgctgctgatgtggctctcactttgggggctagggggggcgtgtatttgtgtggggggattatcccacgattcattgattattttaaaacttcgccctttagagcacgttttgaaacgaaagggcgcatgggagcgtttctcgcttctatccctgtgcatgtcgtgctgaaaaaaactcccggacttgatggggcgggcattgcgttagagaattacttactgcatgataagatatag

SEQ ID NO: 50111 - protein, 336 aa, Helicobacter pylori
MPKTETYPRLLADIGGTNARFGLEVAPRQIECIEVLRCEDFESLSDAVRFYLSKCKESLKLHPIYGSFAVATPIMGDFVQMTNNHWTFSIETTRQCLTLKKLLVINDFVAQAYAISAMQENDLAQIGGIKCEINAPKAILGPGTGLGVSTLIQNSDGSLKVLPGEGGHVSFAPFDDLEILVWQYARSKFNHVSAERFLSGSGLVLIYEALSKRKGLEKVAKLSKAELTPQIISECALNGDYPICRLTLDTFCSMLGTLAADVALTLGARGGVYLCGGIIPRFIDYFKTSPFRARFETKGRMGAFLASIPVHVVLKKTPGLDGAGIALENYLLHDKI

SEQ ID NO: 50112 - DNA, 987 bp, Neisseria meningitidis
  CDS (1)..(987): transl_table=11
atgtcttctacgccgaataaacaagccggatatccccgactggtcgccgatatcggcgggacgaatgcacgctttgcgctggaaaccgcgccgcgcgtcattgaaaaagccgccgtgcttccgtgtaaagactacgatacggttaccgatgcggtgcgtgcctatctgaatcaaagcggtgcaacagccgtacggcacgcggcatttgccatcgccaacccgattttgggcgactgggtgcagatgaccaaccaccattgggcgttttccatcgaaaccacccgtcagactttggggctggacaccctcatccttttgaacgactttaccgcgcaggcattggcggtaacgcagacttcaagcaaagacctgatgcaggtaggcgggcaaaagcctgtcgaatttgcccccaaagccgttatcggccccggtaccggcctgggcgtgagcggattggtgcacagccacgcaggctgggtggctttggcaggcgagggcgggcataccagtttcccgccgtttgacgatatggaagtgctgatttggcagtacgccaaaaacaaatacggccatgtttccgccgaacgctttttgagcggcgcgggcttgagcttggtttacgaggctttggctgcaaaacagaaagccaaacccgccaaactgatgccgtctgaaatcacggaaaaggctttgagcggcgcgtcgcctttgtgccgtcagactttggacatcttctgcgccatgctcggcacggttgcttccaacctcgccctgacgctgggtgcgcgcggcggcgtgtacctgtgtggcggcattattccccgcgtgttggaatatttcaaaacttccccgttccgcagccgtttcgagaacaagggcaggtttgaagcatatcttgccgcgattcccgtgtatgtcgtcttgagcgagtttcccggaatttccggtgcggctgcggctctcgacaaccatttgagaaacgtttaa

SEQ ID NO: 50113 - protein, 328 aa, Neisseria meningitidis
MSSTPNKQAGYPRLVADIGGTNARFALETAPRVIEKAAVLPCKDYDTVTDAVRAYLNQSGATAVRHAAFAIANPILGDWVQMTNHHWAFSIETTRQTLGLDTLILLNDFTAQALAVTQTSSKDLMQVGGQKPVEFAPKAVIGPGTGLGVSGLVHSHAGWVALAGEGGHTSFPPFDDMEVLIWQYAKNKYGHVSAERFLSGAGLSLVYEALAAKQKAKPAKLMPSEITEKALSGASPLCRQTLDIFCAMLGTVASNLALTLGARGGVYLCGGIIPRVLEYFKTSPFRSRFENKGRFEAYLAAIPVYVVLSEFPGISGAAAALDNHLRNV

SEQ ID NO: 50114 - DNA, 966 bp, Photorhabdus luminescens
  CDS (1)..(966): transl_table=11
atgaatctctacggacttgttgctgatattggcggcactaatgccagattagcactttgcaatttggaaaatggggttattgagcggatcgaaacatatagtgcaaaacaacacgccggattagaatctattatcagtcactatttagcagagcaaaaaacagtagtgacttatgcatgtattgctattgcttgcccgataaacggtgattgggtagaaatgaccaatcaccaatgggcattttctattagtgagctgaaacggacacttgggctagaaaaattagatgtgatcaatgacttcacggctgtatctatggctattccaatgctgacagaagaatacaagcttcaattaggaggaggagaagcggttaaagacaaaccgatagcggtttacggggcagggactggcctcggtgtcgctcatttgatcaaggtagacaagcaatgggtaagcttaccgggtgaaggtggtcatgtagattttgccgcgaatagtgaagaacaagatgcaatattggctgttttacggcgtaaatttgggcatgtttcagtagaaagaatcttgtccggtagtggattggtaaacctttatcaggccattgccattttggatcatcgtcagccggaagatttagaaccagaaaccgtgacgcaacgagcattggataaaagttgccaatattgccatcgtgctctgacactattttgtgaaattatggggcgatttggcggaaatttagcgttaaatatggggacttttggtggtgtgtatatcgctggtggtatagtgccgcggtttcttgatttctttaggcaatcgaactttcttcatggatttgaagataaagggcgctttaaaccgttagtacaacagattcctgtttatttgattactcatccacaaccaggattattaggttcaggtacctatttacggcaacagctttcacttattgattaa

SEQ ID NO: 50115 - protein, 321 aa, Photorhabdus luminescens
MNLYGLVADIGGTNARLALCNLENGVIERIETYSAKQHAGLESIISHYLAEQKTVVTYACIAIACPINGDWVEMTNHQWAFSISELKRTLGLEKLDVINDFTAVSMAIPMLTEEYKLQLGGGEAVKDKPIAVYGAGTGLGVAHLIKVDKQWVSLPGEGGHVDFAANSEEQDAILAVLRRKFGHVSVERILSGSGLVNLYQAIAILDHRQPEDLEPETVTQRALDKSCQYCHRALTLFCEIMGRFGGNLALNMGTFGGVYIAGGIVPRFLDFFRQSNFLHGFEDKGRFKPLVQQIPVYLITHPQPGLLGSGTYLRQQLSLID

SEQ ID NO: 50116 - DNA, 996 bp, Pseudomonas aeruginosa
  CDS (1)..(996): transl_table=11
atgaataacgacaacaagagaagcgccggcggcctcggcctggtcggcgatatcggcggcaccaatgcgcgtttcgcgctctggcgcgggcagcgcctggaatccatcgaggtgctcgcctgcgccgactacccgcggcctgaactggccgtgcgcgactacctggcgcggatcggcgaatcggtggcgaacatcgactcggtctgcctggcctgcgccggtccggtcggggcggccgatttccgtttcaccaacaaccactgggtgatcaatcgtgccgcgttccgcgaggagctggggctggatcacctgctgctggtcaacgacttcagcaccatggcctgggccgcctcgcggctaggtgcggacgagctggtgcaggtccgcgccggcagtgcccaggcggatcgcgcccggctgatcatcggtcccggcaccggccttggcgtcggcagcctgctgccgctgggcgggggacgttgggaagtgctgccctgcgagggcgggcacgtcgacctgccggtcacttcgccgcgcgacttcgcgctctggcagggcctgcaggcgcgctacggacatgtctccgccgagcgcgcactgtccggcaacggcctgctcgccctctatgaaatcagctgtgccctggacggggtcgccgtacgcgcgagcagtgcggcggaagtcggtgccctggccatggccggcgacgcccaggcggacgccgtgctggagcacttcttcctgtggctggcgcgggtcgccggcaacgcggtgctcaccgtcggcgcgctcggtggcgtctacattaccggcggcatcgtcccgcgtttcctcgagcgtttcatcgccagcggcttcgccgaggccttcgccagccgtggcaagactagcggcgcttacctgcaggacgtaccggtgtgggtcatgaccgccgaacatccgggcctgctcggcgccggggtcgccctgcagcaggccctggacgccgagggctga

SEQ ID NO: 50117 - protein, 331 aa, Pseudomonas aeruginosa
MNNDNKRSAGGLGLVGDIGGTNARFALWRGQRLESIEVLACADYPRPELAVRDYLARIGESVANIDSVCLACAGPVGAADFRFTNNHWVINRAAFREELGLDHLLLVNDFSTMAWAASRLGADELVQVRAGSAQADRARLIIGPGTGLGVGSLLPLGGGRWEVLPCEGGHVDLPVTSPRDFALWQGLQARYGHVSAERALSGNGLLALYEISCALDGVAVRASSAAEVGALAMAGDAQADAVLEHFFLWLARVAGNAVLTVGALGGVYITGGIVPRFLERFIASGFAEAFASRGKTSGAYLQDVPVWVMTAEHPGLLGAGVALQQALDAEG

SEQ ID NO: 50118 - DNA, 1029 bp, Ralstonia solanacearum
  CDS (1)..(1029)
atgggcagcatggacgatgtgacggcctacccgcgcctggtcggggatgtcggcgggaccaacgcgcgcttcgcgctggagatggcgccgatgcggctggcccatatcggcgtgctggccggcgacgactacccgtcgctggaagcggccatgcgcgcctatctcgccgcgctgccgccggagatcgccgcggcgggcgtgcggcatgcggccatcggcatcgccaatccggtgctgggcgaccagatccgcatgaccaaccgcgactgggcgttttccaccgaggcgatgcgccagtcgctgggcttcgataccttcgtcgtgctcaacgatttcgccgcgctggcgcacgcgctgccctacctgggcgccgacgagctggaacaggtgggcggcagcacctgcgtggccgacgcgccgcgcgcgctgctggggccgggcacgggcctgggcgtggcgtcgctgctgccgacgcaggcagggcgcttcatcgccgtcgcgggcgaggggggccacgtcgcgtttgcgccgatgaacgacgaggaagtcgtcatctggcgcttcgcgcgcgagcgcttcggccatgtctcggccgagcggctgatctcgggcatggggctggagctgatctacgaggcgctcggcgcgtgcttcgacctgtggcagcagggccccgccgtgcgccgcgccgccgacatcaccgccatcgccctgggcgaaatggaagacaccgccggcgatcacgcccgctgccgctacgccgtcgatacgttctgcgccatgctcggcaccgtggcggccaacctggcggtcacgctgggcgcgcggggcggggtctatatcggcggcggcatcgtgccgcggctgggcgccgccttcgccaattcaccgttccggcggcggttcgaagacaagggccgcttctccggctatgtggcggcgatgccggtgtacgtcatccatgcgccgtacccggggctgatcggcctgtgcgcggcgatggatcacgccgtggccagcggccactga

SEQ ID NO: 50119 - protein, 342 aa, Ralstonia solanacearum
MGSMDDVTAYPRLVGDVGGTNARFALEMAPMRLAHIGVLAGDDYPSLEAAMRAYLAALPPEIAAAGVRHAAIGIANPVLGDQIRMTNRDWAFSTEAMRQSLGFDTFVVLNDFAALAHALPYLGADELEQVGGSTCVADAPRALLGPGTGLGVASLLPTQAGRFIAVAGEGGHVAFAPMNDEEVVIWRFARERFGHVSAERLISGMGLELIYEALGACFDLWQQGPAVRRAADITAIALGEMEDTAGDHARCRYAVDTFCAMLGTVAANLAVTLGARGGVYIGGGIVPRLGAAFANSPFRRRFEDKGRFSGYVAAMPVYVIHAPYPGLIGLCAAMDHAVASGH

SEQ ID NO: 50120 - DNA, 1026 bp, Rhizobium loti
  CDS (1)..(1026): transl_table=11
atgccaagcgtaagcgataccgacacgtcgttgcggtttccgatcctgatcggcgacattggcggcaccaatgcgcgcttttcgatcgtgctcgacgccaattccgagccgaccgagccgcagatcgtccagaccgccaatttcaacacgatcgacgaggcgatccaggcggcggtgctcgaccgctcgtcggtccgtcccaattcggcggtgctggcggtggccggtccggtcgacggcgacgagatcgaactcaccaattgcccgtgggtcgtcaagcccaggcagatgtttgccaatctcggcttgagcgacattgtcgtgctcaacgatttcgaggcgcaggcgctggccgtcgtggcgcttggcgaagagcatatggaaaagatcggcggcggcacgccggagcccaatgcaggccgcgtcgtgctcggccccggaaccgggctcggcgtcgccgggctggtctatgccttgcgccactggataccggtgcccggcgaaggcggccatatggacatcggtccgcgcacgccgcgcgatttcgaggtgtttccgcatatcgagaagctcgagggccgcatttccggcgaacagatcctgtgcgggcgcggcctcgtcaacgtctaccgggctgtcgccaaggcggacggcaagccggcgcctttcaccacgccggccgagatcaccggcgcggcgctggccaagaccgatccggtggctgaggaagcgctggagactttcgtcacctgcctcgggcgcaccgccggcgatcttgccctggtgttcatgagccgtggcggcgtcttcttgaccggcgggatcgcccaaaaaatcgtgccggcgctgaaggagggcaatttccgcgccgccttcgaggacaaggcgccgcacagcgcgctgatgcgcaccatgcccgtctatgtcatcacccatccgctggcggcccttctcggccttgccgcctatgccaggaacccgtcgctgttcggcgtccagacggccggccggcgctggcaggcctga

SEQ ID NO: 50121 - protein, 341 aa, Rhizobium loti
MPSVSDTDTSLRFPILIGDIGGTNARFSIVLDANSEPTEPQIVQTANFNTIDEAIQAAVLDRSSVRPNSAVLAVAGPVDGDEIELTNCPWVVKPRQMFANLGLSDIVVLNDFEAQALAVVALGEEHMEKIGGGTPEPNAGRVVLGPGTGLGVAGLVYALRHWIPVPGEGGHMDIGPRTPRDFEVFPHIEKLEGRISGEQILCGRGLVNVYRAVAKADGKPAPFTTPAEITGAALAKTDPVAEEALETFVTCLGRTAGDLALVFMSRGGVFLTGGIAQKIVPALKEGNFRAAFEDKAPHSALMRTMPVYVITHPLAALLGLAAYARNPSLFGVQTAGRRWQA

SEQ ID NO: 50122 - DNA, 1020 bp, Rhizobium meliloti
  CDS (1)..(1020): transl_table=11
atgcccaatgcgagtgaacacagctttccctttccgatcctgatcggcgacatcggcggcaccaatgcccgcttcgcactgctcaccgacgcctacggcgaaccgaagcagttggccccgatcagaacgggcgatttcgccacgatcgaggaggcgatgcagaaaggcatcctcgacaagacctccgtccagccgcgctcggcgatcctcgccgtggccgggccgatcaagggcgacgagataccgctgacgaatgccggctgggtgattcgtccgaaggacatgctggcgggcctcgggctggaggatgtgctggtcatcaacgacttcgaggcccaggcgctcgccatcgccgcgccggccgatcaggatgtcgttcagatcggcggcggagccgtccggcccttccattcgcgcgtcgtgctcggcccgggaaccggtctgggcgtcgccggactggtctatgcgcagcatacctggatacccgtgcccggcgagggcggtcatgtcgatataggtccccggacggagcgcgacttccggatctggcccttcctcgaaccgatcgagggacgcatggccggcgagcagatcctgtgcggccgcggcatcatgaatctctatcgcgctgtctgcgccgccaatggcgaggaagcggttcttgcggatcaggcggcagtgacgacgagcgcgctctccggcgccgatgcggcggcggtcgaaaccgtgtcgctctttgcgacctatctcgggcgcgttgccggcgacatggcgctgatcttcatggcgcgcggcggcgtattccttgccggcggcatttcgcagaagatactgccggcactgacgaagcccgaatttcgcgcggccttcgaggacaaggcgcctcattcggcattgatgcggacgattccgaccttcgccgtcattcaccccatggcggcgctctccggcctcgcggcctttgcccgcacgccgagggacttcggtgttgcaatggagggacgccgttggagaaggtga

SEQ ID NO: 50123 - protein, 339 aa, Rhizobium meliloti
MPNASEHSFPFPILIGDIGGTNARFALLTDAYGEPKQLAPIRTGDFATIEEAMQKGILDKTSVQPRSAILAVAGPIKGDEIPLTNAGWVIRPKDMLAGLGLEDVLVINDFEAQALAIAAPADQDVVQIGGGAVRPFHSRVVLGPGTGLGVAGLVYAQHTWIPVPGEGGHVDIGPRTERDFRIWPFLEPIEGRMAGEQILCGRGIMNLYRAVCAANGEEAVLADQAAVTTSALSGADAAAVETVSLFATYLGRVAGDMALIFMARGGVFLAGGISQKILPALTKPEFRAAFEDKAPHSALMRTIPTFAVIHPMAALSGLAAFARTPRDFGVAMEGRRWRR

SEQ ID NO: 50124 - DNA, 966 bp, Salmonella typhimurium
  CDS (1)..(966): transl_table=11
atgacaaagtatgctttagtaggagatgtaggcggcacgaatgcgcgtcttgccctgtgtgatatcgccagtggagaaatctcgcaggccaaaacgtattccggcctggattatcccagtcttgaggccgtggtgcgcgtttatctcgatgagcatagcgtcagcgtggaagatggttgtatcgccatagcctgcccgattaccggtgactgggtagcgatgactaaccatacctgggctttttctattgcggaaatgaaaaaaaatctcggctttagccatctggaaatcatcaacgatttcaccgccgtgtcgatggcgatcccgatgctgaaaaaagagcatttaattcagttcggcggcggcgaaccggtagacggcaaacctattgcggtgtatggcgcgggaaccggcttgggcgtggcgcatctggtgcatgtggataagcgttggattagccttccgggcgaaggcgggcatgtcgattttgcgcctaatagcgaagaagaagctatgattctggaaatattgcgcgccgaaattggccacgtttccgccgagcgcgtgctgtctggcccggggctggtgaatctttaccgggcgattgttaagtccgacaaccgtctgccggaaaatctgcgcccgaaagatattaccgaacgcgccctggcggatagctgtatcgattgtcgccgcgcgttgtcgctcttttgcgtcatcatggggcgatttggcggcgatctggcgttaaccatggggacatttggcggcgtttatatcgctggcggtattgtcccgcgcttcctggaattttttaaagcgtccggcttccgtggtggctttgaagataaaggccgctttaaagattatgtacacggtattccggtctatctgattgtccatgataatcctggcttgttaggttccggcgcgcatctgcgccagacattaggtcatattctataa

SEQ ID NO: 50125 - protein, 321 aa, Salmonella typhimurium
MTKYALVGDVGGTNARLALCDIASGEISQAKTYSGLDYPSLEAVVRVYLDEHSVSVEDGCIAIACPITGDWVAMTNHTWAFSIAEMKKNLGFSHLEIINDFTAVSMAIPMLKKEHLIQFGGGEPVDGKPIAVYGAGTGLGVAHLVHVDKRWISLPGEGGHVDFAPNSEEEAMILEILRAEIGHVSAERVLSGPGLVNLYRAIVKSDNRLPENLRPKDITERALADSCIDCRRALSLFCVIMGRFGGDLALTMGTFGGVYIAGGIVPRFLEFFKASGFRGGFEDKGRFKDYVHGIPVYLIVHDNPGLLGSGAHLRQTLGHIL

SEQ ID NO: 50126 - DNA, 966 bp, Shigella flexneri
  CDS (1)..(966): transl_table=11
atgacaaagtatgcattagtcggtgatgtgggcggcaccaacgcacgtcttgctctgtgtgatattgccagtggtgaaatctcgcaggctaagacctattcagggcttgattaccccagcctcgaagcggtcattcgcgtttatcttgaagaacataaggtcgaggtgaaagacggctgtattgccatcgcttgcccaattaccggtgactgggtggcaatgaccaaccatacctgggcgttctcaattgccgaaatgaaaaagaatctcggttttagccatctggaaattattaacgattttaccgctgtatcgatggcgatcccgatgctgaaaaaagagcatctgattcagtttggtggcgcagaaccggtcgaaggtaagcctattgcggtttacggtgccggaacggggcttggggttgcgcatctggtccatgtcgataagcgttgggtaagcttgccgggcgaaggcggtcacgttgattttgcgccgaatagtgaagaagaggccattatcctcgaaatattgcgtgcggaaattggtcatgtttcggcggagcgcgtgctttctggccctgggctggtgaatttgtatcgcgcaattgtgaaagctgacaaccgcctgccagaaaatctcaagccaaaagatattaccgaacgcgcgctggctgacagctgcaccgattgccgccgcgcattgtcgctgttttgcgtcattatgggccgttttggcggcaatctggcgctcaatctcgggacatttggcggcgtgtttattgcgggcggtatcgtgccgcgcttccttgagttcttcaaagcctccggtttccgtgccgcatttgaagataaagggcgctttaaagaatatgtccatgatattccggtgtatctcatcgtccatgactatccgggtcttctcggttccggtgcacatttacgccagaccttaggtcacattctgtaa

SEQ ID NO: 50127 - protein, 321 aa, Shigella flexneri
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEAIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDYPGLLGSGAHLRQTLGHIL

SEQ ID NO: 50128 - DNA, 1068 bp, Synechocystis sp
  CDS (1)..(1068): transl_table=11
atgggggccatgggcgtaaattttttggcaggggatatcggcggcactaaaacgattctggccctggtgacgataaacgagagtagcccagggttggcccggccggtgactctgtttgaacagacctacagcagtccagcttttcccgatctggtgcccatggtgcaacaattccgtcaagaagcagcctttgtgttgggtaacccaatctccgttgctaaggcctgtttcgccattgccggccctgtgatcgataacacctgtcgcctcactaatttagattggcatctcagcggcgatcgcctggcccaggaattggccattgcccaggttgacctcatcaatgattttgccgctgtgggttacggcattttagggctagggtcagaggatttaaccgtactccaggccgctcccgtggatccgtcaggggcgatcgccatattgggagcaggcaccggcttgggacaatgctacgtaattccccagggccaaggaagatatcgagtttttgcctccgaaggagcccacggtgactttgccccccgatcgcctttggaatggcagttattggagtatctcaaaaagaagtattccctagggcggatttccattgaacgggtggtatccggcatgggcatcgccatgatttacgaatttttgcggcaccaatacccagaacgggaatcagcccaattcagcaaactctaccaaacctggaatcgagaaaaggaccaagaaaccaaaaccgtcgatctggccgccgccgtatcccaagccgccctggaaggcacagatgtattggctgaccaagccatggaactttttctcggggcctatggagcagaggcaggaaatcttgctttgaagctactacccagaggtggtttgtacgttgccggtggtattgcccccaaaattatccctttactggaaaagggcagttttatgcaaggctttagcgacaaaggcaggatgcaaagcttaatggggacaattcccgtacaggtggtactcaacgccaaagttggcctaattggcgcggcggtttgtgcggcccagtcttag

SEQ ID NO: 50129 - protein, 355 aa, Synechocystis sp
MGAMGVNFLAGDIGGTKTILALVTINESSPGLARPVTLFEQTYSSPAFPDLVPMVQQFRQEAAFVLGNPISVAKACFAIAGPVIDNTCRLTNLDWHLSGDRLAQELAIAQVDLINDFAAVGYGILGLGSEDLTVLQAAPVDPSGAIAILGAGTGLGQCYVIPQGQGRYRVFASEGAHGDFAPRSPLEWQLLEYLKKKYSLGRISIERVVSGMGIAMIYEFLRHQYPERESAQFSKLYQTWNREKDQETKTVDLAAAVSQAALEGTDVLADQAMELFLGAYGAEAGNLALKLLPRGGLYVAGGIAPKIIPLLEKGSFMQGFSDKGRMQSLMGTIPVQVVLNAKVGLIGAAVCAAQS

SEQ ID NO: 50130 - DNA, 1008 bp, Xanthomonas axonopodis
  CDS (1)..(1008): transl_table=11
atgaccgctccttccaagccggtgctggttgccgatatcggcggtaccaatgcgcgcttcgcgctggccgatgtcgacgcctcggtgccgttgctggatgacacctcgcgcgaatttgcggtggtggatttcggttcgctgggcgaagcggcgcgctattacctggaccagatcggcgtgcaggccacccagggcgtgttcgccgtggcgggccgcgtggacggcgacgaggcacgcatcaccaaccatccctgggtgatctcgcgctcgcgcaccgccaccatgctgggtttcagtaccttgcatctgatcaacgactttgccgcgcaggcgatggcgatcagcctgctgcgtccacaggacgtggtgcaggtaggcggcgccagctggcgtccggcaccgatcgatcaagcgcgcaactatggcgtgatcggcccgggcaccggcctgggcgtgggcggcctgatcatccgcaacgggcgctgctttccgctggaaaccgaaggcggccatgtcagcttcccgcccggcacgccggaagaaatccgcatcctggaaatcctgtccgagcagttcggccgggtctccaacgagcggctgatctgcggtccgggcctggtcaatatccatcgcgcgttgagcgagatcgcgggggtcgatccgggcccgctgcaacccaaggacatcaccgcacgcgcggctgcgggcgacccgcggtcctcgcgcaccatcgatctgttctgcgccatcttcggtgcgatcgccggcgacatggtgctgatgcagggcgcctgggacggcgtgttcctcaccggcgggctggtgcccaaggtgctggattcgctgcagcattccggctttcgccagcgcttcgaacacaagggccgtttctccgcgatcatgtcgaaggtgccatcgctggcggtcatgcacccgcatgccggcctgctgggcgccgccgcctacgcggtggatgcacaacgtcagcaccccggggagcagcgatga

SEQ ID NO: 50131 - protein, 335 aa, Xanthomonas axonopodis
MTAPSKPVLVADIGGTNARFALADVDASVPLLDDTSREFAVVDFGSLGEAARYYLDQIGVQATQGVFAVAGRVDGDEARITNHPWVISRSRTATMLGFSTLHLINDFAAQAMAISLLRPQDVVQVGGASWRPAPIDQARNYGVIGPGTGLGVGGLIIRNGRCFPLETEGGHVSFPPGTPEEIRILEILSEQFGRVSNERLICGPGLVNIHRALSEIAGVDPGPLQPKDITARAAAGDPRSSRTIDLFCAIFGAIAGDMVLMQGAWDGVFLTGGLVPKVLDSLQHSGFRQRFEHKGRFSAIMSKVPSLAVMHPHAGLLGAAAYAVDAQRQHPGEQR

SEQ ID NO: 50132 - DNA, 1008 bp, Xanthomonas campestris
  CDS (1)..(1008): transl_table=11
atgactgctccttccaagccggtgctggttgccgacatcggtggcaccaacgcgcgcttcgcgctggccgacatcgatgcctcggtaccgctgctggacgacacctgccgtgagttcgcggtggtcgagttcggctcgctgggcgaggccgcgcgctattacctggaccagattggcgtgcaggccaccaagggcgtgttcgcggtggccggccgtgtggatggcgacgaagcccgcatcaccaaccatccgtgggtgatctcgcgctcgcgcaccgccaccatgctgggcttcagcacgctgcacctgatcaacgacttcgccgcgcaagcgatggcgatcagcctgctgcgcccgcaggacgtggtgcaggtgggcggcgccagctggcgcccggcaccgatcgagctgccgcgcaactacggcgtcatcggcccgggcaccgggctgggcgtgggtggcctgatcatccgcaacggccgctgttttccgctggaaaccgaaggcggccatgtcagcttcccgcccggcacgccggaagagattcgcgtgctggagatcctgtccgagcagttcggccgggtctccaacgagcgcctgatctgcggcccgggcctggtcaacatccaccgcgcgctgagcgagattgccggcatcgaccccggcccgctggagcccaaggacatcaccgcacgtgccgccgctggcgacccgcgtgcctcgcgcaccattgatctgttctgcgccatcttcggcgcgatcgccggtgacatggtgctgatgcagggtgcctgggacggcgtcttcctcaccggcgggctggtgcccaaggtgctggattcgctgcagcattccggcttccgccagcgcttcgaacacaagggccgtttctccgcaatcatgtcgcgggtgccctcgctggcggtgatgcatccgcatgccggcctcctgggtgcagcggcgtatgcggtggacgccgaacgcgcattgccgggagagcagcgatga

SEQ ID NO: 50133 - protein, 335 aa, Xanthomonas campestris
MTAPSKPVLVADIGGTNARFALADIDASVPLLDDTCREFAVVEFGSLGEAARYYLDQIGVQATKGVFAVAGRVDGDEARITNHPWVISRSRTATMLGFSTLHLINDFAAQAMAISLLRPQDVVQVGGASWRPAPIELPRNYGVIGPGTGLGVGGLIIRNGRCFPLETEGGHVSFPPGTPEEIRVLEILSEQFGRVSNERLICGPGLVNIHRALSEIAGIDPGPLEPKDITARAAAGDPRASRTIDLFCAIFGAIAGDMVLMQGAWDGVFLTGGLVPKVLDSLQHSGFRQRFEHKGRFSAIMSRVPSLAVMHPHAGLLGAAAYAVDAERALPGEQR

SEQ ID NO: 50134 - DNA, 1014 bp, Xylella fastidiosa
  CDS (1)..(1014): transl_table=11
atgaacgcaccacaggctcccgtactggtcgcagacattggagggactaacgcccgctttgcgctggccaaccccaccctaacctcagcaccactgctgaacgacagcctgcgcgaattcgccgtcatcgaattcccctcactgagcgaagctgcacagcactacctgcatcacatcggcatacataccaccaaaggcgtctttgcgatcgccggacacgtagacggcgatgaagcacgtattaccaatcatccctgggtcatcacacgcacgcgcactgcaacaatgctcggcttcgacaccctgcacctcatcaacgattttgttgcccaagcgatggccatcagcgtgttaggccctcaagatgtcatccaaatcggcagtgccaaatgggagcaagtcccgctatcagcagccacccgcaactacggcatcattggccccggcaccggcctaggcgtcggcggcctggtgattcgcaacggccgctgttatccgctagaaaccgagggcggccatgtcagcttcccgccaagcaccccagaagaaatccggatcctggaaatcctgtcacaacaattcggacgtgtctccaacgaacggctgatctccggtccagggctagtcaacattcaccgcgcactgagcgaaatcgacggaatcgacccaggcccactgcgccctcaagacatcaccatgcgcgccgctgacggcgacatacgcgccacacgcaccatcaatctgttctgcaacatcttcggcgccatcaccggcgacctggtactcatccaaggggcttgggatggcgtctttctgacaggcggcctcgttcccaaactattgaactcaatacagcattccggtttccgccaaaaatttgaacataagggtcgattttcggccatcatggcccgtatcccctctttagcagtgatccatccacaccctggcctactcggcgcagccgcatacgcacgagacaccgagccagtcccgcaggacatcaaggcatga

SEQ ID NO: 50135 - protein, 337 aa, Xylella fastidiosa
MNAPQAPVLVADIGGTNARFALANPTLTSAPLLNDSLREFAVIEFPSLSEAAQHYLHHIGIHTTKGVFAIAGHVDGDEARITNHPWVITRTRTATMLGFDTLHLINDFVAQAMAISVLGPQDVIQIGSAKWEQVPLSAATRNYGIIGPGTGLGVGGLVIRNGRCYPLETEGGHVSFPPSTPEEIRILEILSQQFGRVSNERLISGPGLVNIHRALSEIDGIDPGPLRPQDITMRAADGDIRATRTINLFCNIFGAITGDLVLIQGAWDGVFLTGGLVPKLLNSIQHSGFRQKFEHKGRFSAIMARIPSLAVIHPHPGLLGAAAYARDTEPVPQDIKA

SEQ ID NO: 50136 - DNA, 1014 bp, Xylella fastidiosa
  CDS (1)..(1014): transl_table=11
atgaacgcaccacaggctcccgtactggtcgcagacattggagggactaacgcccgctttgcgctcgccaaccccaccctaacctcagcaccactgctgaacgacagcatgcgcgaattcgccgtcatcgaattcccctcactgggcgaagctgcacagcactacctgcatcacatcggcatacataccaccaaaggcgtctttgcgatcgccggacacgtagacggcgatgaagcacgtattaccaatcatccctgggtcatcacacgcacgcgcactgcaacaatgctcggcttcgacaccctgcacctcatcaacgattttgttgcccaagcgatggccatcagcgtgttaggccctcaagatgtcatccaaatcggcagtgccaaatgggagcaattcccgctatcagcagccactcgcaactacggcatcattggccccggcaccggcctaggcgtcggcggcctgatgattcgcaacggccgctgctatccgctagaaaccgagggcggccatgtcagcttcccgccaagcaccccagaagaaatccggatcctggaaatcctgtcacaacaattcggacgtgtctccaacgaacggctgatctccggtccagggatagtcaacattcaccgcgcactgagcgaaatcgacggaatcgacccaggtccactgcgccctcaagacatcaccatgcgcgccgctgacggcgacatacgcgccacacgcaccatcaatctgttctgcaacatcttcggcaccatcaccggcgacctggtactcatccaaggggcttgggatggcgtctttctgacaggcggcctcgttcccaaactattgaactcaatacagcattccggtttccgccaaagatttgaacataagggtcgattttcggccatcatggcccgtatcccctctttggcagtgatccatccacaccctggcctactcggcgcagccgcatacgcacgagacaccgagcaagtcccgcaggaaatcaaggcatga

SEQ ID NO: 50137 - protein, 337 aa, Xylella fastidiosa
MNAPQAPVLVADIGGTNARFALANPTLTSAPLLNDSMREFAVIEFPSLGEAAQHYLHHIGIHTTKGVFAIAGHVDGDEARITNHPWVITRTRTATMLGFDTLHLINDFVAQAMAISVLGPQDVIQIGSAKWEQFPLSAATRNYGIIGPGTGLGVGGLMIRNGRCYPLETEGGHVSFPPSTPEEIRILEILSQQFGRVSNERLISGPGIVNIHRALSEIDGIDPGPLRPQDITMRAADGDIRATRTINLFCNIFGTITGDLVLIQGAWDGVFLTGGLVPKLLNSIQHSGFRQRFEHKGRFSAIMARIPSLAVIHPHPGLLGAAAYARDTEQVPQEIKA

SEQ ID NO: 50138 - DNA, 975 bp, Zymomonas mobilis
  CDS (1)..(975): transl_table=11
atggaaattgttgcgattgacatcggtggaacgcatgcgcgtttctctattgcggaagtaagcaatggtcgggttctttctcttggagaagaaacgacttttaaaacggcagaacatgctagcttacagttagcttgggaacgtttcggtgaaaaactgggtcgtcctctgccacgtgccgcagctattgcatgggctggcccggttcatggtgaagttttaaaacttaccaataacccttgggtattaagaccagctactctgaatgaaaagctggacatcgatacgcatgttctgatcaatgacttcggtgcggttgcccacgcggttgcgcatatggattcttcttatctggatcatatttgtggtcctgatgaagcgcttcctagcgatggtgttatcactattcttggtccgggaacgggcttgggtgttgcccatctgttgcggactgaaggccgttatttcgtcatcgaaactgaaggcggtcatatcgactttgctccgcttgacagacttgaagacaaaattctggcacgtttacgtgaacgtttccgccgcgtttctatcgaacgcattatttctggcccgggtcttggtaatatctacgaagcactggctgccattgaaggcgttccgttcagcttgctggatgatattaaattatggcagatggctttggaaggtaaagacaaccttgctgaagccgctttggatcgcttctgcttgagccttggcgctatcgctggtgatcttgctttggcacagggtgcaaccagtgttgttattggcggtggtgtcggtcttcgtatcgcttcccatttgccggaatctggcttccgtcagcgctttgtttcaaaaggacgctttgaacgcgtcatgtccaagattccggttaagttgattacttatccgcagcctggactgctgggtgcggcagctgcctatgccaacaaatattctgaagttgaataa

SEQ ID NO: 50139 - protein, 324 aa, Zymomonas mobilis
MEIVAIDIGGTHARFSIAEVSNGRVLSLGEETTFKTAEHASLQLAWERFGEKLGRPLPRAAAIAWAGPVHGEVLKLTNNPWVLRPATLNEKLDIDTHVLINDFGAVAHAVAHMDSSYLDHICGPDEALPSDGVITILGPGTGLGVAHLLRTEGRYFVIETEGGHIDFAPLDRLEDKILARLRERFRRVSIERIISGPGLGNIYEALAAIEGVPFSLLDDIKLWQMALEGKDNLAEAALDRFCLSLGAIAGDLALAQGATSVVIGGGVGLRIASHLPESGFRQRFVSKGRFERVMSKIPVKLITYPQPGLLGAAAAYANKYSEVE

SEQ ID NO: 50140 - DNA, 1005 bp, Xylella fastidiosa
  CDS (1)..(1005)
atgattccgaaccctacccgagatgcacccaatatcccgtcctttgttgccgccgatgtcggcggcactcacgtgcgcgtcagcgtggttgcagccgcgcccacgtgtgccagtccaccgcaactgttggatgtgcgcacttaccgctgcgctgactatcccagcctcagcacaattctgaacgacttcctcggtacaagatcagcagtacgtgattgcgtcatcgccagtgccggttttcagcgcagcgatggtactgttatcactaccaacctaccgtggccgctatcaccacaccggctacgcgcagatctcgatctggcagaggtctctctggtcaacgactttgaggcgctggcctacgccacagaggatatggaggctgcgcaattgctgcacctcactggtccagccaaagcgcaggatgggccacgcctgttgcttggtccgggaaccggcctgggtgcagcactctggattcccaataacggacgccccattgtcctccctacggaagccggtcaagcagcattgccgagtacaactgaacttgaaatgcaactggtacgacacatgctgaacaaccgcacacatgtgccgattgagcatgctttatctgggccaggaatactcaatgtgtaccgcgccttgtgtgcgctacagtccgtcctcccccagcacgcaagcccagatgcgatcagtcacgctgcggcagcaggaacagacatgctgtcatcacagactctagaggtattctgcgacttcctcggcagcatcgttggtgatttggtcatgatgtacggtgcacaggggggtgtctatctggccggaggaatcctgccacagctgcgtgagccgctgctacgcagtcactttgtcgaacgcttcctcaataaaggccccatgggcgaggcattacagcacgtcccggtgcggctgatcgaacatgggcaactcggcatcgtaggtgcggcacgctggtacttaaataaaaaagcaacttaa

SEQ ID NO: 50141 - protein, 334 aa, Xylella fastidiosa
MIPNPTRDAPNIPSFVAADVGGTHVRVSVVAAAPTCASPPQLLDVRTYRCADYPSLSTILNDFLGTRSAVRDCVIASAGFQRSDGTVITTNLPWPLSPHRLRADLDLAEVSLVNDFEALAYATEDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 50142 - DNA, 948 bp, Caulobacter crescentus
  CDS (1)..(948): transl_table=11
gtgaatggtcgcgatctggccctggcgctggtcagtccgggcgacgcgccgcgcggacatcgcgatctagcctgcgcgtcgctcaaagcgcttgaagagcacctgatcgacgccgtgtccgagcattcggctgacggcctgatcggagccgctgtctgcggcgccggccccgaaatcgacggcgcgatcgcgctgacggccggcgacttcacgctgacccaggcctggttgcgcgcggtgctgaagacgccgcgcgtctcgctgttgaacgacttcgccgcctgcgccctgggcgcgccccgcctggccccgtcggccatgcgcctgatccacgagggcaagcccggccgcaacgcccagatcgccgtgatcggtcccaatctcggtctcggcgtcgccgccctgacgccccaccgaaccgacgggtggacgcccgtagtcagcgagggtgggcatatcgacttcacccccggcgagccccgcgaagtcccggtgttcgaggcgctgcaagcccggcacggccgggtctcggcggagcatttcctgtcacagcagggcctcgccgatatctatgcggccctgggcggcgggctggacgatagcgacgaggtcatcctcgcccgggtccgggacggcgacgagacggcgcgggaagccctgtcgatcttcagcgccctcttgggggccttcgcgggagacgccgccctcagcttcgcggcccggggaggcgtctatatcaacagccccctgatggaacgcatcgatggcctgctcgatcaggccgccttcagccggcgctttgaggacaagggccggatgagcgcctatctcaaggacatcccggtctatctcgccgtcgggcggtgcacgctgctgggcttgtccgcgctcttcaccgccagcgacctgcgatacgaagccgccgaggtgaaggtcctcgactgctga

SEQ ID NO: 50143 - protein, 315 aa, Caulobacter crescentus
MNGRDLALALVSPGDAPRGHRDLACASLKALEEHLIDAVSEHSADGLIGAAVCGAGPEIDGAIALTAGDFTLTQAWLRAVLKTPRVSLLNDFAACALGAPRLAPSAMRLIHEGKPGRNAQIAVIGPNLGLGVAALTPHRTDGWTPVVSEGGHIDFTPGEPREVPVFEALQARHGRVSAEHFLSQQGLADIYAALGGGLDDSDEVILARVRDGDETAREALSIFSALLGAFAGDAALSFAARGGVYINSPLMERIDGLLDQAAFSRRFEDKGRMSAYLKDIPVYLAVGRCTLLGLSALFTASDLRYEAAEVKVLDC

SEQ ID NO: 50144 - DNA, 1005 bp, Xylella fastidiosa
  CDS (1)..(1005): transl_table=11
atgattccgacccctacccgagatgcacccaatatcccgtcctttcttgccgccgatgtcggcggcactcacgtgcgcgtcagcgtggttgcagccgcgcccacgtgtgctagtccaccgcaactgttcgatgtgcgcacttaccgctgcgctgactatcccagcctcagcacaattctgaacgacttcctcggtacaagatcagcagtacgtgattgcgtcatcgccagtgccggttttcagcgcagcgatggtactgttatcactaccaacctaccgtggccgctatcaccacaccggctacgcgcagatctcaatctggcagaggtctgtctggtcaacgactttgaggcgctggcctacgcgacggaggatatggagcctgcgcaattgctgcacctcactggtccagccaaagcgcaggatggaccacgcctgttgctcggtccgggaaccggcctgggtgcagcactctggattcccaataacggacgccccattgtcctccccacagaagccggtcaagcagcattgccgagtacaactgaacttgaaatgcaactggtacgacacatgctgaacaaccgcacacatgtgccgattgagcatgccttatctgggccaggaatactcaatgtgtaccgcgccttgtgtgcgctacagtccgtcctcccccagcacgcgagcccagatgcgatcagtcacgctgcggcagcaggaacagacatgctgtcatcacagactctagaggtgttctgcgacttcctcggcagcatcgttggtgatttggtcatgatgtacggtgcacaggggggtgtctatctggccggaggaatcctgccgcagctgcgtgagccgctgctacgcagtcactttgtcgaacgcttcctcaataaaggccccatgggtgaggcattacagcacgtcccggtgcggctgatcgaacatgggcaactcggtatcgtaggtgcggcacgctggtacttaaataagaaagcaacttaa

SEQ ID NO: 50145 - protein, 334 aa, Xylella fastidiosa
MIPTPTRDAPNIPSFLAADVGGTHVRVSVVAAAPTCASPPQLFDVRTYRCADYPSLSTILNDFLGTRSAVRDCVIASAGFQRSDGTVITTNLPWPLSPHRLRADLNLAEVCLVNDFEALAYATEDMEPAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 50146 - DNA, 25 bp, Artificial sequence
  (1)..(25): primer
atgacaaagtatgcattagtcggtg

SEQ ID NO: 50147 - DNA, 24 bp, Artificial sequence
  (1)..(24): primer
ttacagaatgtgacctaaggtctg

SEQ ID NO: 50148 - protein, 377 aa, Artificial sequence
  Variant (2)..(2): xaa in position 2 is any amino acid
  Variant (6)..(54): xaa in position 6 to 54 is any amino acid
  Variant (55)..(79): xaa in position 55 to 79 is any or no amino acid
  Variant (81)..(81): xaa in position 81 is any amino acid
  Variant (83)..(90): xaa in position 83 to 90 is any amino acid
  Variant (93)..(94): xaa in position 93 to 94 is any amino acid
  Variant (95)..(95): xaa in position 95 is any or no amino acid
  Variant (97)..(106): xaa in position 97 to 106 is any amino acid
  Variant (108)..(113): xaa in position 108 to 113 is any amino acid
  Variant (114)..(118): xaa in position 114 to 118 is any or no amino acid
  Variant (122)..(122): xaa in position 122 is any amino acid
  Variant (124)..(152): xaa in position 124 to 152 is any amino acid
  Variant (153)..(168): xaa in position 153 to 168 is any or no amino acid
  Variant (170)..(170): xaa in position 170 is any amino acid
  Variant (176)..(187): xaa in position 176 to 187 is any amino acid
  Variant (188)..(193): xaa in position 188 to 193 is any or no amino acid
  Variant (198)..(223): xaa in position 198 to 223 is any amino acid
  Variant (225)..(226): xaa in position 225 to 226 is any amino acid
  Variant (227)..(235): xaa in position 227 to 235 is any or no amino acid
  Variant (238)..(238): xaa in position 238 is any amino acid
  Variant (240)..(270): xaa in position 240 to 270 is any amino acid
  Variant (271)..(301): xaa in position 271 to 301 is any or no amino acid
  Variant (303)..(306): xaa in position 303 to 306 is any amino acid
  Variant (308)..(310): xaa in position 308 to 310 is any amino acid
  Variant (312)..(314): xaa in position 312 to 314 is any amino acid
  Variant (316)..(320): xaa in position 316 to 320 is any amino acid
  Variant (323)..(326): xaa in position 323 to 326 is any amino acid
  Variant (329)..(340): xaa in position 329 to 340 is any amino acid
  Variant (341)..(344): xaa in position 341 to 344 is any or no amino acid
  Variant (346)..(348): xaa in position 346 to 348 is any amino acid
  Variant (350)..(351): xaa in position 350 to 351 is any amino acid
  Variant (354)..(360): xaa in position 354 to 360 is any amino acid
  Variant (361)..(363): xaa in position 361 to 363 is any or no amino acid
  Variant (365)..(376): xaa in position 365 to 376 is any amino acid
DXGGTXXXXXXXXXXXXXXXXXXXXXXXXXXXXXXXXXXXXXXXXXXXXXXXXXXXXXXXXXXXXXXXXXXXXXXXXXXAXPXXXXXXXXTNXXXWXXXXXXXXXXLXXXXXXXXXXXNDFXAXXXXXXXXXXXXXXXXXXXXXXXXXXXXXXXXXXXXXXXXXXXXXGXGTGLGXXXXXXXXXXXXXXXXXXEGGHXXXXXXXXXXXXXXXXXXXXXXXXXXEXXXXXXXXXXXSGXGXXXXXXXXXXXXXXXXXXXXXXXXXXXXXXXXXXXXXXXXXXXXXXXXXXXXXXXXXXXXXXFXXXXGXXXGXXXLXXXXXGGXXXXGGXXXXXXXXXXXXXXXXFXXXFXXKGXXXXXXXXXXPXXXXXXXXXXXXG

SEQ ID NO: 50149 - protein, 11 aa, Artificial sequence
  Variant (2)..(2): xaa in position 2 is Ile or Val
  Variant (6)..(7): xaa in position 6 to 7 is any amino acid
  Variant (8)..(9): xaa in position 8 to 9 is any or no amino acid
  Variant (11)..(11): xaa in position 11 is Phe, Leu, Met or Val
DXGGTXXXXRX

SEQ ID NO: 50150 - protein, 49 aa, Artificial sequence
  Variant (2)..(13): xaa in position 2 to 13 is any amino acid
  Variant (14)..(16): xaa in position 14 to 16 is any or no amino acid
  Variant (19)..(20): xaa in position 19 to 20 is any amino acid
  Variant (22)..(22): xaa in position 22 is any amino acid
  Variant (23)..(23): xaa in position 23 is Phe, Ile, Leu or Val
  Variant (24)..(38): xaa in position 24 to 38 is any amino acid
  Variant (39)..(39): xaa in position 39 is Ile, Leu or Val
  Variant (40)..(40): xaa in position 40 is Ile, Leu, Met or Val
  Variant (43)..(43): xaa in position 43 is Phe, Leu or Val
  Variant (44)..(44): xaa in position 44 is any amino acid
  Variant (45)..(45): xaa in position 45 is Ala, Cys, Gly, Thr or Val
  Variant (46)..(48): xaa in position 46 to 48 is any amino acid
  Variant (49)..(49): xaa in position 49 is Ala, Gly or Ser
AXXXXXXXXXXXXXXXTNXXWXXXXXXXXXXXXXXXXXXXNDXXXXXXX

SEQ ID NO: 50151 - protein, 63 aa, Artificial sequence
  Variant (2)..(2): xaa in position 2 is Ala or Pro
  Variant (8)..(23): xaa in position 8 to 23 is any amino acid
  Variant (24)..(25): xaa in position 24 to 25 is any or no amino acid
  Variant (27)..(27): xaa in position 27 is Ala or Gly
  Variant (29)..(30): xaa in position 29 to 30 is any amino acid
  Variant (31)..(31): xaa in position 31 is Ala, Asp, Glu, Gly, Asn, Ser or Thr
  Variant (32)..(38): xaa in position 32 to 38 is any amino acid
  Variant (39)..(39): xaa in position 39 is Asp, Glu, Gln or Thr
  Variant (40)..(41): xaa in position 40 to 41 is any amino acid
  Variant (42)..(42): xaa in position 42 is Ala, Ile, Leu or Val
  Variant (43)..(55): xaa in position 43 to 55 is any amino acid
  Variant (56)..(56): xaa in position 56 is Glu, Gly or Ser
  Variant (57)..(60): xaa in position 57 to 60 is any amino acid
  Variant (61)..(61): xaa in position 61 is Gly, Ile or Val
  Variant (62)..(62): xaa in position 62 is any amino acid
  Variant (63)..(63): xaa in position 63 is Ala or Gly
GXGTGLGXXXXXXXXXXXXXXXXXXEXGXXXXXXXXXXXXXXXXXXXXXXXXXXXXXXXXXXX

SEQ ID NO: 50152 - protein, 74 aa, Artificial sequence
  Variant (2)..(5): xaa in position 2 to 5 is any amino acid
  Variant (6)..(6): xaa in position 6 is Ala or Gly
  Variant (7)..(8): xaa in position 7 to 8 is any amino acid
  Variant (9)..(9): xaa in position 9 is Ala, Cys, Gly, Ser, Thr or Val
  Variant (10)..(10): xaa in position 10 is any amino acid
  Variant (11)..(11): xaa in position 11 is Asp, Asn or Ser
  Variant (12)..(13): xaa in position 12 to 13 is any amino acid
  Variant (14)..(14): xaa in position 14 is Leu, Met or Val
  Variant (15)..(19): xaa in position 15 to 19 is any amino acid
  Variant (20)..(20): xaa in position 20 is Asp, Gly, Asn or Ser
  Variant (22)..(24): xaa in position 22 to 24 is any amino acid
  Variant (25)..(25): xaa in position 25 is any or no amino acid
  Variant (28)..(40): xaa in position 28 to 40 is any amino acid
  Variant (41)..(41): xaa in position 41 is any or no amino acid
  Variant (43)..(59): xaa in position 43 to 59 is any amino acid
  Variant (60)..(60): xaa in position 60 is any or no amino acid
  Variant (62)..(70): xaa in position 62 to 70 is any amino acid
  Variant (71)..(71): xaa in position 71 is Ala, Gly, Pro or Ser
  Variant (72)..(72): xaa in position 72 is Phe, Ile, Leu or Val
  Variant (73)..(73): xaa in position 73 is any amino acid
FXXXXXXXXXXXXXXXXXXXGXXXXGGXXXXXXXXXXXXXXFXXXXXXXXXXXXXXXXXXPXXXXXXXXXXXXG

SEQ ID NO: 50153 - DNA, 417 bp, Escherichia coli K12
  CDS (1)..(417): transl_table=11
atgatgactaaaacccaaataaataaattaataaaaatgatgaatgatttagactatccatttgaagcaccgctcaaggaatcatttattgaaagtataatccaaatagaatttaattctaattcaactaattgcctggagaagttatgtaatgaagttagtattctttttaagaatcaacctgattatcttacttttttaagagcaatggatggattcgaagttaatggattacgattatttagcctctcgattccagaaccttcagttaaaaacctttttgccgtaaatgaattttatagaaataatgatgatttcataaaccctgatctacaagaacggttagtgatcggggattatagcatttcaatatttacttatgacattaaaggtgatgctgccaacttactgatttag

SEQ ID NO: 50154 - protein, 138 aa, Escherichia coli K12
MMTKTQINKLIKMMNDLDYPFEAPLKESFIESIIQIEFNSNSTNCLEKLCNEVSILFKNQPDYLTFLRAMDGFEVNGLRLFSLSIPEPSVKNLFAVNEFYRNNDDFINPDLQERLVIGDYSISIFTYDIKGDAANLLI

SEQ ID NO: 50155 - DNA, 495 bp, Escherichia coli CFT073
  CDS (1)..(495): transl_table=11
atgatgactaaaacccaaataagtaaattaaaaaaaatgatgaatgatttagactatccatttgaagcaccgctcaaggaatcatttattgaaagtataatccaaataaaatttaattctaactcaactaattgcctggagaagttatgtaatgaagttagtattctctttaataatcaacctgattatcttacttttttaagagcaatggatggattcgaagttaatggattacgattatttagcctctcgattccagaaccttcagttaaaaacctttttgccgtaaatgaattttatagagataatgatgatttcataaatcctgacttacaagaacggttagtgatcggggatgatagcatttcaatatttacttatgacattaaaagtaacttttttgaaattagagataatattggcacagaaaatatattcagttcgtttagtgatttctcttcattcttaaacgaaatcatggacagttgttcataa

SEQ ID NO: 50156 - protein, 164 aa, Escherichia coli CFT073
MMTKTQISKLKKMMNDLDYPFEAPLKESFIESIIQIKFNSNSTNCLEKLCNEVSILFNNQPDYLTFLRAMDGFEVNGLRLFSLSIPEPSVKNLFAVNEFYRDNDDFINPDLQERLVIGDDSISIFTYDIKSNFFEIRDNIGTENIFSSFSDFSSFLNEIMDSCS

SEQ ID NO: 50157 - DNA, 507 bp, Serratia marcescens
  CDS (1)..(507): transl_table=11
atgaaagatttaactcaactactcagcagcttaaagaggttgatggttgcagatcactaccctttagccagcccggtagccccggaagtcttgaaagacttaatctgcaatccgcctccagtggagtgggcagatcacaaaaagagcgcctatatagatatacagaaactcattaaaaccaggcttgattatgcccaagtgtttaatgctatggatggttttgagtacaacggacttacgttttataaccttgttcaggcagagaacgaaaatctattgtggtcaaatatttacatacgcaactttgaagcacgagacaatgaaatctacgttgacccaaatctcactgataaggtgttaatcggagaagatggcatgtcacttttcgcttatagttttgcagacgactgctttcagataagagacaaagcatctactgattatgttattgaatctcatacagagtttgatagatttttgtcttcactgattcaaaccgtcagttga

SEQ ID NO: 50158 - protein, 168 aa, Serratia marcescens
MKDLTQLLSSLKRLMVADHYPLASPVAPEVLKDLICNPPPVEWADHKKSAYIDIQKLIKTRLDYAQVFNAMDGFEYNGLTFYNLVQAENENLLWSNIYIRNFEARDNEIYVDPNLTDKVLIGEDGMSLFAYSFADDCFQIRDKASTDYVIESHTEFDRFLSSLIQTVS

SEQ ID NO: 50159 - DNA, 28 bp, Artificial sequence
  (1)..(28): primer
atgatgactaaaacccaaataaataaat

SEQ ID NO: 50160 - DNA, 26 bp, Artificial sequence
  (1)..(26): primer
ttaaatcagtaagttggcagcatcac

SEQ ID NO: 50161 - protein, 121 aa, Artificial sequence
  Variant (2)..(4): xaa in position 2 to 4 is any amino acid
  Variant (6)..(9): xaa in position 6 to 9 is any amino acid
  Variant (12)..(14): xaa in position 12 to 14 is any amino acid
  Variant (16)..(24): xaa in position 16 to 24 is any amino acid
  Variant (26)..(46): xaa in position 26 to 46 is any amino acid
  Variant (48)..(52): xaa in position 48 to 52 is any amino acid
  Variant (55)..(59): xaa in position 55 to 59 is any amino acid
  Variant (66)..(66): xaa in position 66 is any amino acid
  Variant (70)..(73): xaa in position 70 to 73 is any amino acid
  Variant (75)..(77): xaa in position 75 to 77 is any amino acid
  Variant (79)..(82): xaa in position 79 to 82 is any amino acid
  Variant (83)..(85): xaa in position 83 to 85 is any or no amino acid
  Variant (87)..(90): xaa in position 87 to 90 is any amino acid
  Variant (92)..(94): xaa in position 92 to 94 is any amino acid
  Variant (96)..(96): xaa in position 96 is any amino acid
  Variant (98)..(102): xaa in position 98 to 102 is any amino acid
  Variant (104)..(104): xaa in position 104 is any amino acid
  Variant (106)..(110): xaa in position 106 to 110 is any amino acid
  Variant (113)..(116): xaa in position 113 to 116 is any amino acid
  Variant (118)..(118): xaa in position 118 is any amino acid
  Variant (120)..(120): xaa in position 120 is any amino acid
LXXXMXXXXYPXXXPXXXXXXXXXIXXXXXXXXXXXXXXXXXXXXXLXXXXXDYXXXXXAMDGFEXNGLXXXXLXXXEXXXXXXXNXXXXNXXXRXNXXXXXPXLXXXXXIGXXXXSXFXY

SEQ ID NO: 50162 - protein, 25 aa, Artificial sequence
  Variant (2)..(3): xaa in position 2 to 3 is any or no amino acid
  Variant (5)..(5): xaa in position 5 is Met or Val
  Variant (6)..(6): xaa in position 6 is Ala or Asn
  Variant (8)..(8): xaa in position 8 is any amino acid
  Variant (9)..(9): xaa in position 9 is any or no amino acid
  Variant (12)..(12): xaa in position 12 is Phe or Leu
  Variant (13)..(13): xaa in position 13 is Ala or Glu
  Variant (14)..(14): xaa in position 14 is Ala or Ser
  Variant (16)..(16): xaa in position 16 is Leu or Val
  Variant (17)..(17): xaa in position 17 is any amino acid
  Variant (18)..(18): xaa in position 18 is Glu or Pro
  Variant (19)..(19): xaa in position 19 is Glu or Ser
  Variant (20)..(20): xaa in position 20 is Phe or Val
  Variant (21)..(21): xaa in position 21 is Ile or Leu
  Variant (22)..(22): xaa in position 22 is Glu or Lys
  Variant (23)..(23): xaa in position 23 is Asp or Ser
  Variant (24)..(24): xaa in position 24 is Ile or Leu
KXXMXXDXXYPXXXPXXXXXXXXXI

SEQ ID NO: 50163 - protein, 33 aa, Artificial sequence
  Variant (2)..(2): xaa in position 2 is Phe or Ile
  Variant (3)..(3): xaa in position 3 is any amino acid
  Variant (4)..(4): xaa in position 4 is Asn or Thr
  Variant (5)..(5): xaa in position 5 is Gln or Arg
  Variant (6)..(6): xaa in position 6 is Leu or Pro
  Variant (9)..(10): xaa in position 9 to 10 is any amino acid
  Variant (11)..(11): xaa in position 11 is any or no amino acid
  Variant (13)..(13): xaa in position 13 is any amino acid
  Variant (14)..(14): xaa in position 14 is any or no amino acid
  Variant (21)..(21): xaa in position 21 is any amino acid
  Variant (25)..(25): xaa in position 25 is any amino acid
  Variant (26)..(26): xaa in position 26 is any or no amino acid
  Variant (28)..(30): xaa in position 28 to 30 is any amino acid
  Variant (31)..(31): xaa in position 31 is Ile or Val
  Variant (32)..(32): xaa in position 32 is Pro or Gln
  Variant (33)..(33): xaa in position 33 is Ala or Glu
LXXXXXDYXXXFXXAMDGFEXNGLXXFXXXXXX

SEQ ID NO: 50164 - protein, 37 aa, Artificial sequence
  Variant (2)..(6): xaa in position 2 to 6 is any amino acid
  Variant (7)..(7): xaa in position 7 is any or no amino acid
  Variant (9)..(9): xaa in position 9 is any amino acid
  Variant (10)..(10): xaa in position 10 is any or no amino acid
  Variant (12)..(12): xaa in position 12 is Asp or Asn
  Variant (14)..(14): xaa in position 14 is Asp or Glu
  Variant (15)..(15): xaa in position 15 is any amino acid
  Variant (16)..(16): xaa in position 16 is Phe or Tyr
  Variant (17)..(17): xaa in position 17 is Ile or Val
  Variant (18)..(18): xaa in position 18 is Asp or Asn
  Variant (20)..(20): xaa in position 20 is Asp or Asn
  Variant (22)..(22): xaa in position 22 is Gln or Thr
  Variant (23)..(23): xaa in position 23 is Asp or Glu
  Variant (24)..(24): xaa in position 24 is Lys or Arg
  Variant (25)..(26): xaa in position 25 to 26 is Leu or Val
  Variant (29)..(29): xaa in position 29 is Asp or Glu
  Variant (30)..(30): xaa in position 30 is any amino acid
  Variant (31)..(31): xaa in position 31 is Gly or Ser
  Variant (32)..(32): xaa in position 32 is Ile or Met
  Variant (34)..(34): xaa in position 34 is Ile or Leu
  Variant (36)..(36): xaa in position 36 is Ala or Thr
NXXXXXXFXXRXNXXXXXPXLXXXXXIGXXXXSXFXY

SEQ ID NO: 50165 - DNA, 609 bp, Escherichia coli; identical to SEQ ID NO: 48336
  CDS (1)..(609)

SEQ ID NO: 50166 - protein, 202 aa, Escherichia coli; identical to SEQ ID NO: 48337

SEQ ID NO: 50167 - DNA, 552 bp, Vibrio cholerae O1 biovar eltor str. N16961; identical to SEQ ID NO: 48338
  CDS (1)..(552): transl_table=11

SEQ ID NO: 50168 - protein, 183 aa, Vibrio cholerae O1 biovar eltor str. N16961; identical to SEQ ID NO: 48339

SEQ ID NO: 50169 - DNA, 513 bp, Pasteurella multocida subsp. multocida str. Pm70; identical to SEQ ID NO: 48340
  CDS (1)..(513): transl_table=11

SEQ ID NO: 50170 - protein, 170 aa, Pasteurella multocida subsp. multocida str. Pm70; identical to SEQ ID NO: 48341

SEQ ID NO: 50171 - DNA, 537 bp, Pseudomonas aeruginosa PAO1; identical to SEQ ID NO: 48342
  CDS (1)..(537): transl_table=11

SEQ ID NO: 50172 - protein, 178 aa, Pseudomonas aeruginosa PAO1; identical to SEQ ID NO: 48343

SEQ ID NO: 50173 - DNA, 498 bp, Escherichia coli O157:H7; identical to SEQ ID NO: 48344
  CDS (1)..(498): transl_table=11

SEQ ID NO: 50174 - protein, 165 aa, Escherichia coli O157:H7; identical to SEQ ID NO: 48345

SEQ ID NO: 50175 - DNA, 525 bp, Yersinia pestis CO92; identical to SEQ ID NO: 48346
  CDS (1)..(525): transl_table=11

SEQ ID NO: 50176 - protein, 174 aa, Yersinia pestis CO92; identical to SEQ ID NO: 48347

SEQ ID NO: 50177 - DNA, 498 bp, Salmonella typhimurium LT2; identical to SEQ ID NO: 48348
  CDS (1)..(498): transl_table=11

SEQ ID NO: 50178 - protein, 165 aa, Salmonella typhimurium LT2; identical to SEQ ID NO: 48349

SEQ ID NO: 50179 - DNA, 531 bp, Ralstonia solanacearum GMI1000; identical to SEQ ID NO: 48350
  CDS (1)..(531): transl_table=11

SEQ ID NO: 50180 - protein, 176 aa, Ralstonia solanacearum GMI1000; identical to SEQ ID NO: 48351

SEQ ID NO: 50181 - DNA, 567 bp, Yersinia pestis KIM; identical to SEQ ID NO: 48352
  CDS (1)..(567): transl_table=11

SEQ ID NO: 50182 - protein, 188 aa, Yersinia pestis KIM; identical to SEQ ID NO: 48353

SEQ ID NO: 50183 - DNA, 498 bp, Shigella flexneri 2a str. 301; identical to SEQ ID NO: 48354
  CDS (1)..(498): transl_table=11

SEQ ID NO: 50184 - protein, 165 aa, Shigella flexneri 2a str. 301; identical to SEQ ID NO: 48355

SEQ ID NO: 50185 - DNA, 570 bp, Shewanella oneidensis MR-1; identical to SEQ ID NO: 48356
  CDS (1)..(570): transl_table=11

SEQ ID NO: 50186 - protein, 189 aa, Shewanella oneidensis MR-1; identical to SEQ ID NO: 48357

SEQ ID NO: 50187 - DNA, 558 bp, Pseudomonas putida KT2440; identical to SEQ ID NO: 48358
  CDS (1)..(558): transl_table=11

SEQ ID NO: 50188 - protein, 185 aa, Pseudomonas putida KT2440; identical to SEQ ID NO: 48359

SEQ ID NO: 50189 - DNA, 498 bp, Escherichia coli CFT073; identical to SEQ ID NO: 48360
  CDS (1)..(498): transl_table=11

SEQ ID NO: 50190 - protein, 165 aa, Escherichia coli CFT073; identical to SEQ ID NO: 48361

SEQ ID NO: 50191 - DNA, 540 bp, Vibrio vulnificus CMCP6; identical to SEQ ID NO: 48362
  CDS (1)..(540): transl_table=11

SEQ ID NO: 50192 - protein, 179 aa, Vibrio vulnificus CMCP6; identical to SEQ ID NO: 48363

SEQ ID NO: 50193 - DNA, 561 bp, Pseudomonas syringae pv. tomato str. DC3000; identical to SEQ ID NO: 48364
  CDS (1)..(561): transl_table=11

SEQ ID NO: 50194 - protein, 186 aa, Pseudomonas syringae pv. tomato str. DC3000; identical to SEQ ID NO: 48365

SEQ ID NO: 50195 - DNA, 552 bp, Vibrio parahaemolyticus RIMD 2210633; identical to SEQ ID NO: 48366
  CDS (1)..(552): transl_table=11

SEQ ID NO: 50196 - protein, 183 aa, Vibrio parahaemolyticus RIMD 2210633; identical to SEQ ID NO: 48367

SEQ ID NO: 50197 - DNA, 498 bp, Salmonella enterica subsp. enterica serovar Typhi Ty2; identical to SEQ ID NO: 48368
  CDS (1)..(498): transl_table=11

SEQ ID NO: 50198 - protein, 165 aa, Salmonella enterica subsp. enterica serovar Typhi Ty2; identical to SEQ ID NO: 48369

SEQ ID NO: 50199 - DNA, 558 bp, Coxiella burnetii RSA 493; identical to SEQ ID NO: 48370
  CDS (1)..(558): transl_table=11

SEQ ID NO: 50200 - protein, 185 aa, Coxiella burnetii RSA 493; identical to SEQ ID NO: 48371

SEQ ID NO: 50201 - DNA, 537 bp, Nitrosomonas europaea ATCC 19718; identical to SEQ ID NO: 48372
  CDS (1)..(537): transl_table=11

SEQ ID NO: 50202 - protein, 178 aa, Nitrosomonas europaea ATCC 19718; identical to SEQ ID NO: 48373

SEQ ID NO: 50203 - DNA, 573 bp, Bordetella bronchiseptica RB50; identical to SEQ ID NO: 48374
  CDS (1)..(573): transl_table=11

SEQ ID NO: 50204 - protein, 190 aa, Bordetella bronchiseptica RB50; identical to SEQ ID NO: 48375

SEQ ID NO: 50205 - DNA, 519 bp, Photorhabdus luminescens subsp. laumondii TTO1; identical to SEQ ID NO: 48376
  CDS (1)..(519): transl_table=11

SEQ ID NO: 50206 - protein, 172 aa, Photorhabdus luminescens subsp. laumondii TTO1; identical to SEQ ID NO: 48377

SEQ ID NO: 50207 - DNA, 552 bp, Vibrio vulnificus YJ016; identical to SEQ ID NO: 48378
  CDS (1)..(552): transl_table=11

SEQ ID NO: 50208 - protein, 183 aa, Vibrio vulnificus YJ016; identical to SEQ ID NO: 48379

SEQ ID NO: 50209 - DNA, 519 bp, Bartonella quintana str. Toulouse; identical to SEQ ID NO: 48380
  CDS (1)..(519): transl_table=11

SEQ ID NO: 50210 - protein, 172 aa, Bartonella quintana str. Toulouse; identical to SEQ ID NO: 48381

SEQ ID NO: 50211 - DNA, 516 bp, Bartonella henselae str. Houston-1; identical to SEQ ID NO: 48382
  CDS (1)..(516): transl_table=11

SEQ ID NO: 50212 - protein, 171 aa, Bartonella henselae str. Houston-1; identical to SEQ ID NO: 48383

SEQ ID NO: 50213 - DNA, 504 bp, Acinetobacter sp. ADP1; identical to SEQ ID NO: 48384
  CDS (1)..(504): transl_table=11

SEQ ID NO: 50214 - protein, 167 aa, Acinetobacter sp. ADP1; identical to SEQ ID NO: 48385

SEQ ID NO: 50215 - DNA, 534 bp, Erwinia carotovora subsp. atroseptica SCRI1043; identical to SEQ ID NO: 48386
  CDS (1)..(534): transl_table=11

SEQ ID NO: 50216 - protein, 177 aa, Erwinia carotovora subsp. atroseptica SCRI1043; identical to SEQ ID NO: 48387

SEQ ID NO: 50217 - DNA, 594 bp, Burkholderia mallei ATCC 23344; identical to SEQ ID NO: 48388
  CDS (1)..(594): transl_table=11

SEQ ID NO: 50218 - protein, 197 aa, Burkholderia mallei ATCC 23344; identical to SEQ ID NO: 48389

SEQ ID NO: 50219 - DNA, 489 bp, Methylococcus capsulatus str. Bath; identical to SEQ ID NO: 48390
  CDS (1)..(489): transl_table=11

SEQ ID NO: 50220 - protein, 162 aa, Methylococcus capsulatus str. Bath; identical to SEQ ID NO: 48391

SEQ ID NO: 50221 - DNA, 543 bp, Photobacterium profundum SS9; identical to SEQ ID NO: 48392
  CDS (1)..(543): transl_table=11

SEQ ID NO: 50222 - protein, 180 aa, Photobacterium profundum SS9; identical to SEQ ID NO: 48393

SEQ ID NO: 50223 - DNA, 582 bp, Idiomarina loihiensis L2TR; identical to SEQ ID NO: 48394
  CDS (1)..(582): transl_table=11

SEQ ID NO: 50224 - protein, 193 aa, Idiomarina loihiensis L2TR; identical to SEQ ID NO: 48395

SEQ ID NO: 50225 - DNA, 558 bp, Azoarcus sp. EbN1; identical to SEQ ID NO: 48396
  CDS (1)..(558): transl_table=11

SEQ ID NO: 50226 - protein, 185 aa, Azoarcus sp. EbN1; identical to SEQ ID NO: 48397

SEQ ID NO: 50227 - DNA, 543 bp, Vibrio fischeri ES114; identical to SEQ ID NO: 48398
  CDS (1)..(543): transl_table=11

SEQ ID NO: 50228 - protein, 180 aa, Vibrio fischeri ES114; identical to SEQ ID NO: 48399

SEQ ID NO: 50229 - DNA, 498 bp, Salmonella enterica subsp. enterica serovar Choleraesuis str; identical to SEQ ID NO: 48400
  CDS (1)..(498): transl_table=11

SEQ ID NO: 50230 - protein, 165 aa, Salmonella enterica subsp. enterica serovar Choleraesuis str; identical to SEQ ID NO: 48401

SEQ ID NO: 50231 - DNA, 561 bp, Pseudomonas syringae pv. syringae B728a; identical to SEQ ID NO: 48402
  CDS (1)..(561): transl_table=11

SEQ ID NO: 50232 - protein, 186 aa, Pseudomonas syringae pv. syringae B728a; identical to SEQ ID NO: 48403

SEQ ID NO: 50233 - DNA, 504 bp, Haemophilus somnus 129PT; identical to SEQ ID NO: 48404
  CDS (1)..(504)

SEQ ID NO: 50234 - protein, 167 aa, Haemophilus somnus 129PT; identical to SEQ ID NO: 48405

SEQ ID NO: 50235 - DNA, 507 bp, Pseudomonas syringae pv. syringae B728a; identical to SEQ ID NO: 48406
  CDS (1)..(507)

SEQ ID NO: 50236 - protein, 168 aa, Pseudomonas syringae pv. syringae B728a; identical to SEQ ID NO: 48407

SEQ ID NO: 50237 - DNA, 483 bp, Actinobacillus pleuropneumoniae serovar 1 str. 4074; identical to SEQ ID NO: 48408
  CDS (1)..(483)

SEQ ID NO: 50238 - protein, 160 aa, Actinobacillus pleuropneumoniae serovar 1 str. 4074; identical to SEQ ID NO: 48409

SEQ ID NO: 50239 - DNA, 537 bp, Pseudomonas aeruginosa UCBPP-PA14; identical to SEQ ID NO: 48410
  CDS (1)..(537)

SEQ ID NO: 50240 - protein, 178 aa, Pseudomonas aeruginosa UCBPP-PA14; identical to SEQ ID NO: 48411

SEQ ID NO: 50241 - DNA, 507 bp, Psychrobacter sp. 273-4; identical to SEQ ID NO: 48412
  CDS (1)..(507)

SEQ ID NO: 50242 - protein, 168 aa, Psychrobacter sp. 273-4; identical to SEQ ID NO: 48413

SEQ ID NO: 50243 - DNA, 597 bp, Burkholderia cepacia R18194; identical to SEQ ID NO: 48414
  CDS (1)..(597)

SEQ ID NO: 50244 - protein, 198 aa, Burkholderia cepacia R18194; identical to SEQ ID NO: 48415

SEQ ID NO: 50245 - DNA, 552 bp, Pseudomonas fluorescens PfO-1; identical to SEQ ID NO: 48416
  CDS (1)..(552)

SEQ ID NO: 50246 - protein, 183 aa, Pseudomonas fluorescens PfO-1; identical to SEQ ID NO: 48417

SEQ ID NO: 50247 - DNA, 558 bp, Pseudomonas fluorescens PfO-1; identical to SEQ ID NO: 48418
  CDS (1)..(558)

SEQ ID NO: 50248 - protein, 185 aa, Pseudomonas fluorescens PfO-1; identical to SEQ ID NO: 48419

SEQ ID NO: 50249 - DNA, 684 bp, Burkholderia fungorum LB400; identical to SEQ ID NO: 48420
  CDS (1)..(684)

SEQ ID NO: 50250 - protein, 227 aa, Burkholderia fungorum LB400; identical to SEQ ID NO: 48421

SEQ ID NO: 50251 - DNA, 564 bp, Thiobacillus denitrificans ATCC 25259; identical to SEQ ID NO: 48422
  CDS (1)..(564)

SEQ ID NO: 50252 - protein, 187 aa, Thiobacillus denitrificans ATCC 25259; identical to SEQ ID NO: 48423

SEQ ID NO: 50253 - DNA, 531 bp, Dechloromonas aromatica RCB; identical to SEQ ID NO: 48424
  CDS (1)..(531)

SEQ ID NO: 50254 - protein, 176 aa, Dechloromonas aromatica RCB; identical to SEQ ID NO: 48425

SEQ ID NO: 50255 - DNA, 552 bp, Azotobacter vinelandii AvOP; identical to SEQ ID NO: 48426
  CDS (1)..(552): transl_table=11

SEQ ID NO: 50256 - protein, 183 aa, Azotobacter vinelandii AvOP; identical to SEQ ID NO: 48427

SEQ ID NO: 50257 - DNA, 597 bp, Burkholderia vietnamiensis G4; identical to SEQ ID NO: 48428
  CDS (1)..(597): transl_table=11

SEQ ID NO: 50258 - protein, 198 aa, Burkholderia vietnamiensis G4; identical to SEQ ID NO: 48429

SEQ ID NO: 50259 - DNA, 603 bp, Burkholderia mallei 10229; identical to SEQ ID NO: 48430
  CDS (1)..(603)

SEQ ID NO: 50260 - protein, 200 aa, Burkholderia mallei 10229; identical to SEQ ID NO: 48431

SEQ ID NO: 50261 - DNA, 597 bp, Burkholderia cenocepacia AU 1054; identical to SEQ ID NO: 48432
  CDS (1)..(597): transl_table=11

SEQ ID NO: 50262 - protein, 198 aa, Burkholderia cenocepacia AU 1054; identical to SEQ ID NO: 48433

SEQ ID NO: 50263 - DNA, 603 bp, Burkholderia pseudomallei 1655; identical to SEQ ID NO: 48434
  CDS (1)..(603)

SEQ ID NO: 50264 - protein, 200 aa, Burkholderia pseudomallei 1655; identical to SEQ ID NO: 48435

SEQ ID NO: 50265 - DNA, 552 bp, Chromohalobacter salexigens DSM 3043; identical to SEQ ID NO: 48436
  CDS (1)..(552): transl_table=11

SEQ ID NO: 50266 - protein, 183 aa, Chromohalobacter salexigens DSM 3043; identical to SEQ ID NO: 48437

SEQ ID NO: 50267 - DNA, 537 bp, Methylobacillus flagellatus KT; identical to SEQ ID NO: 48438
  CDS (1)..(537): transl_table=11

SEQ ID NO: 50268 - protein, 178 aa, Methylobacillus flagellatus KT; identical to SEQ ID NO: 48439

SEQ ID NO: 50269 - DNA, 564 bp, Shewanella baltica OS155; identical to SEQ ID NO: 48440
  CDS (1)..(564): transl_table=11

SEQ ID NO: 50270 - protein, 187 aa, Shewanella baltica OS155; identical to SEQ ID NO: 48441

SEQ ID NO: 50271 - DNA, 564 bp, Shewanella amazonensis SB2B; identical to SEQ ID NO: 48442
  CDS (1)..(564): transl_table=11

SEQ ID NO: 50272 - protein, 187 aa, Shewanella amazonensis SB2B; identical to SEQ ID NO: 48443

SEQ ID NO: 50273 - DNA, 615 bp, Shewanella frigidimarina NCIMB 400; identical to SEQ ID NO: 48444
  CDS (1)..(615): transl_table=11

SEQ ID NO: 50274 - protein, 204 aa, Shewanella frigidimarina NCIMB 400; identical to SEQ ID NO: 48445

SEQ ID NO: 50275 - DNA, 564 bp, Pseudomonas fluorescens; identical to SEQ ID NO: 48446
  CDS (1)..(564): transl_table=11

SEQ ID NO: 50276 - protein, 187 aa, Pseudomonas fluorescens; identical to SEQ ID NO: 48447

SEQ ID NO: 50277 - DNA, 609 bp, Xanthomonas albilineans; identical to SEQ ID NO: 48448
  CDS (1)..(609): transl_table=11

SEQ ID NO: 50278 - protein, 202 aa, Xanthomonas albilineans; identical to SEQ ID NO: 48449

SEQ ID NO: 50279 - DNA, 549 bp, Pseudomonas putida; identical to SEQ ID NO: 48450
  CDS (1)..(549): transl_table=11

SEQ ID NO: 50280 - protein, 182 aa, Pseudomonas putida; identical to SEQ ID NO: 48451

SEQ ID NO: 50281 - DNA, 549 bp, Pseudomonas sp; identical to SEQ ID NO: 48452
  CDS (1)..(549): transl_table=11

SEQ ID NO: 50282 - protein, 182 aa, Pseudomonas sp; identical to SEQ ID NO: 48453

SEQ ID NO: 50283 - DNA, 23 bp, Artificial sequence
  (1)..(23): primer
atgcgattgttgcgtttttgttg

SEQ ID NO: 50284 - DNA, 22 bp, Artificial sequence
  (1)..(22): primer
ttagtacaacggtgacgccggt

SEQ ID NO: 50285 - protein, 177 aa, Artificial sequence; identical to SEQ ID NO: 48456
  Variant (3)..(6): xaa in position 3 to 6 is any amino acid
  Variant (10)..(19): xaa in position 10 to 19 is any amino acid
  Variant (20)..(21): xaa in position 20 to 21 is any or no amino acid
  Variant (23)..(41): xaa in position 23 to 41 is any amino acid
  Variant (42)..(54): xaa in position 42 to 54 is any or no amino acid
  Variant (59)..(59): xaa in position 59 is any amino acid
  Variant (61)..(66): xaa in position 61 to 66 is any amino acid
  Variant (67)..(67): xaa in position 67 is any or no amino acid
  Variant (70)..(70): xaa in position 70 is any amino acid
  Variant (72)..(72): xaa in position 72 is any amino acid
  Variant (75)..(84): xaa in position 75 to 84 is any amino acid
  Variant (85)..(101): xaa in position 85 to 101 is any or no amino acid
  Variant (103)..(103): xaa in position 103 is any amino acid
  Variant (104)..(104): xaa in position 104 is any or no amino acid
  Variant (107)..(109): xaa in position 107 to 109 is any amino acid
  Variant (112)..(113): xaa in position 112 to 113 is any amino acid
  Variant (116)..(121): xaa in position 116 to 121 is any amino acid
  Variant (123)..(124): xaa in position 123 to 124 is any amino acid
  Variant (126)..(131): xaa in position 126 to 131 is any amino acid
  Variant (132)..(154): xaa in position 132 to 154 is any or no amino acid
  Variant (156)..(156): xaa in position 156 is any amino acid
  Variant (161)..(168): xaa in position 161 to 168 is any amino acid
  Variant (172)..(172): xaa in position 172 is any amino acid
  Variant (174)..(174): xaa in position 174 is any amino acid

SEQ ID NO: 50286 - protein, 9 aa, Artificial sequence
  Variant (2)..(2): xaa in position 2 is Leu or Val
  Variant (3)..(5): xaa in position 3 to 5 is any amino acid
  Variant (6)..(6): xaa in position 6 is Asp, Gly, Ser or Thr
  Variant (8)..(8): xaa in position 8 is Leu, Met or Val
WXXXXXSXT

SEQ ID NO: 50287 - protein, 17 aa, Artificial sequence
  Variant (3)..(3): xaa in position 3 is Ile or Val
  Variant (4)..(4): xaa in position 4 is any amino acid
  Variant (6)..(8): xaa in position 6 to 8 is any amino acid
  Variant (9)..(9): xaa in position 9 is Asp, Glu, Gly, Asn or Gln
  Variant (10)..(14): xaa in position 10 to 14 is any amino acid
  Variant (15)..(15): xaa in position 15 is Ala, Gly or Gln
  Variant (16)..(16): xaa in position 16 is any amino acid
  Variant (17)..(17): xaa in position 17 is Gln, Ser or Thr
REXXLXXXXXXXXXXXX

SEQ ID NO: 50288 - protein, 10 aa, Artificial sequence
  Variant (2)..(3): xaa in position 2 to 3 is any amino acid
  Variant (4)..(4): xaa in position 4 is Ala, Pro or Ser
  Variant (5)..(5): xaa in position 5 is Ile or Leu
  Variant (7)..(8): xaa in position 7 to 8 is any amino acid
  Variant (9)..(9): xaa in position 9 is Leu or Val
GXXXXGXXXF

SEQ ID NO: 50289 - protein, 23 aa, Artificial sequence
  Variant (2)..(3): xaa in position 2 to 3 is any or no amino acid
  Variant (5)..(5): xaa in position 5 is any or no amino acid
  Variant (7)..(14): xaa in position 7 to 14 is any amino acid
  Variant (15)..(15): xaa in position 15 is Ile, Leu, Met or Val
  Variant (16)..(16): xaa in position 16 is Leu or Met
  Variant (17)..(17): xaa in position 17 is Ile, Leu or Val
  Variant (18)..(18): xaa in position 18 is any amino acid
  Variant (20)..(21): xaa in position 20 to 21 is any amino acid
  Variant (23)..(23): xaa in position 23 is Ala, Pro or Ser
RXXRXSXXXXXXXXXXXXEXXLX

SEQ ID NO: 50290 - DNA, 2970 bp, Saccharomyces cerevisiae; identical to SEQ ID NO: 34137
  CDS (1)..(2970)

SEQ ID NO: 50291 - protein, 989 aa, Saccharomyces cerevisiae; identical to SEQ ID NO: 34138

SEQ ID NO: 50292 - DNA, 2973 bp, Eremothecium gossypii; identical to SEQ ID NO: 34139
  CDS (1)..(2973)

SEQ ID NO: 50293 - protein, 990 aa, Eremothecium gossypii; identical to SEQ ID NO: 34140

SEQ ID NO: 50294 - DNA, 3039 bp, Neurospora crassa; identical to SEQ ID NO: 34141
  CDS (1)..(3039)

SEQ ID NO: 50295 - protein, 1012 aa, Neurospora crassa; identical to SEQ ID NO: 34142

SEQ ID NO: 50296 - DNA, 2967 bp, Magnaporthe grisea 70-15; identical to SEQ ID NO: 34143
  CDS (1)..(2967)

SEQ ID NO: 50297 - protein, 988 aa, Magnaporthe grisea 70-15; identical to SEQ ID NO: 34144

SEQ ID NO: 50298 - DNA, 3015 bp, Gibberella zeae PH-1; identical to SEQ ID NO: 34145
  CDS (1)..(3015)

SEQ ID NO: 50299 - protein, 1004 aa, Gibberella zeae PH-1; identical to SEQ ID NO: 34146

SEQ ID NO: 50300 - DNA, 2973 bp, Candida glabrata CBS138; identical to SEQ ID NO: 34147
  CDS (1)..(2973)

SEQ ID NO: 50301 - protein, 990 aa, Candida glabrata CBS138; identical to SEQ ID NO: 34148

SEQ ID NO: 50302 - DNA, 2949 bp, Kluyveromyces lactis NRRL Y-1140; identical to SEQ ID NO: 34149
  CDS (1)..(2949)

SEQ ID NO: 50303 - protein, 982 aa, Kluyveromyces lactis NRRL Y-1140; identical to SEQ ID NO: 34150

SEQ ID NO: 50304 - DNA, 3192 bp, Debaryomyces hansenii CBS767; identical to SEQ ID NO: 34151
  CDS (1)..(3192)

SEQ ID NO: 50305 - protein, 1063 aa, Debaryomyces hansenii CBS767; identical to SEQ ID NO: 34152

SEQ ID NO: 50306 - DNA, 2973 bp, Yarrowia lipolytica CLIB99; identical to SEQ ID NO: 34153
  CDS (1)..(2973)

SEQ ID NO: 50307 - protein, 990 aa, Yarrowia lipolytica CLIB99; identical to SEQ ID NO: 34154

SEQ ID NO: 50308 - DNA, 3150 bp, Aspergillus nidulans FGSC A4; identical to SEQ ID NO: 34155
  CDS (1)..(3150)

SEQ ID NO: 50309 - protein, 1049 aa, Aspergillus nidulans FGSC A4; identical to SEQ ID NO: 34156

SEQ ID NO: 50310 - DNA, 3105 bp, Candida albicans SC5314; identical to SEQ ID NO: 34157
  CDS (1)..(3105): transl_table=12

SEQ ID NO: 50311 - protein, 1034 aa, Candida albicans SC5314; identical to SEQ ID NO: 34158

SEQ ID NO: 50312 - DNA, 3198 bp, Aspergillus fumigatus Af293; identical to SEQ ID NO: 34159
  CDS (1)..(3198)

SEQ ID NO: 50313 - protein, 1065 aa, Aspergillus fumigatus Af293; identical to SEQ ID NO: 34160

SEQ ID NO: 50314 - DNA, 23 bp, Artificial sequence
  (1)..(23): primer
atgttgcggtttcagcgatttgc

SEQ ID NO: 50315 - DNA, 24 bp, Artificial sequence
  (1)..(24): primer
ctacagttccttcacctcccaatt

SEQ ID NO: 50316 - protein, 1038 aa, Artificial sequence; identical to SEQ ID NO: 34163
  Variant (2)..(3): xaa in position 2 to 3 is any amino acid
  Variant (8)..(8): xaa in position 8 is any amino acid
  Variant (10)..(14): xaa in position 10 to 14 is any amino acid
  Variant (18)..(19): xaa in position 18 to 19 is any amino acid
  Variant (21)..(21): xaa in position 21 is any amino acid
  Variant (24)..(24): xaa in position 24 is any amino acid
  Variant (26)..(26): xaa in position 26 is any amino acid
  Variant (28)..(28): xaa in position 28 is any amino acid
  Variant (29)..(29): xaa in position 29 is any or no amino acid
  Variant (33)..(33): xaa in position 33 is any amino acid
  Variant (38)..(38): xaa in position 38 is any amino acid
  Variant (40)..(40): xaa in position 40 is any amino acid
  Variant (41)..(41): xaa in position 41 is any or no amino acid
  Variant (43)..(43): xaa in position 43 is any amino acid
  Variant (48)..(48): xaa in position 48 is any amino acid
  Variant (58)..(58): xaa in position 58 is any amino acid
  Variant (74)..(74): xaa in position 74 is any amino acid
  Variant (87)..(87): xaa in position 87 is any amino acid
  Variant (97)..(97): xaa in position 97 is any amino acid
  Variant (100)..(100): xaa in position 100 is any amino acid
  Variant (112)..(113): xaa in position 112 to 113 is any amino acid
  Variant (116)..(116): xaa in position 116 is any amino acid
  Variant (119)..(120): xaa in position 119 to 120 is any amino acid
  Variant (124)..(124): xaa in position 124 is any amino acid
  Variant (128)..(128): xaa in position 128 is any amino acid
  Variant (132)..(134): xaa in position 132 to 134 is any amino acid
  Variant (137)..(137): xaa in position 137 is any amino acid
  Variant (144)..(154): xaa in position 144 to 154 is any amino acid
  Variant (155)..(166): xaa in position 155 to 166 is any or no amino acid
  Variant (183)..(183): xaa in position 183 is any amino acid
  Variant (185)..(185): xaa in position 185 is any amino acid
  Variant (187)..(187): xaa in position 187 is any amino acid
  Variant (193)..(193): xaa in position 193 is any amino acid
  Variant (195)..(195): xaa in position 195 is any amino acid
  Variant (199)..(199): xaa in position 199 is any amino acid
  Variant (208)..(209): xaa in position 208 to 209 is any amino acid
  Variant (214)..(214): xaa in position 214 is any amino acid
  Variant (216)..(217): xaa in position 216 to 217 is any amino acid
  Variant (219)..(220): xaa in position 219 to 220 is any amino acid
  Variant (223)..(225): xaa in position 223 to 225 is any amino acid
  Variant (233)..(233): xaa in position 233 is any amino acid
  Variant (238)..(240): xaa in position 238 to 240 is any amino acid
  Variant (242)..(244): xaa in position 242 to 244 is any amino acid
  Variant (246)..(247): xaa in position 246 to 247 is any amino acid
  Variant (249)..(254): xaa in position 249 to 254 is any amino acid
  Variant (256)..(256): xaa in position 256 is any amino acid
  Variant (258)..(262): xaa in position 258 to 262 is any amino acid
  Variant (263)..(280): xaa in position 263 to 280 is any or no amino acid
  Variant (282)..(295): xaa in position 282 to 295 is any or no amino acid
  Variant (297)..(297): xaa in position 297 is any amino acid
  Variant (304)..(305): xaa in position 304 to 305 is any amino acid
  Variant (307)..(309): xaa in position 307 to 309 is any amino acid
  Variant (311)..(312): xaa in position 311 to 312 is any amino acid
  Variant (313)..(315): xaa in position 313 to 315 is any or no amino acid
  Variant (319)..(321): xaa in position 319 to 321 is any amino acid
  Variant (324)..(325): xaa in position 324 to 325 is any amino acid
  Variant (328)..(328): xaa in position 328 is any amino acid
  Variant (332)..(332): xaa in position 332 is any amino acid
  Variant (334)..(335): xaa in position 334 to 335 is any amino acid
  Variant (337)..(338): xaa in position 337 to 338 is any amino acid
  Variant (342)..(342): xaa in position 342 is any amino acid
  Variant (343)..(343): xaa in position 343 is any or no amino acid
  Variant (347)..(348): xaa in position 347 to 348 is any amino acid
  Variant (351)..(351): xaa in position 351 is any amino acid
  Variant (355)..(355): xaa in position 355 is any amino acid
  Variant (357)..(364): xaa in position 357 to 364 is any amino acid
  Variant (369)..(369): xaa in position 369 is any amino acid
  Variant (371)..(396): xaa in position 371 to 396 is any amino acid
  Variant (397)..(405): xaa in position 397 to 405 is any or no amino acid
  Variant (408)..(408): xaa in position 408 is any amino acid
  Variant (410)..(410): xaa in position 410 is any amino acid
  Variant (417)..(418): xaa in position 417 to 418 is any amino acid
  Variant (420)..(422): xaa in position 420 to 422 is any amino acid
  Variant (424)..(424): xaa in position 424 is any amino acid
  Variant (428)..(428): xaa in position 428 is any amino acid
  Variant (431)..(432): xaa in position 431 to 432 is any amino acid
  Variant (434)..(436): xaa in position 434 to 436 is any amino acid
  Variant (438)..(438): xaa in position 438 is any amino acid
  Variant (440)..(441): xaa in position 440 to 441 is any amino acid
  Variant (444)..(446): xaa in position 444 to 446 is any amino acid
  Variant (448)..(452): xaa in position 448 to 452 is any amino acid
  Variant (454)..(455): xaa in position 454 to 455 is any amino acid
  Variant (457)..(463): xaa in position 457 to 463 is any amino acid
  Variant (465)..(468): xaa in position 465 to 468 is any amino acid
  Variant (469)..(470): xaa in position 469 to 470 is any or no amino acid
  Variant (473)..(473): xaa in position 473 is any amino acid
  Variant (478)..(483): xaa in position 478 to 483 is any amino acid
  Variant (484)..(485): xaa in position 484 to 485 is any or no amino acid
  Variant (489)..(493): xaa in position 489 to 493 is any amino acid
  Variant (495)..(497): xaa in position 495 to 497 is any amino acid
  Variant (499)..(501): xaa in position 499 to 501 is any amino acid
  Variant (503)..(504): xaa in position 503 to 504 is any amino acid
  Variant (507)..(508): xaa in position 507 to 508 is any amino acid
  Variant (511)..(512): xaa in position 511 to 512 is any amino acid
  Variant (514)..(525): xaa in position 514 to 525 is any amino acid
  Variant (526)..(533): xaa in position 526 to 533 is any or no amino acid
  Variant (535)..(544): xaa in position 535 to 544 is any amino acid
  Variant (547)..(548): xaa in position 547 to 548 is any amino acid
  Variant (553)..(553): xaa in position 553 is any amino acid
  Variant (555)..(555): xaa in position 555 is any amino acid
  Variant (558)..(558): xaa in position 558 is any amino acid
  Variant (560)..(565): xaa in position 560 to 565 is any amino acid
  Variant (567)..(578): xaa in position 567 to 578 is any amino acid
  Variant (579)..(582): xaa in position 579 to 582 is any or no amino acid
  Variant (589)..(597): xaa in position 589 to 597 is any amino acid
  Variant (598)..(598): xaa in position 598 is any or no amino acid
  Variant (601)..(601): xaa in position 601 is any amino acid
  Variant (603)..(606): xaa in position 603 to 606 is any amino acid
  Variant (611)..(613): xaa in position 611 to 613 is any amino acid
  Variant (615)..(616): xaa in position 615 to 616 is any amino acid
  Variant (620)..(627): xaa in position 620 to 627 is any amino acid
  Variant (630)..(630): xaa in position 630 is any amino acid
  Variant (634)..(634): xaa in position 634 is any amino acid
  Variant (638)..(638): xaa in position 638 is any or no amino acid
  Variant (641)..(648): xaa in position 641 to 648 is any amino acid
  Variant (650)..(661): xaa in position 650 to 661 is any amino acid
  Variant (662)..(662): xaa in position 662 is any or no amino acid
  Variant (664)..(664): xaa in position 664 is any amino acid
  Variant (667)..(672): xaa in position 667 to 672 is any amino acid
  Variant (675)..(679): xaa in position 675 to 679 is any amino acid
  Variant (682)..(683): xaa in position 682 to 683 is any amino acid
  Variant (685)..(685): xaa in position 685 is any amino acid
  Variant (687)..(691): xaa in position 687 to 691 is any amino acid
  Variant (692)..(696): xaa in position 692 to 696 is any or no amino acid
  Variant (698)..(699): xaa in position 698 to 699 is any amino acid
  Variant (702)..(711): xaa in position 702 to 711 is any amino acid
  Variant (714)..(715): xaa in position 714 to 715 is any amino acid
  Variant (718)..(718): xaa in position 718 is any amino acid
  Variant (721)..(723): xaa in position 721 to 723 is any amino acid
  Variant (725)..(725): xaa in position 725 is any amino acid
  Variant (727)..(727): xaa in position 727 is any amino acid
  Variant (730)..(733): xaa in position 730 to 733 is any amino acid
  Variant (735)..(735): xaa in position 735 is any amino acid
  Variant (737)..(739): xaa in position 737 to 739 is any amino acid
  Variant (742)..(742): xaa in position 742 is any amino acid
  Variant (745)..(746): xaa in position 745 to 746 is any amino acid
  Variant (748)..(749): xaa in position 748 to 749 is any amino acid
  Variant (751)..(760): xaa in position 751 to 760 is any amino acid
  Variant (761)..(764): xaa in position 761 to 764 is any or no amino acid
  Variant (768)..(769): xaa in position 768 to 769 is any amino acid
  Variant (771)..(772): xaa in position 771 to 772 is any amino acid
  Variant (775)..(799): xaa in position 775 to 799 is any amino acid
  Variant (800)..(806): xaa in position 800 to 806 is any or no amino acid
  Variant (808)..(809): xaa in position 808 to 809 is any amino acid
  Variant (811)..(813): xaa in position 811 to 813 is any amino acid
  Variant (815)..(839): xaa in position 815 to 839 is any amino acid
  Variant (840)..(852): xaa in position 840 to 852 is any or no amino acid
  Variant (857)..(857): xaa in position 857 is any amino acid
  Variant (859)..(861): xaa in position 859 to 861 is any amino acid
  Variant (863)..(867): xaa in position 863 to 867 is any amino acid
  Variant (870)..(873): xaa in position 870 to 873 is any amino acid
  Variant (875)..(875): xaa in position 875 is any amino acid
  Variant (877)..(877): xaa in position 877 is any amino acid
  Variant (885)..(885): xaa in position 885 is any amino acid
  Variant (890)..(890): xaa in position 890 is any amino acid
  Variant (904)..(907): xaa in position 904 to 907 is any amino acid
  Variant (909)..(909): xaa in position 909 is any amino acid
  Variant (911)..(911): xaa in position 911 is any amino acid
  Variant (913)..(913): xaa in position 913 is any amino acid
  Variant (923)..(924): xaa in position 923 to 924 is any amino acid
  Variant (927)..(931): xaa in position 927 to 931 is any amino acid
  Variant (933)..(934): xaa in position 933 to 934 is any amino acid
  Variant (936)..(936): xaa in position 936 is any amino acid
  Variant (938)..(940): xaa in position 938 to 940 is any amino acid
  Variant (941)..(947): xaa in position 941 to 947 is any or no amino acid
  Variant (949)..(951): xaa in position 949 to 951 is any amino acid
  Variant (954)..(954): xaa in position 954 is any amino acid
  Variant (959)..(959): xaa in position 959 is any amino acid
  Variant (963)..(963): xaa in position 963 is any amino acid
  Variant (968)..(972): xaa in position 968 to 972 is any amino acid
  Variant (975)..(977): xaa in position 975 to 977 is any amino acid
  Variant (979)..(981): xaa in position 979 to 981 is any amino acid
  Variant (984)..(984): xaa in position 984 is any amino acid
  Variant (987)..(989): xaa in position 987 to 989 is any amino acid
  Variant (992)..(994): xaa in position 992 to 994 is any amino acid
  Variant (997)..(997): xaa in position 997 is any amino acid
  Variant (999)..(1001): xaa in position 999 to 1001 is any amino acid
  Variant (1003)..(1004): xaa in position 1003 to 1004 is any amino acid
  Variant (1007)..(1008): xaa in position 1007 to 1008 is any amino acid
  Variant (1012)..(1032): xaa in position 1012 to 1032 is any amino acid
  Variant (1033)..(1035): xaa in position 1033 to 1035 is any or no amino acid
  Variant (1037)..(1037): xaa in position 1037 is any amino acid

SEQ ID NO: 50317 - protein, 101 aa, Artificial sequence; identical to SEQ ID NO: 34164
  Variant (2)..(2): xaa in position 2 is any amino acid
  Variant (3)..(3): xaa in position 3 is Ala or Ser
  Variant (4)..(4): xaa in position 4 is Asp, Glu, Gln or Arg
  Variant (5)..(5): xaa in position 5 is His or Tyr
  Variant (8)..(8): xaa in position 8 is Ile, Leu or Val
  Variant (9)..(9): xaa in position 9 is Ala, Asp or Glu
  Variant (11)..(11): xaa in position 11 is Asp, Glu or Asn
  Variant (13)..(13): xaa in position 13 is any amino acid
  Variant (18)..(18): xaa in position 18 is Gly or Ser
  Variant (19)..(19): xaa in position 19 is Ile or Val
  Variant (20)..(20): xaa in position 20 is Ala or Gly
  Variant (22)..(22): xaa in position 22 is Lys or Arg
  Variant (24)..(24): xaa in position 24 is any or no amino acid
  Variant (27)..(27): xaa in position 27 is any or no amino acid
  Variant (29)..(29): xaa in position 29 is any amino acid
  Variant (32)..(32): xaa in position 32 is Ile, Leu or Val
  Variant (45)..(45): xaa in position 45 is any amino acid
  Variant (48)..(48): xaa in position 48 is Pro or Gln
  Variant (49)..(49): xaa in position 49 is Ile or Val
  Variant (58)..(58): xaa in position 58 is Asn or Pro
  Variant (59)..(59): xaa in position 59 is Lys or Arg
  Variant (60)..(60): xaa in position 60 is Ser or Thr
  Variant (62)..(62): xaa in position 62 is Ala or Ser
  Variant (68)..(68): xaa in position 68 is Phe or Met
  Variant (70)..(70): xaa in position 70 is Ala, Gly or Ser
  Variant (71)..(71): xaa in position 71 is any amino acid
  Variant (73)..(73): xaa in position 73 is His or Tyr
  Variant (75)..(75): xaa in position 75 is any amino acid
  Variant (76)..(76): xaa in position 76 is Phe or Tyr
  Variant (79)..(79): xaa in position 79 is Ala or Ser
  Variant (83)..(84): xaa in position 83 to 84 is any amino acid
  Variant (86)..(86): xaa in position 86 is Phe or Met
  Variant (87)..(87): xaa in position 87 is any amino acid
  Variant (90)..(90): xaa in position 90 is any amino acid
  Variant (91)..(91): xaa in position 91 is Asp, Gly or Ser
  Variant (92)..(92): xaa in position 92 is Leu or Val
  Variant (94)..(94): xaa in position 94 is Leu or Met
  Variant (95)..(95): xaa in position 95 is Asp or Asn
  Variant (96)..(96): xaa in position 96 is Ala or Ser
  Variant (98)..(98): xaa in position 98 is Leu or Met
  Variant (99)..(99): xaa in position 99 is any amino acid

SEQ ID NO: 50318 - protein, 17 aa, Artificial sequence
  Variant (5)..(5): xaa in position 5 is Phe or Tyr
  Variant (12)..(12): xaa in position 12 is Ile, Met or Val
  Variant (14)..(14): xaa in position 14 is Asp or Asn
  Variant (16)..(16): xaa in position 16 is Ala, Asp, Gly, Asn or Ser
KGVVXNEMKGQXSXAXY

SEQ ID NO: 50319 - protein, 44 aa, Artificial sequence; identical to SEQ ID NO: 34166
  Variant (2)..(2): xaa in position 2 is any amino acid
  Variant (7)..(8): xaa in position 7 to 8 is any amino acid
  Variant (10)..(10): xaa in position 10 is Pro, Thr or Val
  Variant (11)..(11): xaa in position 11 is Asp or Glu
  Variant (13)..(13): xaa in position 13 is any amino acid
  Variant (14)..(14): xaa in position 14 is His or Tyr
  Variant (15)..(15): xaa in position 15 is any amino acid
  Variant (16)..(16): xaa in position 16 is Asp, Gly or Gln
  Variant (18)..(19): xaa in position 18 to 19 is any amino acid
  Variant (21)..(24): xaa in position 21 to 24 is any amino acid
  Variant (26)..(26): xaa in position 26 is any amino acid
  Variant (31)..(31): xaa in position 31 is Lys or Arg
  Variant (32)..(32): xaa in position 32 is any amino acid
  Variant (33)..(33): xaa in position 33 is Phe, Ile or Leu
  Variant (34)..(34): xaa in position 34 is Ser or Thr
  Variant (37)..(37): xaa in position 37 is any amino acid
  Variant (38)..(38): xaa in position 38 is Phe, Ile, Leu or Met
  Variant (39)..(39): xaa in position 39 is Pro or Ser
  Variant (40)..(40): xaa in position 40 is Leu or Val
  Variant (41)..(41): xaa in position 41 is any amino acid
  Variant (42)..(42): xaa in position 42 is Asp or Val
  Variant (43)..(43): xaa in position 43 is any amino acid

SEQ ID NO: 50320 - protein, 66 aa, Artificial sequence; identical to SEQ ID NO: 34167
  Variant (2)..(2): xaa in position 2 is any amino acid
  Variant (3)..(3): xaa in position 3 is Ser or Thr
  Variant (5)..(6): xaa in position 5 to 6 is any amino acid
  Variant (8)..(10): xaa in position 8 to 10 is any amino acid
  Variant (11)..(11): xaa in position 11 is Asp or Asn
  Variant (12)..(13): xaa in position 12 to 13 is any amino acid
  Variant (14)..(14): xaa in position 14 is Asp, Glu or Gln
  Variant (15)..(15): xaa in position 15 is Ser or Thr
  Variant (17)..(17): xaa in position 17 is any amino acid
  Variant (18)..(18): xaa in position 18 is Ala, Leu or Val
  Variant (19)..(19): xaa in position 19 is any amino acid
  Variant (20)..(20): xaa in position 20 is Ile, Leu or Val
  Variant (21)..(21): xaa in position 21 is Ile or Leu
  Variant (22)..(22): xaa in position 22 is Gly or Ser
  Variant (23)..(23): xaa in position 23 is Ala, Asn, Ser or Thr
  Variant (26)..(26): xaa in position 26 is Phe, Ile, Leu or Met
  Variant (29)..(29): xaa in position 29 is His or Tyr
  Variant (30)..(30): xaa in position 30 is Asp, Gly or Ser
  Variant (32)..(32): xaa in position 32 is Ala, Ile, Pro or Val
  Variant (33)..(33): xaa in position 33 is Phe, Leu or Met
  Variant (34)..(34): xaa in position 34 is His or Tyr
  Variant (35)..(36): xaa in position 35 to 36 is any amino acid
  Variant (38)..(39): xaa in position 38 to 39 is any amino acid
  Variant (40)..(41): xaa in position 40 to 41 is any or no amino acid
  Variant (43)..(49): xaa in position 43 to 49 is any amino acid
  Variant (50)..(50): xaa in position 50 is any or no amino acid
  Variant (52)..(52): xaa in position 52 is Ala, Ser or Thr
  Variant (54)..(54): xaa in position 54 is any amino acid
  Variant (55)..(55): xaa in position 55 is Asp or Glu
  Variant (56)..(56): xaa in position 56 is Asn, Pro, Ser or Thr
  Variant (57)..(57): xaa in position 57 is any amino acid
  Variant (58)..(58): xaa in position 58 is Ala, Gly, Pro or Thr
  Variant (59)..(60): xaa in position 59 to 60 is any amino acid
  Variant (61)..(61): xaa in position 61 is Gly, Asn or Pro
  Variant (62)..(63): xaa in position 62 to 63 is Phe, Ile or Leu
  Variant (64)..(64): xaa in position 64 is Ser or Thr
  Variant (65)..(65): xaa in position 65 is Ile or Val

SEQ ID NO: 50321 - protein, 89 aa, Artificial sequence; identical to SEQ ID NO: 34168
  Variant (2)..(2): xaa in position 2 is Phe or Tyr
  Variant (3)..(3): xaa in position 3 is any amino acid
  Variant (5)..(5): xaa in position 5 is any amino acid
  Variant (7)..(7): xaa in position 7 is Ala, Gly, Ser or Thr
  Variant (8)..(8): xaa in position 8 is Ala, Gly or Ser
  Variant (9)..(9): xaa in position 9 is any amino acid
  Variant (10)..(10): xaa in position 10 is Ala, Cys or Ser
  Variant (11)..(12): xaa in position 11 to 12 is any amino acid
  Variant (13)..(13): xaa in position 13 is Gly or Thr
  Variant (14)..(14): xaa in position 14 is Ala, Ser, Thr or Val
  Variant (15)..(15): xaa in position 15 is Pro or Ser
  Variant (16)..(16): xaa in position 16 is Phe or Tyr
  Variant (17)..(20): xaa in position 17 to 20 is any amino acid
  Variant (21)..(21): xaa in position 21 is Gly, Asn or Ser
  Variant (22)..(22): xaa in position 22 is Ala or Ser
  Variant (23)..(23): xaa in position 23 is any amino acid
  Variant (25)..(25): xaa in position 25 is any amino acid
  Variant (26)..(26): xaa in position 26 is Ile or Val
  Variant (27)..(27): xaa in position 27 is Leu or Met
  Variant (28)..(28): xaa in position 28 is Ala or Ser
  Variant (29)..(29): xaa in position 29 is Asn, Gln or Ser
  Variant (30)..(30): xaa in position 30 is Leu or Met
  Variant (33)..(34): xaa in position 33 to 34 is any or no amino acid
  Variant (36)..(37): xaa in position 36 to 37 is any or no amino acid
  Variant (40)..(40): xaa in position 40 is any amino acid
  Variant (42)..(42): xaa in position 42 is Ile or Val
  Variant (51)..(51): xaa in position 51 is Ala or Gly
  Variant (53)..(53): xaa in position 53 is Ala or Ser
  Variant (54)..(56): xaa in position 54 to 56 is any amino acid
  Variant (57)..(57): xaa in position 57 is Ala, Pro or Ser
  Variant (58)..(59): xaa in position 58 to 59 is any amino acid
  Variant (61)..(61): xaa in position 61 is any amino acid
  Variant (63)..(63): xaa in position 63 is Ala, Gly, Asn or Ser
  Variant (64)..(64): xaa in position 64 is Phe or Tyr
  Variant (65)..(65): xaa in position 65 is any amino acid
  Variant (71)..(71): xaa in position 71 is any amino acid
  Variant (72)..(72): xaa in position 72 is Ala, Leu or Pro
  Variant (73)..(74): xaa in position 73 to 74 is any amino acid
  Variant (75)..(75): xaa in position 75 is Ser or Thr
  Variant (76)..(76): xaa in position 76 is Ile or Leu
  Variant (77)..(81): xaa in position 77 to 81 is any amino acid
  Variant (82)..(82): xaa in position 82 is Ala, Ser or Val
  Variant (83)..(83): xaa in position 83 is Ala, Gly or Pro
  Variant (84)..(84): xaa in position 84 is any amino acid
  Variant (85)..(85): xaa in position 85 is Phe, Trp or Tyr
  Variant (86)..(88): xaa in position 86 to 88 is any amino acid
  Variant (89)..(89): xaa in position 89 is Asp, Glu, Lys or Arg

SEQ ID NO: 50322 - DNA, 942 bp, Saccharomyces cerevisiae
  CDS (1)..(942)
atgaataaacttgttgatgcccactgtcatgttataaccgacccagacaacacattctgcggtgatgatggagggtcccagggtacgttgcgttgcgttatgtcatcaaacccatatgactggaacaatttgaaaaaattggctggcagaagcacaagtaaaaacgatatatgcgtgggatttggtgtgcatccttggtacagccacttattttatgtgggaagtcggcgcgacaaggtttctcactatcaagatgtactggagtataagaatgaagaacagttcgacagtttggttcaggtgcttcccgaacctctagatcttgaagagtatataaaaagagagtttaacgacactttggttagtgtgattggagaaatcggtcttgataagctcttcagacttcctgcaaatggtttctacatgcagaacgagaaggcaaggcttacgacagtgaaggtcaaactatcgcatcaagaaacagtattcaggcgattttggcgactggcaaggcacacaagcaagcccatctctatacacgatgtaaagtgccacgggaaactaaacgatatctgcaatgaagagctcttgacgtatcactctgtcaagatatgtttacattcgtacacaggctccaaggaaacgcttctgggccaatggctcaagaagtttcccccggatcgtatttttgtgagcctatccaaatggattaattttaaggacccagaagagggagatgccctggtcaggagcttgccctcaacttgcatacttactgaaaccgactatcctattgacaatccagatccgtcataccaaaaggcccttacagagcagctgcagtatttgaatgcacaaatcgcacgagcatgggacgagacactggatgcctcacaagccgctttgcgtgtatacgaaaactttcagaaatttatcaagtga

SEQ ID NO: 50323 - protein, 313 aa, Saccharomyces cerevisiae
MNKLVDAHCHVITDPDNTFCGDDGGSQGTLRCVMSSNPYDWNNLKKLAGRSTSKNDICVGFGVHPWYSHLFYVGSRRDKVSHYQDVLEYKNEEQFDSLVQVLPEPLDLEEYIKREFNDTLVSVIGEIGLDKLFRLPANGFYMQNEKARLTTVKVKLSHQETVFRRFWRLARHTSKPISIHDVKCHGKLNDICNEELLTYHSVKICLHSYTGSKETLLGQWLKKFPPDRIFVSLSKWINFKDPEEGDALVRSLPSTCILTETDYPIDNPDPSYQKALTEQLQYLNAQIARAWDETLDASQAALRVYENFQKFIK

SEQ ID NO: 50324 - DNA, 819 bp, Arabidopsis thaliana
  CDS (1)..(819)
atgaagttgtttgatgctcattgtcacctccaagacaagagggtcatcgacaaagcctcgcagctcatatctgctgctttagctgtcggtgttaccaatttcgcagtcaatggaacctccgagaaagattggaacttggtgaaagagatgggagagacgtatccttctgttgttccttgctttggactccatccttggtttattgctgatagaagccctcattggtttaaaacattgaagaagttctttgagaccactcctactgctgctgttggagaaattggtttagacaaaggtcccttagcaggaggaattgattactcagaccagctagtcgtgtttcgcccacagcttgaacttgcaaaagaactgaacaaaccagtagcagttcattgcatcgatgcatttgatgatctcctagagataatgagatccatagggccttttcctgctggggtgattcttcattcattcaatggttcagctgaagttgttcctaaactcgctgagcttggtgcatacttctctttttctggctggttcacttacattgatgagaaaattgccaagaagactttgaaatcgattccttccgataggctcttattggagacggattcacctgacgggttaccaaaatcagatgagagttcttcggatccaaaaccaactctcaatgagcctgcaaacattcttgctgtactagattatgttgcgaacctgtcaaacatgaagaaggaagagcttgcggagttaagttatgtgaattctgtgaggttgttttcttatccaggttccaaattgcttacagaccagtaa

SEQ ID NO: 50325 - protein, 272 aa, Arabidopsis thaliana
MKLFDAHCHLQDKRVIDKASQLISAALAVGVTNFAVNGTSEKDWNLVKEMGETYPSVVPCFGLHPWFIADRSPHWFKTLKKFFETTPTAAVGEIGLDKGPLAGGIDYSDQLVVFRPQLELAKELNKPVAVHCIDAFDDLLEIMRSIGPFPAGVILHSFNGSAEVVPKLAELGAYFSFSGWFTYIDEKIAKKTLKSIPSDRLLLETDSPDGLPKSDESSSDPKPTLNEPANILAVLDYVANLSNMKKEELAELSYVNSVRLFSYPGSKLLTDQ

SEQ ID NO: 50326 - DNA, 978 bp, Arabidopsis thaliana
  CDS (1)..(978)
atgaaactgttcgacgcgcactgtcaccttcaagacccgaggattatcaccaaagctcctcagataatctcctccgccgttgcttccggcgtctctgctttcgccgtcaatggagtctccgagaaagattggagtttggtcaaagagatgggagctaaatacccttctgttgttccttgctttgggatccatccatggtatgtagcagagaggagtcctcaatggtttgagacattaaagagtttctttgagaccactcctactgctgctgttggagaaattggtttggacaaagggtctaagggaagggagattgatttctcagaacaggttaccgtctttcgtcaacagcttgaacttgcaaaggaattgaagaaacctgcgtcagttcattgtgttcgtgcatttggggatctactcgagatattaaaatctgtagggccttttccttctggggtcatgcttcactcgtatttgggttctgctgagatggttcctgaatttgctaagctcggtgcatatttctccttctccggtttccttatgtccatgagtgagaaaaaagccaagaagatgttgaaagcagttccatctgataggatcttattggagacggattcaccagatgcactaccaaaggcagagtcaggttgtctctactttgtagacggagatccttctctacccgaagaaggaaattcagctcaggatcttgattctgcttcatatgataagcctaatgtgtctagtgactcgatgaagttaacaaaggaaacacttaatcacccggctaatattcatatcgtactcggatatgtagcgcagttgttggatatgaagaatgaagaactcgcggaactaagttatcaaaatgctgttcggttattctcttacgaaggttcaaagatacttcttgacagaggtactggtgatgtctctggtcacactcaaaaccagtcaacaacacatgtatcatga

SEQ ID NO: 50327 - protein, 325 aa, Arabidopsis thaliana
MKLFDAHCHLQDPRIITKAPQIISSAVASGVSAFAVNGVSEKDWSLVKEMGAKYPSVVPCFGIHPWYVAERSPQWFETLKSFFETTPTAAVGEIGLDKGSKGREIDFSEQVTVFRQQLELAKELKKPASVHCVRAFGDLLEILKSVGPFPSGVMLHSYLGSAEMVPEFAKLGAYFSFSGFLMSMSEKKAKKMLKAVPSDRILLETDSPDALPKAESGCLYFVDGDPSLPEEGNSAQDLDSASYDKPNVSSDSMKLTKETLNHPANIHIVLGYVAQLLDMKNEELAELSYQNAVRLFSYEGSKILLDRGTGDVSGHTQNQSTTHVS

SEQ ID NO: 50328 - DNA, 771 bp, Thermoanaerobacter tengcongensis MB4
  CDS (1)..(771): transl_table=11
ttgcttatagactctcacgctcatcttgaggatgagaaatacaatgaagacagggaaaaagtgattgaggagtgcaaaaaggacctcacatttttaataaatgtggggtccaatatattgacttctaaaaagaccattgaacttgcccacaaatacgattttatatacgcaactgtgggcattcaccctcatgatgcagaaagagaaaaagacaaaatagaggaaatagagaagttggctcttgaggataaagtggtggctataggagaaattggcttggattattattacggtgaccctcctaaagaatttcaaattgaggcttttgtgaagcagataaggctcgcaaaaaagcttaaacttcccattgtaattcacgacagagtcgcccatgaggatatcttaaaaatactgaaaaaagaatggacacaggatttaaaaggggtatttcacagttattctggtagtgtcgagatgataaaagaagtgataagtatgaatttttacatctctctttcaggaactgtcactttcaaaaacgctaaaaaagttagggaggttgcaaaagaagttcctcttgaatggcttttgattgagacagatagtccctatttgactcctgagccctacagaggtaagagaaacaagcccacatatgttaaatttgtagcacaaaaaattgctgaaataaaaggtataagttttgaagaagtttgtgaaacaacctcgcaaaatgccataaagcttttcaatttgccctcctgtttttga

SEQ ID NO: 50329 - protein, 256 aa, Thermoanaerobacter tengcongensis MB4
MLIDSHAHLEDEKYNEDREKVIEECKKDLTFLINVGSNILTSKKTIELAHKYDFIYATVGIHPHDAEREKDKIEEIEKLALEDKVVAIGEIGLDYYYGDPPKEFQIEAFVKQIRLAKKLKLPIVIHDRVAHEDILKILKKEWTQDLKGVFHSYSGSVEMIKEVISMNFYISLSGTVTFKNAKKVREVAKEVPLEWLLIETDSPYLTPEPYRGKRNKPTYVKFVAQKIAEIKGISFEEVCETTSQNAIKLFNLPSCF

SEQ ID NO: 50330 - DNA, 897 bp, Eremothecium gossypii
  CDS (1)..(897)
atggtgccattggtagatagccactgccacgtgcggacgcggcggagcgccgcagacgtgctggttcttgcgccagcagcgggcaccgcccgctgtctgatgtcctgcaacgtgtacgactgggaggcgcttgcggcggccggcgccgtgtgcaaggggttcggcgtccatccgtggtatgcgcatctgttttgcctgggacctacgtgcgagaaggcggcccactaccgggcggtgctgcaggcgcgcgacgcgggggagctggaggcactgatcgcgcagctgccgccccccgtgccgctggaggcgcacatcgccgccggcatggccgcgcagccgcagtgcgtgggcgaggttgggctggataaggtgttccggctgcctgcgggcggcgtttacgagggcggcggcgcgctcaccaacgtgcgcatcagcgcagaccaccagctcgccgtattccgccgtatgtgcgagctcgctgccgcgcatcgcctgccgctttcggtgcactcggtgcggtggcacggtaaggtgctggatgtgtacgatgaggtgctgggcgcagactctcgcgtgaacgtgtgtctgcactcgtactcggaagatacgcactctgcccaccgttggtgtgacgagttcgtaagccgtgcgttctatggtgtgtcgaacgccctcaacatgcgcaactacgacacctcgctgcagttactgcgcgctctaccgctcgacagcttgctgaccgagaccgaccacacggtcgacgataccgacccggcggccctacaggccgacctgttcgcggtactacatgcgatccaggacgcccacggacttccgtcgctcgacgccgcgcgcgtggccgtgtatagcaacttctgcagatttctctctaagtag

SEQ ID NO: 50331 - protein, 298 aa, Eremothecium gossypii
MVPLVDSHCHVRTRRSAADVLVLAPAAGTARCLMSCNVYDWEALAAAGAVCKGFGVHPWYAHLFCLGPTCEKAAHYRAVLQARDAGELEALIAQLPPPVPLEAHIAAGMAAQPQCVGEVGLDKVFRLPAGGVYEGGGALTNVRISADHQLAVFRRMCELAAAHRLPLSVHSVRWHGKVLDVYDEVLGADSRVNVCLHSYSEDTHSAHRWCDEFVSRAFYGVSNALNMRNYDTSLQLLRALPLDSLLTETDHTVDDTDPAALQADLFAVLHAIQDAHGLPSLDAARVAVYSNFCRFLSK

SEQ ID NO: 50332 - DNA, 1329 bp, Neurospora crassa
  CDS (1)..(1329)
atgtgtccctccaccggcgaatcaatacctcatgaagttcccaaaagagacgatgatgaagctcccaaagagcccttcccatggcacgttggtgtctacgacgcccactgtcatcccaccgacaccatggcttccatctccagcataaacaacatgcaagctcgacttctcaccatcatggccacacgcggtcaagaccaagacctcgtcgcctccgtagccgagcagcacggcatcacagacttgaacgagctgcgcgaaagcagttcatccgaaacccccaagaaggtcgtcccagcgttcggctggcacccttggttctctcaccagctctacgatgactccaaagacgaagaagaagaagaagaaggagaagaggtcacggatgtacaggcacacaatagaaaaactaagcactactctaccgttctatcgccccctcccgatgccgatttcatcgcttctctccccgatcccattcctctcagcaagtttctccaagaaacccgccaacgcctgctcgcccaccccacagccctggtcggcgaaatcggccttgacaaagcgtttcgtctcccgtggggcaaagtgaatgagtcgtcctcgtcctcgcgcaacgacggcgacctaacaccgggcggtcgagaaggacggatgctcagtccttaccacgtcaagatggcgcaccaggtcgacgttctcaaagcccaacttcgcctggcaggcgagctgggtcgtcccgtctctctacacggcgtgcaggctcacggcgtgttattcgatgccttggcgtcgctgtggaagggacatgagaaggaggtggtgtcgcggaagaagcaaaagatgattgccaagggcgtgtcggaggatttttcctcctcgtctagtgatgaggaggaggaatccgattactcggaatttgggcttgtgggggagcccaagcaactacacaaaatcatgaagcccaagaagaagccgtacaaaccgaaaccgaaaccgttcccgccgagggcgtgtctacattccttcagcgggccgccgcaggtgttgaagcagtatttggatcccaagatcccggtcaagtgctacttttcgttttccatggtgattaatctggggacggcgggcggagaggccaagtttgcggatgtgattcgggcgtgtccggatgggcaggtgctggtggagagcgatttgcatgtggcgggcgaggatatggatgggtatttggaggatattgcgaggaggatatgtgagataaaggggtgggggttggaggaggggatgcagaggataaggaggaattatgaagagtttttgtttggttga

SEQ ID NO: 50333 - protein, 442 aa, Neurospora crassa
MCPSTGESIPHEVPKRDDDEAPKEPFPWHVGVYDAHCHPTDTMASISSINNMQARLLTIMATRGQDQDLVASVAEQHGITDLNELRESSSSETPKKVVPAFGWHPWFSHQLYDDSKDEEEEEEGEEVTDVQAHNRKTKHYSTVLSPPPDADFIASLPDPIPLSKFLQETRQRLLAHPTALVGEIGLDKAFRLPWGKVNESSSSSRNDGDLTPGGREGRMLSPYHVKMAHQVDVLKAQLRLAGELGRPVSLHGVQAHGVLFDALASLWKGHEKEVVSRKKQKMIAKGVSEDFSSSSSDEEEESDYSEFGLVGEPKQLHKIMKPKKKPYKPKPKPFPPRACLHSFSGPPQVLKQYLDPKIPVKCYFSFSMVINLGTAGGEAKFADVIRACPDGQVLVESDLHVAGEDMDGYLEDIARRICEIKGWGLEEGMQRIRRNYEEFLFG

SEQ ID NO: 50334 - DNA, 1254 bp, Magnaporthe grisea 70-15
  CDS (1)..(1254)
atgtgtccaggccacgggcatgctccgggtaatgccccggtctcggccggcagtccgagtaacaccggacccggcgactccgaaccttttccctgggagatcggagcttatgattcacactgccaccccactaccactcccgcctccatcgcccacattcccacaatgcggacccgggccatgaccgtcatggcctctcgcgcccaggaccaggctctctcggccaccgctgcagacgaccacggtgtccccagtcgctctgaactgcagtcgcggtcgttggatcccagcgctccggtcggcagggttgtccctgcttttggctaccatccttggttctcgcacctgatctatgacgactcggcgtgcgcagagctcgacaaggccgcccacttcgcctcggtcctgaagccatctccggcctcggacccggacttcctcgccagcctgcttgacccggaacctctctcgtccgtcgtcgctgcgacaaaagagaggttgctccgctacccgaccggaatggtcggcgaggtaggtctcgacaaggcgtttcggctcccgcagcctcgcgaaccggggccggacggcgagatcgacccacccgctgaggacgagcgcgacatggttcccggcgggcggtacggccgcatgctgagcaagtaccgagtcaacctgccgcaccaggagcgcgtcttcttggctcaggtcgccctggctggggagctcgggcggcccgtgagcgtgcacggggtgcagtgctcaggtctgctgctggatgcgctctccaagacgtggaagggccacgagagggaggtcgtcagccggcggaagcagaggctggtggctcagaacgcccaggcctgggaggagtatgactcggacgaggaggatgagccgcagcagacagaggtcggcgcgaagccgtttcctccgcggatatgcctgcactccttctctggttcggccgaagtgttaaagcagtacacggacccgcggataccctccaaaatattcttttccttctcagttgcgataaacatgggtaccgcctctgtcgaggagaaattgcccgagataatacgagcctgtccagatgataggatacttgtagagaccgatctgcatcttgccggcgacgagatggattcaatgctggagaagatttaccgccatgtgtgccacgtaaaaggctggggactcaaggagggcatggagaggatagccaggaactatgaagatttcgtgtttggctag

SEQ ID NO: 50335 - protein, 417 aa, Magnaporthe grisea 70-15
MCPGHGHAPGNAPVSAGSPSNTGPGDSEPFPWEIGAYDSHCHPTTTPASIAHIPTMRTRAMTVMASRAQDQALSATAADDHGVPSRSELQSRSLDPSAPVGRVVPAFGYHPWFSHLIYDDSACAELDKAAHFASVLKPSPASDPDFLASLLDPEPLSSVVAATKERLLRYPTGMVGEVGLDKAFRLPQPREPGPDGEIDPPAEDERDMVPGGRYGRMLSKYRVNLPHQERVFLAQVALAGELGRPVSVHGVQCSGLLLDALSKTWKGHEREVVSRRKQRLVAQNAQAWEEYDSDEEDEPQQTEVGAKPFPPRICLHSFSGSAEVLKQYTDPRIPSKIFFSFSVAINMGTASVEEKLPEIIRACPDDRILVETDLHLAGDEMDSMLEKIYRHVCHVKGWGLKEGMERIARNYEDFVFG

SEQ ID NO: 50336 - DNA, 1176 bp, Gibberella zeae PH-1
  CDS (1)..(1176)
atgtgtatgcatgatcatcaagacaacgcgggtaccgagccaccgctcgaccctgtggaaccattcccgtggcatctcggagttttcgatgcccataaccacatcggcgaacgtgtttattcagtttccgacttacctaccatgaaatctcgtgcggtagcaataatggcaacaagaacacaagatcagccgctcattgaagccatcgtccaacaacacggggtgaaaggcccggaatgtttctcccaagataaaacgactgtcatcgcaggttacgggaggcacccgtggttttcgcatgagctttatgacgactcattggaaaaccctacctatgtgccatctgatgatgttgaggccgcaaaagggcgacattataaggcagtactttcaccagccccagaagacccggcgtggtggcacgatcaaccagctccaatcgccctttcagagttcatcgctgaaaccagggcccggcttatacgggatccatttgcaatggtcggcgaaattggtctagacaagccttttaggttaccaatgcagtggcccgacccaagaccgcccagagatcccgcacgcacgggaggaggacgcgagagaagaccacttagtcagcaccgtatacaaattccgcaccaaaaggctgtattcatggctcatttgaaacttgccggtgaacttggaagagctgtcagtgtccacggtgttcaagtacatggacttttgtacaacgctttgacagagtgctggaaggggcacgaactcaaaggccgccgcgcgagggacaaagaaaggaaggagaacactcaaacggccgatgttgaagaggcaacttcgaagccatatcctccgcgtatttgtctccactccttcagtggcaaagaagacgccgtgaagcagtatcttcaaccttcgatccctgcaaagatattcttctcgttttccaaggccaacaatctgggtacggatatgggaacggaaaagagcaaggatgccgtgaaggcggtgcctgataatcgaatcttggtcgagagtgatcttcacacggccggtcaaaggatggataatgagcttgaggagatgtatagagcaatttgcgagttcaaaggatggacactggaacatggtgtagcgcagatagcaaagaactacaccgagtttgtatttggctag

SEQ ID NO: 50337 - protein, 391 aa, Gibberella zeae PH-1
MCMHDHQDNAGTEPPLDPVEPFPWHLGVFDAHNHIGERVYSVSDLPTMKSRAVAIMATRTQDQPLIEAIVQQHGVKGPECFSQDKTTVIAGYGRHPWFSHELYDDSLENPTYVPSDDVEAAKGRHYKAVLSPAPEDPAWWHDQPAPIALSEFIAETRARLIRDPFAMVGEIGLDKPFRLPMQWPDPRPPRDPARTGGGRERRPLSQHRIQIPHQKAVFMAHLKLAGELGRAVSVHGVQVHGLLYNALTECWKGHELKGRRARDKERKENTQTADVEEATSKPYPPRICLHSFSGKEDAVKQYLQPSIPAKIFFSFSKANNLGTDMGTEKSKDAVKAVPDNRILVESDLHTAGQRMDNELEEMYRAICEFKGWTLEHGVAQIAKNYTEFVFG

SEQ ID NO: 50338 - DNA, 1425 bp, Gibberella zeae PH-1
  CDS (1)..(1425)
atgctctctacaacctctaacgtacgcaagcgtgcttgtcattacacaagagagatcatcgaaataccaatgccattatcagagcaaatcatctacctcactgaaaactgctccgtcgataacaaacaccaaccacagacgtcacatgagcaactcatctcacttttgactcatcccctgattcgatcaatcgtcaacatgtgtcaatacacccacaattacgatgagcaaccagtgcctgtagtagatgtaggcgacgaatccccgttcccctggcatctgccaatatgcgacgctcactgccatccaacggataccatggattccatacaggatatcccctcaatgcgcgcggctgcattggctattatggcaacccgggcacaggaccaggatcttgtcgcagaagtggccaacaagcactccaacgataaccccaagctgctcttccaaggcaactccggccaaagcaatacttgggtagttccatcttttggctggcacccctggttttcacatctcctctatgacgactcggccgatgctccgacatatcggcccacctccggctccgagaccgacaacgctgccaagcaggcccactacaacgccgttctccagccggaaccttcatcggactttgtcgcctctctgccaaccccaatcgctgtaagcacgtttctagaggaaactgaatcccgtctatctgccaatccctatgccttggtcggcgaaattggcgttgacaaggccttccgtcttcctgaaccatggaacccctctgagcaagctgaacgagattcgactttgactcctggaggtcgcgaaggtcggcatctcagtcctcatcgggtaagaatagagcatcagcgtgccattctcgctgcacagctccgtcttgctggcaagactcgccgagctgttagcgtacacggtgtgcaagctcatggagtgctccatgacactcttgtcgacacatggaagggtcatgagcgcgaagtgataacacgtcgaaaacggcgtcttgttgccaagggggctgaggacttttcggatgaggaagatgacgatgacagcgagaagccatatcctccacggatatgtctgcactcattcagtgctagtgttgaagtgttgaagcagtacctcagcccaacaatcccagctcgcatttttgtctcactgtcggtggctgtcaaccttagcacggatgccagttgcaccaagactgacgaggtgctccgcgctctgcccgatgacagcgtgcttatagaaagcgatcttcacatagtaggtgagcacatggaaaaggcactagaagacatgtaccgacatgtttgcgaagttaaaggttgggagctcgaggaaggtgtcaagaagatagccatgaattacgaggagttcatctttggacgacgagagtag

SEQ ID NO: 50339 - protein, 474 aa, Gibberella zeae PH-1
MLSTTSNVRKRACHYTREIIEIPMPLSEQIIYLTENCSVDNKHQPQTSHEQLISLLTHPLIRSIVNMCQYTHNYDEQPVPVVDVGDESPFPWHLPICDAHCHPTDTMDSIQDIPSMRAAALAIMATRAQDQDLVAEVANKHSNDNPKLLFQGNSGQSNTWVVPSFGWHPWFSHLLYDDSADAPTYRPTSGSETDNAAKQAHYNAVLQPEPSSDFVASLPTPIAVSTFLEETESRLSANPYALVGEIGVDKAFRLPEPWNPSEQAERDSTLTPGGREGRHLSPHRVRIEHQRAILAAQLRLAGKTRRAVSVHGVQAHGVLHDTLVDTWKGHEREVITRRKRRLVAKGAEDFSDEEDDDDSEKPYPPRICLHSFSASVEVLKQYLSPTIPARIFVSLSVAVNLSTDASCTKTDEVLRALPDDSVLIESDLHIVGEHMEKALEDMYRHVCEVKGWELEEGVKKIAMNYEEFIFGRRE

SEQ ID NO: 50340 - DNA, 1095 bp, Ustilago maydis 521
  CDS (1)..(1095)
atgtgtacaggagagtcgcacaccgagacatgcaaggcggtgacgcccaaacaaccatcgccgaatcttgcgggcttgtttgtggactcacattgccaccctacggacgatccggtagcgtacactgcgttgaatttagacgatcttagcgatcgcattagcaattcaaccgttggacgactagtatgcatgtcaacaaatgcgagagaccagaacatggtcgcagagctagcctcacggcatccggacaaagtgacgccctgctttgggtggcatccctggtttgcccatcagatctcgctctccgacccggcgccaagcaaagagaaacactaccacgaactttttggcattcttgacacttggtcagtcgagcatcatccggccaaagaagagctcgactcgatatgggatcagttgtcggagccaatatcgcttagcagcgtctgccaaggaattcgcggacaatttgaccggtttcccaacgcactgttgggcgaagtcggaatagaccgagcgttcagaatacctcggcgagcatggaactatgatccacaaagagcagagctcaaaacagccgtcccgaagttgaccaggctcaagacaccacaggcgcatcagttgtcggtcttgcgagcacagatcgacgttgccctggcctaccgacgcaacatctcgcttcactctgttcaagcagcaggtctcacagtagaccttctggcatctctgcgaaatgaaaacatatccgccttcggcgccgtgcgggtttcactccattcttgtacgctcgacaacaatgtggtgcgatccgtcacgaagaagcatgccaacgtctacgttggcttttcttcgaccatcaaccgcaagcagatcgaagcacgcgaatgcttggcgagcgtcgatcgtagtcgtgccttgatggaaagcgactatcacacggtgagtgcgattccaggctacctgctcgaggccgtcgattactttgctcaactgcatgatctgagcacggaagcggctgcacagcagctgcgcgctaattgggacaccttctattcaggcagcccactggcggaagagtcggacgactcagactaa

SEQ ID NO: 50341 - protein, 364 aa, Ustilago maydis 521
MCTGESHTETCKAVTPKQPSPNLAGLFVDSHCHPTDDPVAYTALNLDDLSDRISNSTVGRLVCMSTNARDQNMVAELASRHPDKVTPCFGWHPWFAHQISLSDPAPSKEKHYHELFGILDTWSVEHHPAKEELDSIWDQLSEPISLSSVCQGIRGQFDRFPNALLGEVGIDRAFRIPRRAWNYDPQRAELKTAVPKLTRLKTPQAHQLSVLRAQIDVALAYRRNISLHSVQAAGLTVDLLASLRNENISAFGAVRVSLHSCTLDNNVVRSVTKKHANVYVGFSSTINRKQIEARECLASVDRSRALMESDYHTVSAIPGYLLEAVDYFAQLHDLSTEAAAQQLRANWDTFYSGSPLAEESDDSD

SEQ ID NO: 50342 - DNA, 897 bp, Candida glabrata CBS138
  CDS (1)..(897)
atgctagtggatgcgcactgtcatctcgacggcagcgcagacagccgcggatgtgcggagtatgcgaggaacgtgcgggtgtgcctgatgagtacgaacccgcaggacgctgagatgttgtcggtagggattggtcttggcaatgcggtgtgcgcgtttggcgtgcacccgtggttctcgcactggttctacgtaggcgatgcgcctgggaagctggagcattacagtcgggtgatgcaggcggatgctgcggatgagggctttctgtcgctggtggatgagttaccggaccccattgacctggaccagtacatacgggaccactttcccaagggccggtggcaagtcatcggtgaagtgggactcgataagctgttccgtgtgaagcgtagggacggcacactgtcgcgctggcatgtgtccatggaccaccagcgggtggtgttggacaggttccttgatctggcagtgcggaccggactaagtgtgtcgctgcatggcgtcaaggctcatggctctctgctggacaggtgcgagaagaagctgctgaacacaccttgtaacatctgcttgcactcgtatacgggtcctgcagatactttgacggccctgtggatacgcaagtttggtcacgagcgcatatttgtgtccttatcacagtacattaatctagacgacaagcatagagcggtcactgagaacatactagacatatgtcccaagacttgcatattaccagagacagacttcgagatcaataagcatgacgcacaacggttggagatgtcgctgcgcacagtttacaacttcataggccagaggtggggcatagataactacgaagaattgatgcaaaccaactttgagtcattttatgggcactcaattgctcagtaa

SEQ ID NO: 50343 - protein, 298 aa, Candida glabrata CBS138
MLVDAHCHLDGSADSRGCAEYARNVRVCLMSTNPQDAEMLSVGIGLGNAVCAFGVHPWFSHWFYVGDAPGKLEHYSRVMQADAADEGFLSLVDELPDPIDLDQYIRDHFPKGRWQVIGEVGLDKLFRVKRRDGTLSRWHVSMDHQRVVLDRFLDLAVRTGLSVSLHGVKAHGSLLDRCEKKLLNTPCNICLHSYTGPADTLTALWIRKFGHERIFVSLSQYINLDDKHRAVTENILDICPKTCILPETDFEINKHDAQRLEMSLRTVYNFIGQRWGIDNYEELMQTNFESFYGHSIAQ

SEQ ID NO: 50344 - DNA, 975 bp, Kluyveromyces lactis NRRL Y-1140
  CDS (1)..(975)
atggttccatgtcttgtcgatgcacattgccatgtgtctactatggtggatgctgtaggatgcgataagatcagaagcaatttggacctggcccttgccggaacggcaagtgatgtccaacggtgtgtcatgagcacgaatgtgtacgactgggaattactggagcccctgctgctaatgaaacaactggatgatgaaggtcccggaatcaatgttagtcttggtgtgcatccctggtattgccatttatatcagttagataggtcgctttctaaggtagggcattataggaattgtcttaaatgtaaagacgaggtacagttgatggaattggtagagcaattgccggatccagtagatttgtcaagttacttgtcagatgagcgggtttctcgtgtgggttgtattggcgagatcggattggacaaggtttttcggttgcctcagaatggctttctcgtgagcaataatgggacatcgttggaaagaagtagtttaagcaatgtaagggtagagtttgcacatcagatccaggtatttgaaacgttattaaaagttgcaaagggaagggggttgccggtttcgatccattctgtgaaatgtcaaggtactacttttgatatttgcaagagaatattattggatagcgaggtgaacatatgtttgcactcgtttactgggacattggatacggtgcggctatggctggcgaatttcccacatgaacggcttttctttagcgtttcgtgttggatcaacttgaaagactgggattctggtgctgagctgttgaagagtttgcccttgcagtgtattttgacagagacagattgttctgtggattcagtgtcgtcgcaagagcaacgacagatgctagattccgttcttgacgccatttcaagagctcacggcatttccaggactaaggcgatggacacggtattacaaaacttcaatagattcttacgtaaatga

SEQ ID NO: 50345 - protein, 324 aa, Kluyveromyces lactis NRRL Y-1140
MVPCLVDAHCHVSTMVDAVGCDKIRSNLDLALAGTASDVQRCVMSTNVYDWELLEPLLLMKQLDDEGPGINVSLGVHPWYCHLYQLDRSLSKVGHYRNCLKCKDEVQLMELVEQLPDPVDLSSYLSDERVSRVGCIGEIGLDKVFRLPQNGFLVSNNGTSLERSSLSNVRVEFAHQIQVFETLLKVAKGRGLPVSIHSVKCQGTTFDICKRILLDSEVNICLHSFTGTLDTVRLWLANFPHERLFFSVSCWINLKDWDSGAELLKSLPLQCILTETDCSVDSVSSQEQRQMLDSVLDAISRAHGISRTKAMDTVLQNFNRFLRK

SEQ ID NO: 50346 - DNA, 1041 bp, Debaryomyces hansenii CBS767
  CDS (1)..(1041)
atgaatggatatgtacagtttttagcagacagtcactgtcatttagatgtggaatgttcatctcaaagagcagaagaattagggaattttttgaacactctggagtcaataattgaccgcagagagttctttcatattatgtcctcaaatcatgtagacatatttcatatagacttaatattagacaaattagaaaacaaaactgttctcccatatttcggtattcatccatggtacagccacttatttactgatctcaagttggaggaatttgagaacgaacaagaatggaagcaaattcattacgaatcagtacttgatcctacaccaccgtccgagttgttagaggtactaccaaatcccataagcttcgactcgcatgttaatgaaatacgcaggcttgccaacaagcatcaaaaaaagggattttctgttggcattggagaaattgggttagataaactatttagaattccactgaacggatattttggcaatcagaaactccccctcaacgataatccaaataagctatcggcctgtagagtcaaaatggatcaccaagcatacatatttgcaaggcaattgaaattggccagtagtttgaaaagacctatttctttacattgtgtcaaggcacatggtttactatacgaccaagtaactagtaaaaaagaacttgacggcatttcttcagttatacttcattcatattccggatctctcgatcaggcaggtttgtggatacgacacttttcgaagtcgaatcgactattatatttttcgctctcaaattggattaatggatccgccaagaaacaagattcgttaaaagatctcgttaaactacttggcaacgatcagatactactagaaactgatgttggtatagacaaatatctactagatcctgagagaagagaagaatatttcaatcagctaaaagaaatttttatcaagatatgctcaattaaaggctggggtgaagatcttgcgaaggagatcatatttgacaattggaataaatctatcgcccaatga

SEQ ID NO: 50347 - protein, 346 aa, Debaryomyces hansenii CBS767
MNGYVQFLADSHCHLDVECSSQRAEELGNFLNTLESIIDRREFFHIMSSNHVDIFHIDLILDKLENKTVLPYFGIHPWYSHLFTDLKLEEFENEQEWKQIHYESVLDPTPPSELLEVLPNPISFDSHVNEIRRLANKHQKKGFSVGIGEIGLDKLFRIPLNGYFGNQKLPLNDNPNKLSACRVKMDHQAYIFARQLKLASSLKRPISLHCVKAHGLLYDQVTSKKELDGISSVILHSYSGSLDQAGLWIRHFSKSNRLLYFSLSNWINGSAKKQDSLKDLVKLLGNDQILLETDVGIDKYLLDPERREEYFNQLKEIFIKICSIKGWGEDLAKEIIFDNWNKSIAQ

SEQ ID NO: 50348 - DNA, 936 bp, Oryza sativa (japonica cultivar-group)
  CDS (1)..(936)
atggcccaggcaccagcgcgcgccgcttccgtcgtgcggctcttcgacgcgcactgccacctgcaggacccgcgtgtgctgtccgtcgccccttccctcatacgcgccgccaccgccgccggcgtcgcgcgcttcgccgtcaacggcacttccgagaaagactggcacctggtgaagcagatggccgaggagtacccgtccgtcgtcccctgcttcggcctccacccatggtgggtaccggagagatcgccggattggatggattcgctccggcggttcttcgctgaaacaccagaggcggctgttggggagattggtctggacaaaggttcacatggaaaaaccattgactttggagaacaggttgaagttttccagcagcaacttgaacttgctaaggagttgaacaagcctgtttctgttcattgtgtgcgcgcctttggtgatcttctggagatactaaagagaactggacctttcccagctggtgtgttgctgcattcgtatctaggatctgcagaaatggtgtccagccttgaaattttaggctgttacttttcgttgtccggcttccttacaggcatgaaatccacgaaggcaaagaaaatgctaaaatcaatgcccttagacagaattctgctagagaccgacgcaccggatgcattaccgaaattggatgatatttctctattagcagtacctgtggatagctcaagtgcagataatggagaaagtaaaaaagattctaattcacgggcatctaccacttcaaatgagtctttgaaccatccatctaatatccacattgttatgaagtatgtcgcctcactgcttgaaatatcagaaatagaacttgctgaagtgacatacaagaatgcgaccaagctgttctcttatcatggatccaaagttcacaatgaagtggaagctgtgtga

SEQ ID NO: 50349 - protein, 311 aa, Oryza sativa (japonica cultivar-group)
MAQAPARAASVVRLFDAHCHLQDPRVLSVAPSLIRAATAAGVARFAVNGTSEKDWHLVKQMAEEYPSVVPCFGLHPWWVPERSPDWMDSLRRFFAETPEAAVGEIGLDKGSHGKTIDFGEQVEVFQQQLELAKELNKPVSVHCVRAFGDLLEILKRTGPFPAGVLLHSYLGSAEMVSSLEILGCYFSLSGFLTGMKSTKAKKMLKSMPLDRILLETDAPDALPKLDDISLLAVPVDSSSADNGESKKDSNSRASTTSNESLNHPSNIHIVMKYVASLLEISEIELAEVTYKNATKLFSYHGSKVHNEVEAV

SEQ ID NO: 50350 - DNA, 954 bp, Yarrowia lipolytica CLIB99
  CDS (1)..(954)
atgtttgatgcccattgtcacccaacagacactcctgataccctcgatctgatcccgagcatgaaaacggaccttctggcctgcatgtcgaccaactttcaagatatagaaagagtggagtcgattgctgattggcctaaggtggtaccttgtttcggataccatccttggttcacatggaaggtgtacacggaagaaggattggaagcaaaggaacattatagtcgtgttttggcaggtcccagaggctctgaggaggaactgcagggattcgtggccagccaagagcaaccaatgccgttctccaattatcttgatctcatgagacaaggtcttgagaagtatcctaatggcatgattggggaggcgggtttggacaagccgtttcgggttaaggataaagagggggataagctgacgccatttagagtgtctcttgaccaccagcggacgattttggggctccagttgcaactagctgttgactatgggagacccatatctttgcatggagttcagtgtcatggagcgttacttgagtgtgtaaccgagattctaaagaagaaccctggaaaacccctgactgtttgtttgcattcttactctggtcctcccgactttctggtaggctggttcaagttggaaggctccaagaagaagcctaccaaggtacgtgtcttcgtgtctgtgagcagtgttataacctgcggacacatcgatcgtgaaggagaccgcttcgatcaaaagttggagaagatttctcctttgttggcgaagattccggacgaccggctgcttattgagtcggattactacaaagcaggacctgttatggatgatcttatgcaggaggtgctggatctagttgctcatgcaaagggtgtatctaaagcgggggctctcgagatgttggacaagaactctcgagagtttttggactacagacgcgagtag

SEQ ID NO: 50351 - protein, 317 aa, Yarrowia lipolytica CLIB99
MFDAHCHPTDTPDTLDLIPSMKTDLLACMSTNFQDIERVESIADWPKVVPCFGYHPWFTWKVYTEEGLEAKEHYSRVLAGPRGSEEELQGFVASQEQPMPFSNYLDLMRQGLEKYPNGMIGEAGLDKPFRVKDKEGDKLTPFRVSLDHQRTILGLQLQLAVDYGRPISLHGVQCHGALLECVTEILKKNPGKPLTVCLHSYSGPPDFLVGWFKLEGSKKKPTKVRVFVSVSSVITCGHIDREGDRFDQKLEKISPLLAKIPDDRLLIESDYYKAGPVMDDLMQEVLDLVAHAKGVSKAGALEMLDKNSREFLDYRRE

SEQ ID NO: 50352 - DNA, 1380 bp, Cryptococcus neoformans var. neoformans JEC21
  CDS (1)..(1380)
atgtgccacgacaagccccccacgcagaaacaagcacgggacgcacaggccgccgacgcgcccctcgcctgggagacgatcccgctgcctcccgcccatgtcctctcccaccgtacgccccccccccctccccccctctggctaatgagtacgacagtgacagacgcacactgccacccgacagacctcgcccatccccccgcggtatacgacatcctcgccctcggcggactcgcagccatggcgaccgcggcggacgaccaggcgaaagtggaggcgctgggccgggagaggcagtggttcaggggggacccgggccggaacgagggacgcggcagggggaaagggaaagggggggcaggggtgggcgtggtggcgtgcttcggataccatccctggttcacccatcgctataccctctctccgccgtccgccatcccttccaggcgggaccactatacctctctcttcctccaatccgcccctgccaagtccacctccagcgaccgcccagacgaaaacacgctcgaaaccctgttggaaaccctcctgcccttcctccccgacccaacccctctccagcccttgctccacaccctccgccaaaacctcgtcaagttcttggacgaagggagactgacaatgctgggagaggtggggctggatgcgagtgcgaggctgaggtggccggtcgaggcgagaggtatctgggaggagatgtatgggaaggggaggaaggaactggagcccgcgccaggggaaggagaagaatggaaacgcctgacaccgttcaaagtccccatcgcacatcaacgtgccgtccttgaagctcaaatggaaatcgcaatcgagctgggtgtcaacatttcattccattctgtcgcttgtgctggcccgacgatggatgttttaaacagtatgaaaaccaaacacggcccccactttatccggcgcgtaaacgttgatcttcattccgccgggggatggagtcctcagttctggacacaggctcaaaaatcccttcccaacctatacgcatccccctccatccccatcacttcccgctccccctccgccccatctctcatccgcgccatcgcccgcgatagaatgctggtagagtcggacacccatgatgcgaggttgagtacaaggtacgtttgggcagcgacagagtgggtgggcaggttgaaagggtggaaggtggagggtttggatcgcaatcgggattgtccaagggtggaggaagactgggaactagaaagcgaagaagaagcatacgaccatcgtggaaaacctatcgaccctgcaccagaagaaacatggaccgttcggacattggagaggaactgggcacggtttatgcgtcttttagattga

SEQ ID NO: 50353 - protein, 459 aa, Cryptococcus neoformans var. neoformans JEC21
MCHDKPPTQKQARDAQAADAPLAWETIPLPPAHVLSHRTPPPPPPLWLMSTTVTDAHCHPTDLAHPPAVYDILALGGLAAMATAADDQAKVEALGRERQWFRGDPGRNEGRGRGKGKGGAGVGVVACFGYHPWFTHRYTLSPPSAIPSRRDHYTSLFLQSAPAKSTSSDRPDENTLETLLETLLPFLPDPTPLQPLLHTLRQNLVKFLDEGRLTMLGEVGLDASARLRWPVEARGIWEEMYGKGRKELEPAPGEGEEWKRLTPFKVPIAHQRAVLEAQMEIAIELGVNISFHSVACAGPTMDVLNSMKTKHGPHFIRRVNVDLHSAGGWSPQFWTQAQKSLPNLYASPSIPITSRSPSAPSLIRAIARDRMLVESDTHDARLSTRYVWAATEWVGRLKGWKVEGLDRNRDCPRVEEDWELESEEEAYDHRGKPIDPAPEETWTVRTLERNWARFMRLLD

SEQ ID NO: 50354 - DNA, 969 bp, Dictyostelium discoideum
  CDS (1)..(969)
atgtgtgaaaaagaaattaataataataataataataatgaattaactgaaaaatctaaagaggaaattgaaaaagatgaaattgaatacttggaatatttaaaatataggaaagaaattattgatagtcattgtcatattcatgaagatgttgaacatttacaagagtcatgtgatttaccatttaaaaagatattactcatgggtacaacagttgaagattgggataaaattaaccaattagccgataagatcaatgatgataataaaatcattagatgttttggtatacatccttggtttgtttataattatttaccaccaactgaattaattggtaaaataaaagaaggtgatggcagtaatgattcaataataataagtattgacgaaacgtggagaattaaaatgaaagaattgttactaaaatatccaaattcaatagtgggtgaaattggtattgacaaggtgacaaaagttagattaaatggatttaataagaatgaccaggagagccaaatgagggtgtttagagaccagattgagatagccaatgaattggacagattggttagtttacattgtgtacaactccaaggtcaactattaacattcttccaatcacttgatattgataaattcccacctgcaattgcactacatacttttggtggtaaacctgctacagtcgatcaattttgtaaaatggcatctggaaaaggtgataaattctatttcggtctatcatttataaatttaacattttcaaaagttgataaactcattcaagcaattcctgatgacagattattactagaaagtgatcaaaattcaccaacccaagttgatcaatcattatttaaattaattcaaaaaatttcaatttcaaaaaattggacaattcaaaaaacaattgaacaaacaactttaaatactttaaattttctttcaaagcaaattaaaaaataa

SEQ ID NO: 50355 - protein, 322 aa, Dictyostelium discoideum
MCEKEINNNNNNNELTEKSKEEIEKDEIEYLEYLKYRKEIIDSHCHIHEDVEHLQESCDLPFKKILLMGTTVEDWDKINQLADKINDDNKIIRCFGIHPWFVYNYLPPTELIGKIKEGDGSNDSIIISIDETWRIKMKELLLKYPNSIVGEIGIDKVTKVRLNGFNKNDQESQMRVFRDQIEIANELDRLVSLHCVQLQGQLLTFFQSLDIDKFPPAIALHTFGGKPATVDQFCKMASGKGDKFYFGLSFINLTFSKVDKLIQAIPDDRLLLESDQNSPTQVDQSLFKLIQKISISKNWTIQKTIEQTTLNTLNFLSKQIKK

SEQ ID NO: 50356 - DNA, 1215 bp, Aspergillus nidulans FGSC A4
  CDS (1)..(1215)
atgaaccagtctgaatctcaatatgagcccgactttccttggggaattggtgtcttcgacgctcattgccaccctactgacaccatggcgagcatcgccgatataccccgcatgaaagcaacgacacttacaatcatgtccacacgagctgacgaccaagacctggtctttcaagtcgcaactcagcttgccaaagaatcaggcgatgggaatgaggacgcacggcgcgttcttccctgttttggctggcacccgtggttttcgcacctgatcatggacgacataacaccgtccaaagatgatcaaaaggaaattgacgagaacaccaaaaagtcacactatagccgaattctaaaaccatccccagatgaggctttcacatcttctcttccaacccccatacccctctcgcagctcctatcagaaacgcggtcaagactacaggccttccctgctgccctcgtcggcgaaattggtttggatcgagcctttcgactaccccagccctggacgcaagaggagcacgacgcccgagatggcgcgatgacgcctgggtcgcgcgagggccgccggctttctccctaccaggtcaggccggagcaccagaaagctgttctggaagctcagttgcgtctggccggagcattgcagcggccggtgtctgtgcatagtgtgcaggcacatggggccgtgattgaggtcttcaagggcctttggaaagggcatgagcggaaggtcgcttcacggcgcgagcggaaacgccgacatagtcatgccgaggcgcatgcgggaagcgatgatgaagatgcgcgaggcgcgcagacctcacatagtgcaggcacaagggaacgcgaagccctccccttcccgccacggatatgcatgcactcctattcgggtcctgcagaaaccctaaagcaattcctgcacccgtcgaacccatcagacgtctatttctctttttcaagcgttatcaatttctcccatcactctgacaagtctgttgcggtgatcaaggctttacccgacgacagggtgttaattgaaagtgatctgcatattgccgggcaacagatggacgatcggctcgaggaggtcactcggcagatttgtgaaatccgcgggtgggatctgcggcaaggggtgcagcagctggcggataattggagacgctttgtgtatggtgacgcgctgccagattcatcaaatagctga

SEQ ID NO: 50357 - protein, 404 aa, Aspergillus nidulans FGSC A4
MNQSESQYEPDFPWGIGVFDAHCHPTDTMASIADIPRMKATTLTIMSTRADDQDLVFQVATQLAKESGDGNEDARRVLPCFGWHPWFSHLIMDDITPSKDDQKEIDENTKKSHYSRILKPSPDEAFTSSLPTPIPLSQLLSETRSRLQAFPAALVGEIGLDRAFRLPQPWTQEEHDARDGAMTPGSREGRRLSPYQVRPEHQKAVLEAQLRLAGALQRPVSVHSVQAHGAVIEVFKGLWKGHERKVASRRERKRRHSHAEAHAGSDDEDARGAQTSHSAGTREREALPFPPRICMHSYSGPAETLKQFLHPSNPSDVYFSFSSVINFSHHSDKSVAVIKALPDDRVLIESDLHIAGQQMDDRLEEVTRQICEIRGWDLRQGVQQLADNWRRFVYGDALPDSSNS

SEQ ID NO: 50358 - DNA, 972 bp, Candida albicans SC5314
  CDS (1)..(972): transl_table=12
atgaatgacacatttctaaacctaagcgatagccattgccattttaacccggaatgtactgctagtgacacagagaaatttgcagaaagactcaacgagcaatcaaaacagatcccagacaactactttcatctaatgactactcaacatttggatcttgaatttatggatacattactaaccaggttagagaatccaagagtattagttccatattttggtgtacacccttggttttctcatttgttttatattgaaggtacccccaccaaggaggaacattacaagaatgttttgaaaccagaaccttccaatgaattattggctacattacctgatcccattagtctacacaaacacaaagatagatttctagagatcattaacaaacataaccttgaaatatatggaattggcgaaattgggttggataaactattcagagttcctaataacggctactgtggtaatttgaatttcccactgtcgacagaaaataaattatctgcttgtagagttgatattaatcatcaattggatgtttttaaatttcaactaacattagctgaacaattaaagaaacaagtgtctttgcattgtgttaaagctcatggcttattgtttgatcaagtgaaaaagttttccaatattacagtcatccttcattcgtataccggatcaattgaacaagcacaggtgtggataaaatcgttaccccagaacagactctacttttcattttcaaattggatcaacggagaaaaaatagaggctctaaaagcacttgtaacggcacttcgaccaacgcaaatattgattgaatcagatattgacgttgacagaagtttcattgagcagaggcaaacaaaacactttgaccaccttgatggcatttacaaaaagattcatgagcacatttttatagattcattacaaattcacaacaacatgctaaattctataggcatatag

SEQ ID NO: 50359 - protein, 323 aa, Candida albicans SC5314
MNDTFLNLSDSHCHFNPECTASDTEKFAERLNEQSKQIPDNYFHLMTTQHLDLEFMDTLLTRLENPRVLVPYFGVHPWFSHLFYIEGTPTKEEHYKNVLKPEPSNELLATLPDPISLHKHKDRFLEIINKHNLEIYGIGEIGLDKLFRVPNNGYCGNLNFPSSTENKLSACRVDINHQLDVFKFQLTLAEQLKKQVSLHCVKAHGLLFDQVKKFSNITVILHSYTGSIEQAQVWIKSLPQNRLYFSFSNWINGEKIEALKALVTALRPTQILIESDIDVDRSFIEQRQTKHFDHLDGIYKKIHEHIFIDSLQIHNNMLNSIGI

SEQ ID NO: 50360 - DNA, 1386 bp, Aspergillus fumigatus Af293
  CDS (1)..(1386)
atgctgatacagctaatacacgagtggtcaatgttggtcactgaagccccaggcataacagtaattactgttatggtatcggtatttccagtatcttttcggtactattacatcacagcattcagttgtcaccctcaagggccgaaaacgatctctatcatactaccacgagatcaacacatatgggacgggaggaacatgcctgaatatgatcatgacaaggtccccgattttccttgggaacttggtgtctacgatgcccattgccaccccacggacgccatgtcgtcaatatctgatattccagggatgaaagcagcgacgctcacagtcatggccacaagagcggaagatcaggacctcgtatttcagatagctaaagaccttaacaatgcaaaattgactgttcaggacgccgagacggatcgcgtactgccatccttcggatggcatccatggttttcacaccaaatcatcgacgatcagaagtcatcatcagatataacccagggcgcctcagatctggagagcaagaagacacattatcataaagtcttaacaccagctccagaagatgaagacttcgtttcttctctacctgatcccaagcctctctcgcaattcatctccgaaacacgcgaacggctactatcttttcccaatgctctggttggcgaggtcggccttgatcgtgctttcagacttccaaaggcctggacccagcaggaggctgagaatcgtaatgcgcatataacacccggatctcgtgaaggccggaaactctcaccttacagggtgcatatggaacaccaaaaggctattctgaaggcccagcttcgcctcgccggagaacttcgacgaccagtctcagtacacagtgtccaagcacatggagcggtgttcgatgttttcaaggagctatggtccggccatgagcgcagagtaccatcgcgacgggagagacgaagacgtcttagcgttgaaggggctcacgcagagagcgacgcggaagacgagcaagtgcaaaagtcactaaagcgcgaaggttcacctctcccatacccaccccggatctgtatgcattcgtattcaggtcctgtggagcaattgaagcaatttctgaacccttcaaatccctcagacgtgtacttctccttttccaatgtcatcaatttcagcgggccatcgtctcagaaagtcattgcagttgtcaaagctttgccggaggacagagtgcttattgagagtgaccttcacactgctggacagcagatggacgacttgctcgaggaagttgctcggcagatatgtgagctccgtggctggtctttgcaggagggggtccaacgattggcagacaactggaaacggtttgtgtttgggtag

SEQ ID NO: 50361 - protein, 461 aa, Aspergillus fumigatus Af293
MLIQLIHEWSMLVTEAPGITVITVMVSVFPVSFRYYYITAFSCHPQGPKTISIILPRDQHIWDGRNMPEYDHDKVPDFPWELGVYDAHCHPTDAMSSISDIPGMKAATLTVMATRAEDQDLVFQIAKDLNNAKLTVQDAETDRVLPSFGWHPWFSHQIIDDQKSSSDITQGASDLESKKTHYHKVLTPAPEDEDFVSSLPDPKPLSQFISETRERLLSFPNALVGEVGLDRAFRLPKAWTQQEAENRNAHITPGSREGRKLSPYRVHMEHQKAILKAQLRLAGELRRPVSVHSVQAHGAVFDVFKELWSGHERRVPSRRERRRRLSVEGAHAESDAEDEQVQKSLKREGSPLPYPPRICMHSYSGPVEQLKQFLNPSNPSDVYFSFSNVINFSGPSSQKVIAVVKALPEDRVLIESDLHTAGQQMDDLLEEVARQICELRGWSLQEGVQRLADNWKRFVFG

SEQ ID NO: 50362 - DNA, 1380 bp, Cryptococcus neoformans var
  CDS (1)..(1380)
atgtgccacgacaagccccccacgcagaaacaagcacgggacgcacaggccgccgacgcgcccctcgcctgggagacgatcccgctgcctcccgcccatgtcctctcccaccgtacgccccccccccctccccccctctggctaatgagtacgacagtgacagacgcacactgccacccgacagacctcgcccatccccccgcggtatacgacatcctcgccctcggcggactcgcagccatggcgaccgcggcggacgaccaggcgaaagtggaggcgctgggccgggagaggcagtggttcaggggggacccgggccggaacgagggacgcggcagggggaaagggaaagggggggcaggggtgggcgtggtggcgtgcttcggataccatccctggttcacccatcgctataccctctctccgccgtccgccatcccttccaggcgggaccactatacctctctcttcctccaatccgcccctgccaagtccacctccagcgaccgcccagacgaaaacacgctcgaaaccctgttggaaaccctcctgcccttcctccccgacccaacccctctccagcccttgctccacaccctccgccaaaacctcgtcaagttcttggacgaagggagactgacaatgctgggagaggtggggctggatgcgagtgcgaggctgaggtggccggtcgaggcgagaggtatctgggaggagatgtatgggaaggggaggaaggaactggagcccgcgccaggggaaggagaagaatggaaacgcctgacaccgttcaaagtccccatcgcacatcaacgtgccgtccttgaagctcaaatggaaatcgcaatcgagctgggtgtcaacatttcattccattctgtcgcttgtgctggcccgacgatggatgttttaaacagtatgaaaaccaaacacggcccccactttatccggcgcgtaaacgttgatcttcattccgccgggggatggagtcctcagttctggacacaggctcaaaaatcccttcccaacctatacgcatccccctccatccccatcacttcccgctccccctccgccccatctctcatccgcgccatcgcccgcgatagaatgctggtagagtcggacagccatgatgcgaggttgagtacaaggtacgtttgggcagcgacagagtgggtgggcaggttgaaagggtggaaggtggagggtttggatcgcaatcaagattgtccaagggtggaggaagactgggaactagaaagcgaagaagaagcatacgaccatcgtggaaaacctatcgaccctgcaccagaagaaacatggaccgttcggacattggagaggaactgggcacggtttatgcgtcttttagattga

SEQ ID NO: 50363 - protein, 459 aa, Cryptococcus neoformans var
MCHDKPPTQKQARDAQAADAPLAWETIPLPPAHVLSHRTPPPPPPLWLMSTTVTDAHCHPTDLAHPPAVYDILALGGLAAMATAADDQAKVEALGRERQWFRGDPGRNEGRGRGKGKGGAGVGVVACFGYHPWFTHRYTLSPPSAIPSRRDHYTSLFLQSAPAKSTSSDRPDENTLETLLETLLPFLPDPTPLQPLLHTLRQNLVKFLDEGRLTMLGEVGLDASARLRWPVEARGIWEEMYGKGRKELEPAPGEGEEWKRLTPFKVPIAHQRAVLEAQMEIAIELGVNISFHSVACAGPTMDVLNSMKTKHGPHFIRRVNVDLHSAGGWSPQFWTQAQKSLPNLYASPSIPITSRSPSAPSLIRAIARDRMLVESDSHDARLSTRYVWAATEWVGRLKGWKVEGLDRNQDCPRVEEDWELESEEEAYDHRGKPIDPAPEETWTVRTLERNWARFMRLLD

SEQ ID NO: 50364 - DNA, 957 bp, Arabidopsis thaliana
  CDS (1)..(957)
atgaaactgttcgacgcgcactgtcaccttcaagacccgaggattatcaccaaagctcctcagataatctcctccgccgttgcttccggcgtctctgctttcgccgtcaatggagtctccgagaaagattggagtttggtcaaagagatgggagctaaatacccttctgttgttccttgctttgggatccatccatggtatgtagcagagaggagtcctcaatggtttgagacattaaagagtttctttgagaccactcctactgctgctgttggagaaattggtttggacaaagggtctaagggaagggagattgatttctcagaacaggttaccgtctttcgtcaacagcttgaacttgcaaaggaattgaagaaacctgcgtcagttcattgtgttcgtgcatttggggatctactcgagatattaaaatctgtagggccttttccttctggggtcatgcttcactcgtatttgggttctgctgagatggttcctgaatttgctaagctcggtgcatatttctccttctccggtttccttatgtccatgagtgagaaaaaagccaagaagatgttgaaagcagttccatctgataggatcttattggagacggattcaccagatgcactaccaaaggcagagtcaggttgtctctactttgtagacggagatccttctctacccgaagaaggaaattcagctcaggatcttgattctgcttcatatgataagcctaatgtgtctagtgactcgatgaagttaacaaaggaaacacttaatcacccggctaatattcatatcttgttggatatgaagaatgaagaactcgcggaactaagttatcaaaatgctgttcggttattctcttacgaaggttcaaagatacttcttgacagaggtactggtgatgtctctggtcacactcaaaaccagtcaacaacacatgtatcatga

SEQ ID NO: 50365 - protein, 318 aa, Arabidopsis thaliana
MKLFDAHCHLQDPRIITKAPQIISSAVASGVSAFAVNGVSEKDWSLVKEMGAKYPSVVPCFGIHPWYVAERSPQWFETLKSFFETTPTAAVGEIGLDKGSKGREIDFSEQVTVFRQQLELAKELKKPASVHCVRAFGDLLEILKSVGPFPSGVMLHSYLGSAEMVPEFAKLGAYFSFSGFLMSMSEKKAKKMLKAVPSDRILLETDSPDALPKAESGCLYFVDGDPSLPEEGNSAQDLDSASYDKPNVSSDSMKLTKETLNHPANIHILLDMKNEELAELSYQNAVRLFSYEGSKILLDRGTGDVSGHTQNQSTTHVS

SEQ ID NO: 50366 - DNA, 1008 bp, Schizosaccharomyces pombe
  CDS (1)..(1008)
atggaatctatcattgacgctcattgccatccaactgatgcaccgcaagaattacatttggttgctaatctttctgttggtaaattaatagtaatgggaacccggccgacagatcaaaagtatgtcgaacaacttgcgaaagaataccctggtaaagtaatacctagttttgggatacatccatggttttcttattatttgtacgatgatttggataaagatttgcaaagtagtgaaacgagaaaaaagaagcattacgaaaaaatattgactccaatacctgatgaagattttatcaatgctcttcccaacccagtcccgatttcagaatttttggaggacgctcgtcgacatcttaaacagtacccaaacgctctcattggcgaaatcggcttggataagccatttcgattgccagttggcccatatgatgcaaggtcctcacttcctcaaggacctctatcaccattttacgtaaaaatggaacatcaatgtaaagtgtttgaagcacaagtgcgtcttgctgcagaattccaacgtgctgttagtgttcactgcgttcagacgtatgctcttttgtatagcagtttagctaaattttgggatggtcgctggattccttccaaaacgaaaatacgaaagatgaagaaagaagagtacgaaaattctcttgctgaagaacgaaagcattaccctcccaaaatttgccttcatagctactctggtagcattgagcaaatttctcagttttcagcccataaagttccgaccgagttttactactctttttcaataggtataaatagtcgttataaaaattttattcaaacacttaaaggcgttcccgacgataagctattggcagagagtgatcatcacagtgctagccaaatcgatgaattagttcgacaatctttgaacgttatgtcagaagctaagtcctggacttttgaggatactattacaaaaatttcaagtaactctaaagcatttttgaaagtaacttga

SEQ ID NO: 50367 - protein, 335 aa, Schizosaccharomyces pombe
MESIIDAHCHPTDAPQELHLVANLSVGKLIVMGTRPTDQKYVEQLAKEYPGKVIPSFGIHPWFSYYLYDDLDKDLQSSETRKKKHYEKILTPIPDEDFINALPNPVPISEFLEDARRHLKQYPNALIGEIGLDKPFRLPVGPYDARSSLPQGPLSPFYVKMEHQCKVFEAQVRLAAEFQRAVSVHCVQTYALLYSSLAKFWDGRWIPSKTKIRKMKKEEYENSLAEERKHYPPKICLHSYSGSIEQISQFSAHKVPTEFYYSFSIGINSRYKNFIQTLKGVPDDKLLAESDHHSASQIDELVRQSLNVMSEAKSWTFEDTITKISSNSKAFLKVT

SEQ ID NO: 50368 - DNA, 25 bp, Artificial sequence
  (1)..(25): primer
atgaataaacttgttgatgcccact

SEQ ID NO: 50369 - DNA, 27 bp, Artificial sequence
  (1)..(27): primer
tcacttgataaatttctgaaagttttc

SEQ ID NO: 50370 - protein, 495 aa, Artificial sequence
  Variant (2)..(2): xaa in position 2 is any amino acid
  Variant (6)..(32): xaa in position 6 to 32 is any amino acid
  Variant (33)..(43): xaa in position 33 to 43 is any or no amino acid
  Variant (45)..(57): xaa in position 45 to 57 is any amino acid
  Variant (58)..(84): xaa in position 58 to 84 is any or no amino acid
  Variant (87)..(87): xaa in position 87 is any amino acid
  Variant (91)..(96): xaa in position 91 to 96 is any amino acid
  Variant (97)..(146): xaa in position 97 to 146 is any or no amino acid
  Variant (148)..(164): xaa in position 148 to 164 is any amino acid
  Variant (165)..(173): xaa in position 165 to 173 is any or no amino acid
  Variant (176)..(176): xaa in position 176 is any amino acid
  Variant (180)..(189): xaa in position 180 to 189 is any amino acid
  Variant (190)..(227): xaa in position 190 to 227 is any or no amino acid
  Variant (229)..(238): xaa in position 229 to 238 is any amino acid
  Variant (240)..(246): xaa in position 240 to 246 is any amino acid
  Variant (248)..(248): xaa in position 248 is any amino acid
  Variant (250)..(250): xaa in position 250 is any amino acid
  Variant (252)..(254): xaa in position 252 to 254 is any amino acid
  Variant (256)..(270): xaa in position 256 to 270 is any amino acid
  Variant (271)..(337): xaa in position 271 to 337 is any or no amino acid
  Variant (341)..(342): xaa in position 341 to 342 is any amino acid
  Variant (344)..(358): xaa in position 344 to 358 is any amino acid
  Variant (359)..(368): xaa in position 359 to 368 is any or no amino acid
  Variant (370)..(370): xaa in position 370 is any amino acid
  Variant (372)..(393): xaa in position 372 to 393 is any amino acid
  Variant (394)..(405): xaa in position 394 to 405 is any or no amino acid
  Variant (407)..(407): xaa in position 407 is any amino acid
  Variant (409)..(409): xaa in position 409 is any amino acid
  Variant (411)..(445): xaa in position 411 to 445 is any amino acid
  Variant (446)..(494): xaa in position 446 to 494 is any or no amino acid
DXHCHXXXXXXXXXXXXXXXXXXXXXXXXXXXXXXXXXXXXXXDXXXXXXXXXXXXXXXXXXXXXXXXXXXXXXXXXXXXXXXXFGXHPWXXXXXXXXXXXXXXXXXXXXXXXXXXXXXXXXXXXXXXXXXXXXXXXXXXXXXXXXPXXXXXXXXXXXXXXXXXXXXXXXXXXGEXGLDXXXXXXXXXXXXXXXXXXXXXXXXXXXXXXXXXXXXXXXXXXXXXXXXQXXXXXXXXXXAXXXXXXXSXHXVXXXGXXXXXXXXXXXXXXXXXXXXXXXXXXXXXXXXXXXXXXXXXXXXXXXXXXXXXXXXXXXXXXXXXXXXXXXXXXXXXXXXXXLHSXXGXXXXXXXXXXXXXXXXXXXXXXXXXSXSXXXXXXXXXXXXXXXXXXXXXXXXXXXXXXXXXXLXEXDXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 50371 - protein, 5 aa, Artificial sequence
  Variant (2)..(2): xaa in position 2 is Ala or Ser
DXHCH

SEQ ID NO: 50372 - protein, 11 aa, Artificial sequence
  Variant (2)..(3): xaa in position 2 to 3 is any amino acid
  Variant (4)..(4): xaa in position 4 is any or no amino acid
  Variant (7)..(7): xaa in position 7 is any amino acid
  Variant (11)..(11): xaa in position 11 is Phe, Trp or Tyr
VXXXFGXHPWX

SEQ ID NO: 50373 - protein, 12 aa, Artificial sequence
  Variant (3)..(3): xaa in position 3 is Ile or Val
  Variant (5)..(5): xaa in position 5 is Ile or Leu
  Variant (7)..(9): xaa in position 7 to 9 is any amino acid
  Variant (10)..(11): xaa in position 10 to 11 is any or no amino acid
GEXGXDXXXXXR

SEQ ID NO: 50374 - protein, 37 aa, Artificial sequence
  Variant (2)..(3): xaa in position 2 to 3 is any amino acid
  Variant (4)..(4): xaa in position 4 is Ile or Val
  Variant (5)..(5): xaa in position 5 is Phe or Leu
  Variant (6)..(10): xaa in position 6 to 10 is any amino acid
  Variant (11)..(11): xaa in position 11 is Ile or Leu
  Variant (13)..(18): xaa in position 13 to 18 is any amino acid
  Variant (19)..(19): xaa in position 19 is Ala, Ile, Leu or Val
  Variant (21)..(21): xaa in position 21 is Phe, Ile, Leu or Val
  Variant (23)..(23): xaa in position 23 is Cys, Asp, Gly or Ser
  Variant (25)..(27): xaa in position 25 to 27 is any amino acid
  Variant (29)..(29): xaa in position 29 is any amino acid
  Variant (30)..(36): xaa in position 30 to 36 is any or no amino acid
QXXXXXXXXXXAXXXXXXXSXHXVXXXGXXXXXXXXL

SEQ ID NO: 50375 - protein, 10 aa, Artificial sequence
  Variant (2)..(2): xaa in position 2 is any amino acid
  Variant (3)..(3): xaa in position 3 is Asp, Glu, Gly, Asn, Gln or Thr
  Variant (4)..(4): xaa in position 4 is any amino acid
  Variant (5)..(5): xaa in position 5 is Ile, Leu or Val
  Variant (7)..(7): xaa in position 7 is any amino acid
  Variant (9)..(9): xaa in position 9 is Ser or Thr
PXXXXLXEXD

SEQ ID NO: 50376 - DNA, 1992 bp, Saccharomyces cerevisiae; identical to SEQ ID NO: 46090
  CDS (1)..(1992)

SEQ ID NO: 50377 - protein, 663 aa, Saccharomyces cerevisiae; identical to SEQ ID NO: 46091

SEQ ID NO: 50378 - DNA, 28 bp, Artificial sequence
  (1)..(28): primer
atgaagttactttttaaaagatattcgt

SEQ ID NO: 50379 - DNA, 27 bp, Artificial sequence
  (1)..(27): primer
ttatttttgttgcatttgcttagatct

SEQ ID NO: 50380 - DNA, 1203 bp, Escherichia coli; identical to SEQ ID NO: 13945
  CDS (1)..(1203)

SEQ ID NO: 50381 - protein, 400 aa, Escherichia coli; identical to SEQ ID NO: 13946

SEQ ID NO: 50382 - DNA, 1281 bp, Aquifex aeolicus VF5; identical to SEQ ID NO: 13947
  CDS (1)..(1281): transl_table=11

SEQ ID NO: 50383 - protein, 426 aa, Aquifex aeolicus VF5; identical to SEQ ID NO: 13948

SEQ ID NO: 50384 - DNA, 1260 bp, Neisseria meningitidis Z2491; identical to SEQ ID NO: 13949
  CDS (1)..(1260): transl_table=11

SEQ ID NO: 50385 - protein, 419 aa, Neisseria meningitidis Z2491; identical to SEQ ID NO: 13950

SEQ ID NO: 50386 - DNA, 1425 bp, Deinococcus radiodurans R1; identical to SEQ ID NO: 13951
  CDS (1)..(1425): transl_table=11

SEQ ID NO: 50387 - protein, 474 aa, Deinococcus radiodurans R1; identical to SEQ ID NO: 13952

SEQ ID NO: 50388 - DNA, 1392 bp, Mycobacterium tuberculosis CDC1551; identical to SEQ ID NO: 13953
  CDS (1)..(1392): transl_table=11

SEQ ID NO: 50389 - protein, 463 aa, Mycobacterium tuberculosis CDC1551; identical to SEQ ID NO: 13954

SEQ ID NO: 50390 - DNA, 1203 bp, Salmonella typhimurium LT2; identical to SEQ ID NO: 13955
  CDS (1)..(1203): transl_table=11

SEQ ID NO: 50391 - protein, 400 aa, Salmonella typhimurium LT2; identical to SEQ ID NO: 13956

SEQ ID NO: 50392 - DNA, 1320 bp, Agrobacterium tumefaciens str. C58; identical to SEQ ID NO: 13957
  CDS (1)..(1320): transl_table=11

SEQ ID NO: 50393 - protein, 439 aa, Agrobacterium tumefaciens str. C58; identical to SEQ ID NO: 13958

SEQ ID NO: 50394 - DNA, 1251 bp, Yersinia pestis KIM; identical to SEQ ID NO: 13959
  CDS (1)..(1251): transl_table=11

SEQ ID NO: 50395 - protein, 416 aa, Yersinia pestis KIM; identical to SEQ ID NO: 13960

SEQ ID NO: 50396 - DNA, 1314 bp, Thermosynechococcus elongatus BP-1; identical to SEQ ID NO: 13961
  CDS (1)..(1314): transl_table=11

SEQ ID NO: 50397 - protein, 437 aa, Thermosynechococcus elongatus BP-1; identical to SEQ ID NO: 13962

SEQ ID NO: 50398 - DNA, 1464 bp, Oceanobacillus iheyensis HTE831; identical to SEQ ID NO: 13963
  CDS (1)..(1464): transl_table=11

SEQ ID NO: 50399 - protein, 487 aa, Oceanobacillus iheyensis HTE831; identical to SEQ ID NO: 13964

SEQ ID NO: 50400 - DNA, 1209 bp, Pseudomonas putida KT2440; identical to SEQ ID NO: 13965
  CDS (1)..(1209): transl_table=11

SEQ ID NO: 50401 - protein, 402 aa, Pseudomonas putida KT2440; identical to SEQ ID NO: 13966

SEQ ID NO: 50402 - DNA, 1305 bp, Bradyrhizobium japonicum USDA 110; identical to SEQ ID NO: 13967
  CDS (1)..(1305)

SEQ ID NO: 50403 - protein, 434 aa, Bradyrhizobium japonicum USDA 110; identical to SEQ ID NO: 13968

SEQ ID NO: 50404 - DNA, 1434 bp, Lactobacillus plantarum WCFS1; identical to SEQ ID NO: 13969
  CDS (1)..(1434): transl_table=11

SEQ ID NO: 50405 - protein, 477 aa, Lactobacillus plantarum WCFS1; identical to SEQ ID NO: 13970

SEQ ID NO: 50406 - DNA, 1203 bp, Salmonella enterica subsp. enterica serovar Typhi Ty2; identical to SEQ ID NO: 13971
  CDS (1)..(1203): transl_table=11

SEQ ID NO: 50407 - protein, 400 aa, Salmonella enterica subsp. enterica serovar Typhi Ty2; identical to SEQ ID NO: 13972

SEQ ID NO: 50408 - DNA, 1170 bp, Bacteroides thetaiotaomicron VPI-5482; identical to SEQ ID NO: 13973
  CDS (1)..(1170): transl_table=11

SEQ ID NO: 50409 - protein, 389 aa, Bacteroides thetaiotaomicron VPI-5482; identical to SEQ ID NO: 13974

SEQ ID NO: 50410 - DNA, 1407 bp, Coxiella burnetii RSA 493; identical to SEQ ID NO: 13975
  CDS (1)..(1407): transl_table=11

SEQ ID NO: 50411 - protein, 468 aa, Coxiella burnetii RSA 493; identical to SEQ ID NO: 13976

SEQ ID NO: 50412 - DNA, 1185 bp, Porphyromonas gingivalis W83; identical to SEQ ID NO: 13977
  CDS (1)..(1185): transl_table=11

SEQ ID NO: 50413 - protein, 394 aa, Porphyromonas gingivalis W83; identical to SEQ ID NO: 13978

SEQ ID NO: 50414 - DNA, 1608 bp, Oryza sativa (japonica cultivar-group); identical to SEQ ID NO: 13979
  CDS (1)..(1608)

SEQ ID NO: 50415 - protein, 535 aa, Oryza sativa (japonica cultivar-group); identical to SEQ ID NO: 13980

SEQ ID NO: 50416 - DNA, 1446 bp, Geobacter sulfurreducens PCA; identical to SEQ ID NO: 13981
  CDS (1)..(1446): transl_table=11

SEQ ID NO: 50417 - protein, 481 aa, Geobacter sulfurreducens PCA; identical to SEQ ID NO: 13982

SEQ ID NO: 50418 - DNA, 1437 bp, Treponema denticola ATCC 35405; identical to SEQ ID NO: 13983
  CDS (1)..(1437): transl_table=11

SEQ ID NO: 50419 - protein, 478 aa, Treponema denticola ATCC 35405; identical to SEQ ID NO: 13984

SEQ ID NO: 50420 - DNA, 1293 bp, Eremothecium gossypii; identical to SEQ ID NO: 13985
  CDS (1)..(1293)

SEQ ID NO: 50421 - protein, 430 aa, Eremothecium gossypii; identical to SEQ ID NO: 13986

SEQ ID NO: 50422 - DNA, 1434 bp, Neurospora crassa; identical to SEQ ID NO: 13987
  CDS (1)..(1434)

SEQ ID NO: 50423 - protein, 477 aa, Neurospora crassa; identical to SEQ ID NO: 13988

SEQ ID NO: 50424 - DNA, 5916 bp, Magnaporthe grisea 70-15; identical to SEQ ID NO: 13989
  CDS (1)..(5916)

SEQ ID NO: 50425 - protein, 1971 aa, Magnaporthe grisea 70-15; identical to SEQ ID NO: 13990

SEQ ID NO: 50426 - DNA, 1380 bp, Gibberella zeae PH-1; identical to SEQ ID NO: 13991
  CDS (1)..(1380)

SEQ ID NO: 50427 - protein, 459 aa, Gibberella zeae PH-1; identical to SEQ ID NO: 13992

SEQ ID NO: 50428 - DNA, 1839 bp, Ustilago maydis 521; identical to SEQ ID NO: 13993
  CDS (1)..(1839)

SEQ ID NO: 50429 - protein, 612 aa, Ustilago maydis 521; identical to SEQ ID NO: 13994

SEQ ID NO: 50430 - DNA, 1464 bp, Aspergillus nidulans FGSC A4; identical to SEQ ID NO: 13995
  CDS (1)..(1464)

SEQ ID NO: 50431 - protein, 487 aa, Aspergillus nidulans FGSC A4; identical to SEQ ID NO: 13996

SEQ ID NO: 50432 - DNA, 1296 bp, Candida glabrata CBS138; identical to SEQ ID NO: 13997
  CDS (1)..(1296)

SEQ ID NO: 50433 - protein, 431 aa, Candida glabrata CBS138; identical to SEQ ID NO: 13998

SEQ ID NO: 50434 - DNA, 1284 bp, Kluyveromyces lactis NRRL Y-1140; identical to SEQ ID NO: 13999
  CDS (1)..(1284)

SEQ ID NO: 50435 - protein, 427 aa, Kluyveromyces lactis NRRL Y-1140; identical to SEQ ID NO: 14000

SEQ ID NO: 50436 - DNA, 1269 bp, Debaryomyces hansenii CBS767; identical to SEQ ID NO: 14001
  CDS (1)..(1269)

SEQ ID NO: 50437 - protein, 422 aa, Debaryomyces hansenii CBS767; identical to SEQ ID NO: 14002

SEQ ID NO: 50438 - DNA, 1245 bp, Yarrowia lipolytica CLIB99; identical to SEQ ID NO: 14003
  CDS (1)..(1245)

SEQ ID NO: 50439 - protein, 414 aa, Yarrowia lipolytica CLIB99; identical to SEQ ID NO: 14004

SEQ ID NO: 50440 - DNA, 1362 bp, Cryptococcus neoformans var. neoformans JEC21; identical to SEQ ID NO: 14005
  CDS (1)..(1362)

SEQ ID NO: 50441 - protein, 453 aa, Cryptococcus neoformans var. neoformans JEC21; identical to SEQ ID NO: 14006

SEQ ID NO: 50442 - DNA, 1173 bp, Entamoeba histolytica HM-1:IMSS; identical to SEQ ID NO: 14007
  CDS (1)..(1173)

SEQ ID NO: 50443 - protein, 390 aa, Entamoeba histolytica HM-1:IMSS; identical to SEQ ID NO: 14008

SEQ ID NO: 50444 - DNA, 1266 bp, Candida albicans SC5314; identical to SEQ ID NO: 14009
  CDS (1)..(1266): transl_table=12

SEQ ID NO: 50445 - protein, 421 aa, Candida albicans SC5314; identical to SEQ ID NO: 14010

SEQ ID NO: 50446 - DNA, 1305 bp, Bartonella quintana str. Toulouse; identical to SEQ ID NO: 14011
  CDS (1)..(1305): transl_table=11

SEQ ID NO: 50447 - protein, 434 aa, Bartonella quintana str. Toulouse; identical to SEQ ID NO: 14012

SEQ ID NO: 50448 - DNA, 1305 bp, Bartonella henselae str. Houston-1; identical to SEQ ID NO: 14013
  CDS (1)..(1305): transl_table=11

SEQ ID NO: 50449 - protein, 434 aa, Bartonella henselae str. Houston-1; identical to SEQ ID NO: 14014

SEQ ID NO: 50450 - DNA, 1470 bp, Bacillus licheniformis ATCC 14580; identical to SEQ ID NO: 14015
  CDS (1)..(1470): transl_table=11

SEQ ID NO: 50451 - protein, 489 aa, Bacillus licheniformis ATCC 14580; identical to SEQ ID NO: 14016

SEQ ID NO: 50452 - DNA, 1167 bp, Bacteroides fragilis YCH46; identical to SEQ ID NO: 14017
  CDS (1)..(1167): transl_table=11

SEQ ID NO: 50453 - protein, 388 aa, Bacteroides fragilis YCH46; identical to SEQ ID NO: 14018

SEQ ID NO: 50454 - DNA, 1350 bp, Methylococcus capsulatus str. Bath; identical to SEQ ID NO: 14019
  CDS (1)..(1350): transl_table=11

SEQ ID NO: 50455 - protein, 449 aa, Methylococcus capsulatus str. Bath; identical to SEQ ID NO: 14020

SEQ ID NO: 50456 - DNA, 1317 bp, Nocardia farcinica IFM 10152; identical to SEQ ID NO: 14021
  CDS (1)..(1317): transl_table=11

SEQ ID NO: 50457 - protein, 438 aa, Nocardia farcinica IFM 10152; identical to SEQ ID NO: 14022

SEQ ID NO: 50458 - DNA, 1404 bp, Legionella pneumophila str. Paris; identical to SEQ ID NO: 14023
  CDS (1)..(1404): transl_table=11

SEQ ID NO: 50459 - protein, 467 aa, Legionella pneumophila str. Paris; identical to SEQ ID NO: 14024

SEQ ID NO: 50460 - DNA, 1404 bp, Legionella pneumophila str. Lens; identical to SEQ ID NO: 14025
  CDS (1)..(1404): transl_table=11

SEQ ID NO: 50461 - protein, 467 aa, Legionella pneumophila str. Lens; identical to SEQ ID NO: 14026

SEQ ID NO: 50462 - DNA, 1473 bp, Geobacillus kaustophilus HTA426; identical to SEQ ID NO: 14027
  CDS (1)..(1473): transl_table=11

SEQ ID NO: 50463 - protein, 490 aa, Geobacillus kaustophilus HTA426; identical to SEQ ID NO: 14028

SEQ ID NO: 50464 - DNA, 1347 bp, Idiomarina loihiensis L2TR; identical to SEQ ID NO: 14029
  CDS (1)..(1347): transl_table=11

SEQ ID NO: 50465 - protein, 448 aa, Idiomarina loihiensis L2TR; identical to SEQ ID NO: 14030

SEQ ID NO: 50466 - DNA, 1344 bp, Silicibacter pomeroyi DSS-3; identical to SEQ ID NO: 14031
  CDS (1)..(1344): transl_table=11

SEQ ID NO: 50467 - protein, 447 aa, Silicibacter pomeroyi DSS-3; identical to SEQ ID NO: 14032

SEQ ID NO: 50468 - DNA, 1260 bp, Neisseria gonorrhoeae FA 1090; identical to SEQ ID NO: 14033
  CDS (1)..(1260): transl_table=11

SEQ ID NO: 50469 - protein, 419 aa, Neisseria gonorrhoeae FA 1090; identical to SEQ ID NO: 14034

SEQ ID NO: 50470 - DNA, 1167 bp, Bacteroides fragilis NCTC 9343; identical to SEQ ID NO: 14035
  CDS (1)..(1167): transl_table=11

SEQ ID NO: 50471 - protein, 388 aa, Bacteroides fragilis NCTC 9343; identical to SEQ ID NO: 14036

SEQ ID NO: 50472 - DNA, 1251 bp, Salmonella enterica subsp. enterica serovar Choleraesuis str; identical to SEQ ID NO: 14037
  CDS (1)..(1251): transl_table=11

SEQ ID NO: 50473 - protein, 416 aa, Salmonella enterica subsp. enterica serovar Choleraesuis str; identical to SEQ ID NO: 14038

SEQ ID NO: 50474 - DNA, 1224 bp, Pseudomonas syringae pv. syringae B728a; identical to SEQ ID NO: 14039
  CDS (1)..(1224)

SEQ ID NO: 50475 - protein, 407 aa, Pseudomonas syringae pv. syringae B728a; identical to SEQ ID NO: 14040

SEQ ID NO: 50476 - DNA, 1326 bp, Corynebacterium jeikeium K411; identical to SEQ ID NO: 14041
  CDS (1)..(1326): transl_table=11

SEQ ID NO: 50477 - protein, 441 aa, Corynebacterium jeikeium K411; identical to SEQ ID NO: 14042

SEQ ID NO: 50478 - DNA, 1293 bp, Rhodobacter sphaeroides 2.4.1; identical to SEQ ID NO: 14043
  CDS (1)..(1293)

SEQ ID NO: 50479 - protein, 430 aa, Rhodobacter sphaeroides 2.4.1; identical to SEQ ID NO: 14044

SEQ ID NO: 50480 - DNA, 1134 bp, Xylella fastidiosa Ann-1; identical to SEQ ID NO: 14045
  CDS (1)..(1134)

SEQ ID NO: 50481 - protein, 377 aa, Xylella fastidiosa Ann-1; identical to SEQ ID NO: 14046

SEQ ID NO: 50482 - DNA, 1464 bp, Leuconostoc mesenteroides subsp. mesenteroides ATCC 8293; identical to SEQ ID NO: 14047
  CDS (1)..(1464)

SEQ ID NO: 50483 - protein, 487 aa, Leuconostoc mesenteroides subsp. mesenteroides ATCC 8293; identical to SEQ ID NO: 14048

SEQ ID NO: 50484 - DNA, 1242 bp, Psychrobacter sp. 273-4; identical to SEQ ID NO: 14049
  CDS (1)..(1242)

SEQ ID NO: 50485 - protein, 413 aa, Psychrobacter sp. 273-4; identical to SEQ ID NO: 14050

SEQ ID NO: 50486 - DNA, 1179 bp, Ralstonia eutropha JMP134; identical to SEQ ID NO: 14051
  CDS (1)..(1179)

SEQ ID NO: 50487 - protein, 392 aa, Ralstonia eutropha JMP134; identical to SEQ ID NO: 14052

SEQ ID NO: 50488 - DNA, 1200 bp, Burkholderia cepacia R18194; identical to SEQ ID NO: 14053
  CDS (1)..(1200)

SEQ ID NO: 50489 - protein, 399 aa, Burkholderia cepacia R18194; identical to SEQ ID NO: 14054

SEQ ID NO: 50490 - DNA, 1224 bp, Pseudomonas fluorescens PfO-1; identical to SEQ ID NO: 14055
  CDS (1)..(1224)

SEQ ID NO: 50491 - protein, 407 aa, Pseudomonas fluorescens PfO-1; identical to SEQ ID NO: 14056

SEQ ID NO: 50492 - DNA, 1197 bp, Burkholderia fungorum LB400; identical to SEQ ID NO: 14057
  CDS (1)..(1197)

SEQ ID NO: 50493 - protein, 398 aa, Burkholderia fungorum LB400; identical to SEQ ID NO: 14058

SEQ ID NO: 50494 - DNA, 1428 bp, Oenococcus oeni PSU-1; identical to SEQ ID NO: 14059
  CDS (1)..(1428)

SEQ ID NO: 50495 - protein, 475 aa, Oenococcus oeni PSU-1; identical to SEQ ID NO: 14060

SEQ ID NO: 50496 - DNA, 1380 bp, Trichodesmium erythraeum IMS101; identical to SEQ ID NO: 14061
  CDS (1)..(1380)

SEQ ID NO: 50497 - protein, 459 aa, Trichodesmium erythraeum IMS101; identical to SEQ ID NO: 14062

SEQ ID NO: 50498 - DNA, 1434 bp, Campylobacter upsaliensis RM3195; identical to SEQ ID NO: 14063
  CDS (1)..(1434): transl_table=11

SEQ ID NO: 50499 - protein, 477 aa, Campylobacter upsaliensis RM3195; identical to SEQ ID NO: 14064

SEQ ID NO: 50500 - DNA, 1488 bp, Lactococcus lactis subsp. cremoris SK11; identical to SEQ ID NO: 14065
  CDS (1)..(1488)

SEQ ID NO: 50501 - protein, 495 aa, Lactococcus lactis subsp. cremoris SK11; identical to SEQ ID NO: 14066

SEQ ID NO: 50502 - DNA, 1461 bp, Deinococcus geothermalis DSM 11300; identical to SEQ ID NO: 14067
  CDS (1)..(1461): transl_table=11

SEQ ID NO: 50503 - protein, 486 aa, Deinococcus geothermalis DSM 11300; identical to SEQ ID NO: 14068

SEQ ID NO: 50504 - DNA, 1359 bp, Azotobacter vinelandii AvOP; identical to SEQ ID NO: 14069
  CDS (1)..(1359): transl_table=11

SEQ ID NO: 50505 - protein, 452 aa, Azotobacter vinelandii AvOP; identical to SEQ ID NO: 14070

SEQ ID NO: 50506 - DNA, 1356 bp, Burkholderia vietnamiensis G4; identical to SEQ ID NO: 14071
  CDS (1)..(1356): transl_table=11

SEQ ID NO: 50507 - protein, 451 aa, Burkholderia vietnamiensis G4; identical to SEQ ID NO: 14072

SEQ ID NO: 50508 - DNA, 1200 bp, Burkholderia mallei 10229; identical to SEQ ID NO: 14073
  CDS (1)..(1200)

SEQ ID NO: 50509 - protein, 399 aa, Burkholderia mallei 10229; identical to SEQ ID NO: 14074

SEQ ID NO: 50510 - DNA, 1200 bp, Burkholderia cenocepacia AU 1054; identical to SEQ ID NO: 14075
  CDS (1)..(1200): transl_table=11

SEQ ID NO: 50511 - protein, 399 aa, Burkholderia cenocepacia AU 1054; identical to SEQ ID NO: 14076

SEQ ID NO: 50512 - DNA, 1356 bp, Burkholderia pseudomallei 1655; identical to SEQ ID NO: 14077
  CDS (1)..(1356)

SEQ ID NO: 50513 - protein, 451 aa, Burkholderia pseudomallei 1655; identical to SEQ ID NO: 14078

SEQ ID NO: 50514 - DNA, 1173 bp, Chromohalobacter salexigens DSM 3043; identical to SEQ ID NO: 14079
  CDS (1)..(1173): transl_table=11

SEQ ID NO: 50515 - protein, 390 aa, Chromohalobacter salexigens DSM 3043; identical to SEQ ID NO: 14080

SEQ ID NO: 50516 - DNA, 1356 bp, Burkholderia pseudomallei 668; identical to SEQ ID NO: 14081
  CDS (1)..(1356)

SEQ ID NO: 50517 - protein, 451 aa, Burkholderia pseudomallei 668; identical to SEQ ID NO: 14082

SEQ ID NO: 50518 - DNA, 1269 bp, Polaromonas sp. JS666; identical to SEQ ID NO: 14083
  CDS (1)..(1269): transl_table=11

SEQ ID NO: 50519 - protein, 422 aa, Polaromonas sp. JS666; identical to SEQ ID NO: 14084

SEQ ID NO: 50520 - DNA, 1341 bp, Crocosphaera watsonii WH 8501; identical to SEQ ID NO: 14085
  CDS (1)..(1341): transl_table=11

SEQ ID NO: 50521 - protein, 446 aa, Crocosphaera watsonii WH 8501; identical to SEQ ID NO: 14086

SEQ ID NO: 50522 - DNA, 1431 bp, Geobacter metallireducens GS-15; identical to SEQ ID NO: 14087
  CDS (1)..(1431): transl_table=11

SEQ ID NO: 50523 - protein, 476 aa, Geobacter metallireducens GS-15; identical to SEQ ID NO: 14088

SEQ ID NO: 50524 - DNA, 1206 bp, Methanosarcina barkeri str. fusaro; identical to SEQ ID NO: 14089
  CDS (1)..(1206): transl_table=11

SEQ ID NO: 50525 - protein, 401 aa, Methanosarcina barkeri str. fusaro; identical to SEQ ID NO: 14090

SEQ ID NO: 50526 - DNA, 1206 bp, Desulfuromonas acetoxidans DSM 684; identical to SEQ ID NO: 14091
  CDS (1)..(1206): transl_table=11

SEQ ID NO: 50527 - protein, 401 aa, Desulfuromonas acetoxidans DSM 684; identical to SEQ ID NO: 14092

SEQ ID NO: 50528 - DNA, 1293 bp, Jannaschia sp. CCS1; identical to SEQ ID NO: 14093
  CDS (1)..(1293): transl_table=11

SEQ ID NO: 50529 - protein, 430 aa, Jannaschia sp. CCS1; identical to SEQ ID NO: 14094

SEQ ID NO: 50530 - DNA, 1458 bp, Desulfitobacterium hafniense DCB-2; identical to SEQ ID NO: 14095
  CDS (1)..(1458): transl_table=11

SEQ ID NO: 50531 - protein, 485 aa, Desulfitobacterium hafniense DCB-2; identical to SEQ ID NO: 14096

SEQ ID NO: 50532 - DNA, 1218 bp, Methanococcoides burtonii DSM 6242; identical to SEQ ID NO: 14097
  CDS (1)..(1218): transl_table=11

SEQ ID NO: 50533 - protein, 405 aa, Methanococcoides burtonii DSM 6242; identical to SEQ ID NO: 14098

SEQ ID NO: 50534 - DNA, 1575 bp, Frankia sp. EAN1pec; identical to SEQ ID NO: 14099
  CDS (1)..(1575): transl_table=11

SEQ ID NO: 50535 - protein, 524 aa, Frankia sp. EAN1pec; identical to SEQ ID NO: 14100

SEQ ID NO: 50536 - DNA, 1200 bp, Ralstonia metallidurans CH34; identical to SEQ ID NO: 14101
  CDS (1)..(1200): transl_table=11

SEQ ID NO: 50537 - protein, 399 aa, Ralstonia metallidurans CH34; identical to SEQ ID NO: 14102

SEQ ID NO: 50538 - DNA, 1341 bp, Magnetococcus sp. MC-1; identical to SEQ ID NO: 14103
  CDS (1)..(1341): transl_table=11

SEQ ID NO: 50539 - protein, 446 aa, Magnetococcus sp. MC-1; identical to SEQ ID NO: 14104

SEQ ID NO: 50540 - DNA, 1305 bp, Mesorhizobium sp. BNC1; identical to SEQ ID NO: 14105
  CDS (1)..(1305): transl_table=11

SEQ ID NO: 50541 - protein, 434 aa, Mesorhizobium sp. BNC1; identical to SEQ ID NO: 14106

SEQ ID NO: 50542 - DNA, 1290 bp, Silicibacter sp. TM1040; identical to SEQ ID NO: 14107
  CDS (1)..(1290): transl_table=11

SEQ ID NO: 50543 - protein, 429 aa, Silicibacter sp. TM1040; identical to SEQ ID NO: 14108

SEQ ID NO: 50544 - DNA, 1305 bp, Nitrobacter hamburgensis X14; identical to SEQ ID NO: 14109
  CDS (1)..(1305): transl_table=11

SEQ ID NO: 50545 - protein, 434 aa, Nitrobacter hamburgensis X14; identical to SEQ ID NO: 14110

SEQ ID NO: 50546 - DNA, 1308 bp, Paracoccus denitrificans PD1222; identical to SEQ ID NO: 14111
  CDS (1)..(1308): transl_table=11

SEQ ID NO: 50547 - protein, 435 aa, Paracoccus denitrificans PD1222; identical to SEQ ID NO: 14112

SEQ ID NO: 50548 - DNA, 1230 bp, Pseudomonas fluorescens; identical to SEQ ID NO: 14113
  CDS (1)..(1230): transl_table=11

SEQ ID NO: 50549 - protein, 409 aa, Pseudomonas fluorescens; identical to SEQ ID NO: 14114

SEQ ID NO: 50550 - DNA, 1215 bp, Pseudomonas fluorescens; identical to SEQ ID NO: 14115
  CDS (1)..(1215): transl_table=11

SEQ ID NO: 50551 - protein, 404 aa, Pseudomonas fluorescens; identical to SEQ ID NO: 14116

SEQ ID NO: 50552 - DNA, 1443 bp, Staphylococcus haemolyticus; identical to SEQ ID NO: 14117
  CDS (1)..(1443): transl_table=11

SEQ ID NO: 50553 - protein, 480 aa, Staphylococcus haemolyticus; identical to SEQ ID NO: 14118

SEQ ID NO: 50554 - DNA, 1245 bp, Leishmania major; identical to SEQ ID NO: 14119
  CDS (1)..(1245)

SEQ ID NO: 50555 - protein, 414 aa, Leishmania major; identical to SEQ ID NO: 14120

SEQ ID NO: 50556 - DNA, 1380 bp, Gibberella moniliformis; identical to SEQ ID NO: 14121
  CDS (1)..(1380)

SEQ ID NO: 50557 - protein, 459 aa, Gibberella moniliformis; identical to SEQ ID NO: 14122

SEQ ID NO: 50558 - DNA, 1233 bp, Schizosaccharomyces pombe; identical to SEQ ID NO: 14123
  CDS (1)..(1233)

SEQ ID NO: 50559 - protein, 410 aa, Schizosaccharomyces pombe; identical to SEQ ID NO: 14124

SEQ ID NO: 50560 - DNA, 1290 bp, Saccharomyces cerevisiae; identical to SEQ ID NO: 14125
  CDS (1)..(1290)

SEQ ID NO: 50561 - protein, 429 aa, Saccharomyces cerevisiae; identical to SEQ ID NO: 14126

SEQ ID NO: 50562 - DNA, 1200 bp, Pseudomonas aeruginosa; identical to SEQ ID NO: 14127
  CDS (1)..(1200): transl_table=11

SEQ ID NO: 50563 - protein, 399 aa, Pseudomonas aeruginosa; identical to SEQ ID NO: 14128

SEQ ID NO: 50564 - DNA, 1197 bp, Pseudomonas aeruginosa; identical to SEQ ID NO: 14129
  CDS (1)..(1197): transl_table=11

SEQ ID NO: 50565 - protein, 398 aa, Pseudomonas aeruginosa; identical to SEQ ID NO: 14130

SEQ ID NO: 50566 - DNA, 1224 bp, Acinetobacter sp; identical to SEQ ID NO: 14131
  CDS (1)..(1224): transl_table=11

SEQ ID NO: 50567 - protein, 407 aa, Acinetobacter sp; identical to SEQ ID NO: 14132

SEQ ID NO: 50568 - DNA, 1218 bp, Bordetella pertussis; identical to SEQ ID NO: 14133
  CDS (1)..(1218): transl_table=11

SEQ ID NO: 50569 - protein, 405 aa, Bordetella pertussis; identical to SEQ ID NO: 14134

SEQ ID NO: 50570 - DNA, 1305 bp, Brucella melitensis; identical to SEQ ID NO: 14135
  CDS (1)..(1305): transl_table=11

SEQ ID NO: 50571 - protein, 434 aa, Brucella melitensis; identical to SEQ ID NO: 14136

SEQ ID NO: 50572 - DNA, 1305 bp, Brucella suis; identical to SEQ ID NO: 14137
  CDS (1)..(1305)

SEQ ID NO: 50573 - protein, 434 aa, Brucella suis; identical to SEQ ID NO: 14138

SEQ ID NO: 50574 - DNA, 1200 bp, Buchnera aphidicola; identical to SEQ ID NO: 14139
  CDS (1)..(1200): transl_table=11

SEQ ID NO: 50575 - protein, 399 aa, Buchnera aphidicola; identical to SEQ ID NO: 14140

SEQ ID NO: 50576 - DNA, 1197 bp, Buchnera aphidicola; identical to SEQ ID NO: 14141
  CDS (1)..(1197): transl_table=11

SEQ ID NO: 50577 - protein, 398 aa, Buchnera aphidicola; identical to SEQ ID NO: 14142

SEQ ID NO: 50578 - DNA, 1200 bp, Burkholderia mallei; identical to SEQ ID NO: 14143
  CDS (1)..(1200): transl_table=11

SEQ ID NO: 50579 - protein, 399 aa, Burkholderia mallei; identical to SEQ ID NO: 14144

SEQ ID NO: 50580 - DNA, 1209 bp, Chromobacterium violaceum; identical to SEQ ID NO: 14145
  CDS (1)..(1209): transl_table=11

SEQ ID NO: 50581 - protein, 402 aa, Chromobacterium violaceum; identical to SEQ ID NO: 14146

SEQ ID NO: 50582 - DNA, 1206 bp, Erwinia carotovora; identical to SEQ ID NO: 14147
  CDS (1)..(1206): transl_table=11

SEQ ID NO: 50583 - protein, 401 aa, Erwinia carotovora; identical to SEQ ID NO: 14148

SEQ ID NO: 50584 - DNA, 1215 bp, Methanosarcina acetivorans; identical to SEQ ID NO: 14149
  CDS (1)..(1215): transl_table=11

SEQ ID NO: 50585 - protein, 404 aa, Methanosarcina acetivorans; identical to SEQ ID NO: 14150

SEQ ID NO: 50586 - DNA, 1209 bp, Neisseria gonorrhoeae; identical to SEQ ID NO: 14151
  CDS (1)..(1209)

SEQ ID NO: 50587 - protein, 402 aa, Neisseria gonorrhoeae; identical to SEQ ID NO: 14152

SEQ ID NO: 50588 - DNA, 1209 bp, Neisseria meningitidis; identical to SEQ ID NO: 14153
  CDS (1)..(1209)

SEQ ID NO: 50589 - protein, 402 aa, Neisseria meningitidis; identical to SEQ ID NO: 14154

SEQ ID NO: 50590 - DNA, 1209 bp, Neisseria meningitidis; identical to SEQ ID NO: 14155
  CDS (1)..(1209): transl_table=11

SEQ ID NO: 50591 - protein, 402 aa, Neisseria meningitidis; identical to SEQ ID NO: 14156

SEQ ID NO: 50592 - DNA, 1215 bp, Photorhabdus luminescens; identical to SEQ ID NO: 14157
  CDS (1)..(1215): transl_table=11

SEQ ID NO: 50593 - protein, 404 aa, Photorhabdus luminescens; identical to SEQ ID NO: 14158

SEQ ID NO: 50594 - DNA, 1218 bp, Photobacterium profundum; identical to SEQ ID NO: 14159
  CDS (1)..(1218): transl_table=11

SEQ ID NO: 50595 - protein, 405 aa, Photobacterium profundum; identical to SEQ ID NO: 14160

SEQ ID NO: 50596 - DNA, 1170 bp, Ralstonia solanacearum; identical to SEQ ID NO: 14161
  CDS (1)..(1170)

SEQ ID NO: 50597 - protein, 389 aa, Ralstonia solanacearum; identical to SEQ ID NO: 14162

SEQ ID NO: 50598 - DNA, 1305 bp, Rhizobium loti; identical to SEQ ID NO: 14163
  CDS (1)..(1305): transl_table=11

SEQ ID NO: 50599 - protein, 434 aa, Rhizobium loti; identical to SEQ ID NO: 14164

SEQ ID NO: 50600 - DNA, 1305 bp, Rhizobium meliloti; identical to SEQ ID NO: 14165
  CDS (1)..(1305): transl_table=11

SEQ ID NO: 50601 - protein, 434 aa, Rhizobium meliloti; identical to SEQ ID NO: 14166

SEQ ID NO: 50602 - DNA, 1203 bp, Salmonella choleraesuis; identical to SEQ ID NO: 14167
  CDS (1)..(1203)

SEQ ID NO: 50603 - protein, 400 aa, Salmonella choleraesuis; identical to SEQ ID NO: 14168

SEQ ID NO: 50604 - DNA, 1203 bp, Salmonella paratyphi; identical to SEQ ID NO: 14169
  CDS (1)..(1203): transl_table=11

SEQ ID NO: 50605 - protein, 400 aa, Salmonella paratyphi; identical to SEQ ID NO: 14170

SEQ ID NO: 50606 - DNA, 1308 bp, Vibrio cholerae; identical to SEQ ID NO: 14171
  CDS (1)..(1308): transl_table=11

SEQ ID NO: 50607 - protein, 435 aa, Vibrio cholerae; identical to SEQ ID NO: 14172

SEQ ID NO: 50608 - DNA, 1311 bp, Vibrio parahaemolyticus; identical to SEQ ID NO: 14173
  CDS (1)..(1311): transl_table=11

SEQ ID NO: 50609 - protein, 436 aa, Vibrio parahaemolyticus; identical to SEQ ID NO: 14174

SEQ ID NO: 50610 - DNA, 1314 bp, Vibrio vulnificus; identical to SEQ ID NO: 14175
  CDS (1)..(1314): transl_table=11

SEQ ID NO: 50611 - protein, 437 aa, Vibrio vulnificus; identical to SEQ ID NO: 14176

SEQ ID NO: 50612 - DNA, 1314 bp, Vibrio vulnificus; identical to SEQ ID NO: 14177
  CDS (1)..(1314): transl_table=11

SEQ ID NO: 50613 - protein, 437 aa, Vibrio vulnificus; identical to SEQ ID NO: 14178

SEQ ID NO: 50614 - DNA, 1179 bp, Xanthomonas axonopodis; identical to SEQ ID NO: 14179
  CDS (1)..(1179): transl_table=11

SEQ ID NO: 50615 - protein, 392 aa, Xanthomonas axonopodis; identical to SEQ ID NO: 14180

SEQ ID NO: 50616 - DNA, 1197 bp, Xanthomonas campestris; identical to SEQ ID NO: 14181
  CDS (1)..(1197): transl_table=11

SEQ ID NO: 50617 - protein, 398 aa, Xanthomonas campestris; identical to SEQ ID NO: 14182

SEQ ID NO: 50618 - DNA, 1185 bp, Xylella fastidiosa; identical to SEQ ID NO: 14183
  CDS (1)..(1185): transl_table=11

SEQ ID NO: 50619 - protein, 394 aa, Xylella fastidiosa; identical to SEQ ID NO: 14184

SEQ ID NO: 50620 - DNA, 1185 bp, Xylella fastidiosa; identical to SEQ ID NO: 14185
  CDS (1)..(1185): transl_table=11

SEQ ID NO: 50621 - protein, 394 aa, Xylella fastidiosa; identical to SEQ ID NO: 14186

SEQ ID NO: 50622 - DNA, 24 bp, Artificial sequence
  (1)..(24): primer
atgacacaattcgcttctcctgtt

SEQ ID NO: 50623 - DNA, 26 bp, Artificial sequence
  (1)..(26): primer
ttaactggcttttttaatatgcggaa

SEQ ID NO: 50624 - protein, 581 aa, Artificial sequence; identical to SEQ ID NO: 14189
  Variant (3)..(3): xaa in position 3 is any amino acid
  Variant (20)..(22): xaa in position 20 to 22 is any amino acid
  Variant (23)..(24): xaa in position 23 to 24 is any or no amino acid
  Variant (27)..(29): xaa in position 27 to 29 is any amino acid
  Variant (31)..(31): xaa in position 31 is any amino acid
  Variant (33)..(33): xaa in position 33 is any amino acid
  Variant (35)..(36): xaa in position 35 to 36 is any amino acid
  Variant (38)..(42): xaa in position 38 to 42 is any amino acid
  Variant (43)..(53): xaa in position 43 to 53 is any or no amino acid
  Variant (56)..(57): xaa in position 56 to 57 is any amino acid
  Variant (60)..(60): xaa in position 60 is any amino acid
  Variant (62)..(63): xaa in position 62 to 63 is any amino acid
  Variant (68)..(68): xaa in position 68 is any amino acid
  Variant (72)..(72): xaa in position 72 is any amino acid
  Variant (75)..(76): xaa in position 75 to 76 is any amino acid
  Variant (78)..(78): xaa in position 78 is any amino acid
  Variant (80)..(88): xaa in position 80 to 88 is any or no amino acid
  Variant (95)..(96): xaa in position 95 to 96 is any amino acid
  Variant (100)..(103): xaa in position 100 to 103 is any amino acid
  Variant (105)..(105): xaa in position 105 is any amino acid
  Variant (107)..(109): xaa in position 107 to 109 is any amino acid
  Variant (110)..(126): xaa in position 110 to 126 is any or no amino acid
  Variant (128)..(128): xaa in position 128 is any or no amino acid
  Variant (130)..(130): xaa in position 130 is any or no amino acid
  Variant (132)..(132): xaa in position 132 is any or no amino acid
  Variant (134)..(134): xaa in position 134 is any or no amino acid
  Variant (136)..(137): xaa in position 136 to 137 is any amino acid
  Variant (138)..(138): xaa in position 138 is any or no amino acid
  Variant (153)..(154): xaa in position 153 to 154 is any amino acid
  Variant (156)..(156): xaa in position 156 is any amino acid
  Variant (158)..(161): xaa in position 158 to 161 is any amino acid
  Variant (162)..(162): xaa in position 162 is any or no amino acid
  Variant (164)..(172): xaa in position 164 to 172 is any amino acid
  Variant (174)..(176): xaa in position 174 to 176 is any amino acid
  Variant (178)..(183): xaa in position 178 to 183 is any amino acid
  Variant (184)..(198): xaa in position 184 to 198 is any or no amino acid
  Variant (208)..(208): xaa in position 208 is any amino acid
  Variant (210)..(212): xaa in position 210 to 212 is any amino acid
  Variant (214)..(215): xaa in position 214 to 215 is any amino acid
  Variant (218)..(218): xaa in position 218 is any amino acid
  Variant (221)..(222): xaa in position 221 to 222 is any amino acid
  Variant (224)..(224): xaa in position 224 is any amino acid
  Variant (225)..(236): xaa in position 225 to 236 is any or no amino acid
  Variant (238)..(238): xaa in position 238 is any or no amino acid
  Variant (244)..(245): xaa in position 244 to 245 is any amino acid
  Variant (250)..(250): xaa in position 250 is any amino acid
  Variant (252)..(252): xaa in position 252 is any amino acid
  Variant (263)..(263): xaa in position 263 is any amino acid
  Variant (265)..(266): xaa in position 265 to 266 is any amino acid
  Variant (269)..(270): xaa in position 269 to 270 is any amino acid
  Variant (271)..(288): xaa in position 271 to 288 is any or no amino acid
  Variant (290)..(291): xaa in position 290 to 291 is any amino acid
  Variant (294)..(295): xaa in position 294 to 295 is any amino acid
  Variant (298)..(299): xaa in position 298 to 299 is any amino acid
  Variant (302)..(303): xaa in position 302 to 303 is any amino acid
  Variant (305)..(305): xaa in position 305 is any amino acid
  Variant (306)..(316): xaa in position 306 to 316 is any or no amino acid
  Variant (318)..(318): xaa in position 318 is any amino acid
  Variant (326)..(329): xaa in position 326 to 329 is any amino acid
  Variant (334)..(334): xaa in position 334 is any amino acid
  Variant (337)..(337): xaa in position 337 is any amino acid
  Variant (338)..(391): xaa in position 338 to 391 is any or no amino acid
  Variant (394)..(394): xaa in position 394 is any amino acid
  Variant (397)..(397): xaa in position 397 is any amino acid
  Variant (401)..(401): xaa in position 401 is any amino acid
  Variant (407)..(408): xaa in position 407 to 408 is any amino acid
  Variant (416)..(416): xaa in position 416 is any amino acid
  Variant (418)..(418): xaa in position 418 is any amino acid
  Variant (419)..(427): xaa in position 419 to 427 is any or no amino acid
  Variant (430)..(430): xaa in position 430 is any amino acid
  Variant (433)..(442): xaa in position 433 to 442 is any or no amino acid
  Variant (453)..(453): xaa in position 453 is any amino acid
  Variant (455)..(455): xaa in position 455 is any amino acid
  Variant (457)..(457): xaa in position 457 is any amino acid
  Variant (459)..(459): xaa in position 459 is any amino acid
  Variant (461)..(466): xaa in position 461 to 466 is any amino acid
  Variant (468)..(474): xaa in position 468 to 474 is any or no amino acid
  Variant (484)..(484): xaa in position 484 is any amino acid
  Variant (489)..(491): xaa in position 489 to 491 is any amino acid
  Variant (492)..(531): xaa in position 492 to 531 is any or no amino acid
  Variant (541)..(542): xaa in position 541 to 542 is any amino acid
  Variant (545)..(545): xaa in position 545 is any amino acid
  Variant (553)..(553): xaa in position 553 is any amino acid
  Variant (557)..(557): xaa in position 557 is any amino acid
  Variant (559)..(560): xaa in position 559 to 560 is any amino acid
  Variant (561)..(575): xaa in position 561 to 575 is any or no amino acid
  Variant (578)..(579): xaa in position 578 to 579 is any amino acid

SEQ ID NO: 50625 - protein, 10 aa, Artificial sequence
  Variant (2)..(2): xaa in position 2 is any amino acid
  Variant (3)..(3): xaa in position 3 is Asn or Thr
  Variant (5)..(5): xaa in position 5 is any amino acid
  Variant (7)..(7): xaa in position 7 is any amino acid
  Variant (8)..(8): xaa in position 8 is Phe, Ile, Leu or Val
  Variant (9)..(9): xaa in position 9 is any amino acid
LXXDXYXXXM

SEQ ID NO: 50626 - protein, 25 aa, Artificial sequence
  Variant (2)..(4): xaa in position 2 to 4 is any or no amino acid
  Variant (8)..(10): xaa in position 8 to 10 is any amino acid
  Variant (11)..(11): xaa in position 11 is Ala or Gly
  Variant (12)..(14): xaa in position 12 to 14 is any amino acid
  Variant (15)..(15): xaa in position 15 is Ala, Asp, Glu, Gly, Asn, Gln or Ser
  Variant (16)..(19): xaa in position 16 to 19 is any amino acid
  Variant (22)..(22): xaa in position 22 is any amino acid
  Variant (25)..(25): xaa in position 25 is Ala, Glu, Gln or Ser
GXXXTSNXXXXXXXXXXXXGTXAHX

SEQ ID NO: 50627 - DNA, 291 bp, Escherichia coli K12; identical to SEQ ID NO: 18608
  CDS (1)..(291): transl_table=11

SEQ ID NO: 50628 - protein, 96 aa, Escherichia coli K12; identical to SEQ ID NO: 18609

SEQ ID NO: 50629 - DNA, 216 bp, Bacteriophage 933W; identical to SEQ ID NO: 18610
  CDS (1)..(216): transl_table=11

SEQ ID NO: 50630 - protein, 71 aa, Bacteriophage 933W; identical to SEQ ID NO: 18611

SEQ ID NO: 50631 - DNA, 291 bp, Bacteriophage VT2-Sa; identical to SEQ ID NO: 18612
  CDS (1)..(291): transl_table=11

SEQ ID NO: 50632 - protein, 96 aa, Bacteriophage VT2-Sa; identical to SEQ ID NO: 18613

SEQ ID NO: 50633 - DNA, 315 bp, Escherichia coli O157:H7 EDL933; identical to SEQ ID NO: 18614
  CDS (1)..(315): transl_table=11

SEQ ID NO: 50634 - protein, 104 aa, Escherichia coli O157:H7 EDL933; identical to SEQ ID NO: 18615

SEQ ID NO: 50635 - DNA, 315 bp, Escherichia coli O157:H7 EDL933; identical to SEQ ID NO: 18616
  CDS (1)..(315): transl_table=11

SEQ ID NO: 50636 - protein, 104 aa, Escherichia coli O157:H7 EDL933; identical to SEQ ID NO: 18617

SEQ ID NO: 50637 - DNA, 273 bp, Escherichia coli O157:H7 EDL933; identical to SEQ ID NO: 18618
  CDS (1)..(273): transl_table=11

SEQ ID NO: 50638 - protein, 90 aa, Escherichia coli O157:H7 EDL933; identical to SEQ ID NO: 18619

SEQ ID NO: 50639 - DNA, 216 bp, Escherichia coli O157:H7; identical to SEQ ID NO: 18620
  CDS (1)..(216): transl_table=11

SEQ ID NO: 50640 - protein, 71 aa, Escherichia coli O157:H7; identical to SEQ ID NO: 18621

SEQ ID NO: 50641 - DNA, 207 bp, Escherichia coli O157:H7; identical to SEQ ID NO: 18622
  CDS (1)..(207): transl_table=11

SEQ ID NO: 50642 - protein, 68 aa, Escherichia coli O157:H7; identical to SEQ ID NO: 18623

SEQ ID NO: 50643 - DNA, 216 bp, Escherichia coli O157:H7; identical to SEQ ID NO: 18624
  CDS (1)..(216): transl_table=11

SEQ ID NO: 50644 - protein, 71 aa, Escherichia coli O157:H7; identical to SEQ ID NO: 18625

SEQ ID NO: 50645 - DNA, 216 bp, Escherichia coli O157:H7; identical to SEQ ID NO: 18626
  CDS (1)..(216): transl_table=11

SEQ ID NO: 50646 - protein, 71 aa, Escherichia coli O157:H7; identical to SEQ ID NO: 18627

SEQ ID NO: 50647 - DNA, 216 bp, Escherichia coli O157:H7; identical to SEQ ID NO: 18628
  CDS (1)..(216): transl_table=11

SEQ ID NO: 50648 - protein, 71 aa, Escherichia coli O157:H7; identical to SEQ ID NO: 18629

SEQ ID NO: 50649 - DNA, 207 bp, Escherichia coli O157:H7; identical to SEQ ID NO: 18630
  CDS (1)..(207): transl_table=11

SEQ ID NO: 50650 - protein, 68 aa, Escherichia coli O157:H7; identical to SEQ ID NO: 18631

SEQ ID NO: 50651 - DNA, 207 bp, Escherichia coli O157:H7; identical to SEQ ID NO: 18632
  CDS (1)..(207): transl_table=11

SEQ ID NO: 50652 - protein, 68 aa, Escherichia coli O157:H7; identical to SEQ ID NO: 18633

SEQ ID NO: 50653 - DNA, 216 bp, Shigella flexneri 2a str. 301; identical to SEQ ID NO: 18634
  CDS (1)..(216): transl_table=11

SEQ ID NO: 50654 - protein, 71 aa, Shigella flexneri 2a str. 301; identical to SEQ ID NO: 18635

SEQ ID NO: 50655 - DNA, 216 bp, Shigella flexneri 2a str. 301; identical to SEQ ID NO: 18636
  CDS (1)..(216): transl_table=11

SEQ ID NO: 50656 - protein, 71 aa, Shigella flexneri 2a str. 301; identical to SEQ ID NO: 18637

SEQ ID NO: 50657 - DNA, 321 bp, Escherichia coli CFT073; identical to SEQ ID NO: 18638
  CDS (1)..(321): transl_table=11

SEQ ID NO: 50658 - protein, 106 aa, Escherichia coli CFT073; identical to SEQ ID NO: 18639

SEQ ID NO: 50659 - DNA, 216 bp, Escherichia coli CFT073; identical to SEQ ID NO: 18640
  CDS (1)..(216): transl_table=11

SEQ ID NO: 50660 - protein, 71 aa, Escherichia coli CFT073; identical to SEQ ID NO: 18641

SEQ ID NO: 50661 - DNA, 216 bp, Shigella flexneri 2a str. 2457T; identical to SEQ ID NO: 18642
  CDS (1)..(216): transl_table=11

SEQ ID NO: 50662 - protein, 71 aa, Shigella flexneri 2a str. 2457T; identical to SEQ ID NO: 18643

SEQ ID NO: 50663 - DNA, 180 bp, Shigella flexneri 2a str. 2457T; identical to SEQ ID NO: 18644
  CDS (1)..(180): transl_table=11

SEQ ID NO: 50664 - protein, 59 aa, Shigella flexneri 2a str. 2457T; identical to SEQ ID NO: 18645

SEQ ID NO: 50665 - DNA, 213 bp, Yersinia pseudotuberculosis IP 32953; identical to SEQ ID NO: 18646
  CDS (1)..(213): transl_table=11

SEQ ID NO: 50666 - protein, 70 aa, Yersinia pseudotuberculosis IP 32953; identical to SEQ ID NO: 18647

SEQ ID NO: 50667 - DNA, 216 bp, Shigella sonnei Ss046; identical to SEQ ID NO: 18648
  CDS (1)..(216): transl_table=11

SEQ ID NO: 50668 - protein, 71 aa, Shigella sonnei Ss046; identical to SEQ ID NO: 18649

SEQ ID NO: 50669 - DNA, 216 bp, Shigella sonnei Ss046; identical to SEQ ID NO: 18650
  CDS (1)..(216): transl_table=11

SEQ ID NO: 50670 - protein, 71 aa, Shigella sonnei Ss046; identical to SEQ ID NO: 18651

SEQ ID NO: 50671 - DNA, 207 bp, Bacteriophage H19B; identical to SEQ ID NO: 18652
  CDS (1)..(207): transl_table=11

SEQ ID NO: 50672 - protein, 68 aa, Bacteriophage H19B; identical to SEQ ID NO: 18653

SEQ ID NO: 50673 - DNA, 291 bp, Stx1; identical to SEQ ID NO: 18654
  CDS (1)..(291): transl_table=11

SEQ ID NO: 50674 - protein, 96 aa, Stx1; identical to SEQ ID NO: 18655

SEQ ID NO: 50675 - DNA, 150 bp, Escherichia coli; identical to SEQ ID NO: 18656
  CDS (1)..(150): transl_table=11

SEQ ID NO: 50676 - protein, 49 aa, Escherichia coli; identical to SEQ ID NO: 18657

SEQ ID NO: 50677 - DNA, 216 bp, Escherichia coli; identical to SEQ ID NO: 18658
  CDS (1)..(216): transl_table=11

SEQ ID NO: 50678 - protein, 71 aa, Escherichia coli; identical to SEQ ID NO: 18659

SEQ ID NO: 50679 - DNA, 216 bp, Shigella dysenteriae; identical to SEQ ID NO: 18660
  CDS (1)..(216): transl_table=11

SEQ ID NO: 50680 - protein, 71 aa, Shigella dysenteriae; identical to SEQ ID NO: 18661

SEQ ID NO: 50681 - DNA, 216 bp, Escherichia coli O6; identical to SEQ ID NO: 18662
  CDS (1)..(216): transl_table=11

SEQ ID NO: 50682 - protein, 71 aa, Escherichia coli O6; identical to SEQ ID NO: 18663

SEQ ID NO: 50683 - DNA, 216 bp, Bacteriophage P21; identical to SEQ ID NO: 18664
  CDS (1)..(216): transl_table=11

SEQ ID NO: 50684 - protein, 71 aa, Bacteriophage P21; identical to SEQ ID NO: 18665

SEQ ID NO: 50685 - DNA, 24 bp, Artificial sequence
  (1)..(24): primer
atgctgtcaaaactaccccgtaga

SEQ ID NO: 50686 - DNA, 23 bp, Artificial sequence
  (1)..(23): primer
ttactctcctctcgcagccttac

SEQ ID NO: 50687 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 50688 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 50689 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 50690 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 50691 - DNA, 360 bp, Escherichia coli
  CDS (1)..(360)
atgctgcaaatcccacagaattatattcatacgcgctcaacgcctttctggaataaacaaactgcgcctgccggaatattcgaacgtcatcttgataaaggaacgcgcccgggggtttacccacgcctttccgttatgcatggggcggtcaaatatctcggctacgctgatgaacacagtgcagagcctgatcaggtgatccttatcgaagcggggcagtttgcggtgttccctccagaaaagtggcacaacattgaagccatgactgacgatacttatttcaacattgacttcttcgtggctcctgaagtcctgatggaaggtgcgcaacaacggaaagtcattcataacgggaaatga

SEQ ID NO: 50692 - protein, 119 aa, Escherichia coli
MLQIPQNYIHTRSTPFWNKQTAPAGIFERHLDKGTRPGVYPRLSVMHGAVKYLGYADEHSAEPDQVILIEAGQFAVFPPEKWHNIEAMTDDTYFNIDFFVAPEVLMEGAQQRKVIHNGK

SEQ ID NO: 50693 - DNA, 861 bp, Streptococcus pneumoniae TIGR4
  CDS (1)..(861): transl_table=11
atggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttggcctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaa

SEQ ID NO: 50694 - protein, 286 aa, Streptococcus pneumoniae TIGR4
MEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGRNSLFLAQQDFDVTAVDQNGLALEILQSIVEQEDLDMPVGLYDINSASIEQEYDFIVSTVVLMFLQADRIPAIIQNMQEKTSVGGYNLIVCAMDTEDYPCSVNFPFTFKEGELADYYKDWELVKYNENPGHLHRRDENGNRIQLRFATLLAKKIK

SEQ ID NO: 50695 - DNA, 867 bp, Streptococcus pneumoniae R6
  CDS (1)..(867): transl_table=11
ttgaaaatggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttggcctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaa

SEQ ID NO: 50696 - protein, 288 aa, Streptococcus pneumoniae R6
MKMEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGRNSLFLAQQDFDVTAVDQNGLALEILQSIVEQEDLDMPVGLYDINSASIEQEYDFIVSTVVLMFLQADRIPAIIQNMQEKTSVGGYNLIVCAMDTEDYPCSVNFPFTFKEGELADYYKDWELVKYNENPGHLHRRDENGNRIQLRFATLLAKKIK

SEQ ID NO: 50697 - DNA, 363 bp, Salmonella typhimurium LT2
  CDS (1)..(363): transl_table=11
atgcggcaaattccacaaaatcatattcatacacgttccacgccattctggaacaaagagacggcgcctgccggaattttcgaacgccaccttgataagggaacgcgacccgacgtttatcctcgtctctcggtgatgcagggggcggtcaaatatctcggatacgctgatgaacattgctctgagccggaagagatcatggtgatcaatgccggcgagtttggcgtgtttcctccggaaaagtggcacaatattgaggtcatgacggatgatacctattttaacatcgacttttttgtcgcgccggaagtactgatggaaggggcgacctcacgaaaagtcattcatgccgggagagaataa

SEQ ID NO: 50698 - protein, 120 aa, Salmonella typhimurium LT2
MRQIPQNHIHTRSTPFWNKETAPAGIFERHLDKGTRPDVYPRLSVMQGAVKYLGYADEHCSEPEEIMVINAGEFGVFPPEKWHNIEVMTDDTYFNIDFFVAPEVLMEGATSRKVIHAGRE

SEQ ID NO: 50699 - DNA, 333 bp, Vibrio vulnificus CMCP6
  CDS (1)..(333): transl_table=11
atgcgcattccaaaagagtggacgattcaacgctccaccccattttttaccaaacaaaccgtgccagcagcgctgctgacacaccacaataccgcgcaaggggtatttggccagctgtgcgtgatggaagggacggtcacgtactatggttttgccaacgaagaggcaacggaagcagagcaagtggtggtgatcaccgcggggcagtttgcgaccagtccgccacaatattggcatcgtatcgagatgagcgacgatgcgcagttcaatatcaacttctggtcggatcgtgataaacgaagtgaggtgatgttccacgcgaaaacggagtga

SEQ ID NO: 50700 - protein, 110 aa, Vibrio vulnificus CMCP6
MRIPKEWTIQRSTPFFTKQTVPAALLTHHNTAQGVFGQLCVMEGTVTYYGFANEEATEAEQVVVITAGQFATSPPQYWHRIEMSDDAQFNINFWSDRDKRSEVMFHAKTE

SEQ ID NO: 50701 - DNA, 342 bp, Salmonella enterica subsp. enterica serovar Typhi Ty2
  CDS (1)..(342): transl_table=11
atgtcccacttacgcatcccggcaaactggaaagttaaacgctctacccccttttacaccaaagagaatgttccggcggcactgctctctcatcacaacacagcggcaggcgttttcggacaactctgcgtgatggaaggcaccgtgacctactatggctttgcgaatgaaaccgcgacagaaccagaagtgaaagtggtgattaatgccgggcaattcgccaccagtccgccgcaatactggcatcgggtagagctgagcgatgatgcgcggttcaacattcatttttgggtagaggaagaccatcagggcgaggaaatgtatcaacagaaaaaagcctga

SEQ ID NO: 50702 - protein, 113 aa, Salmonella enterica subsp. enterica serovar Typhi Ty2
MSHLRIPANWKVKRSTPFYTKENVPAALLSHHNTAAGVFGQLCVMEGTVTYYGFANETATEPEVKVVINAGQFATSPPQYWHRVELSDDARFNIHFWVEEDHQGEEMYQQKKA

SEQ ID NO: 50703 - DNA, 342 bp, Vibrio vulnificus YJ016
  CDS (1)..(342): transl_table=11
atgtcacatatgcgcattccaaaagagtggacgattcaacgctccaccccattttttaccaaacaaaccgtgccagcagcgctgctgacacaccacaataccgcgcaaggggtctttggccagctgtgcgtgatggaagggacggtcacgtactatggttttgccaacgaagaggctacggaagcagagcaagtggtggtgatcaccgcggggcagtttgcgaccagtccgccacaatattggcatcgtatcgagatgagcgacgatgcgcagttcaacatcaacttctggtcggatcgtgataaacgaaatgaggtgatgttccacgcgaaaacggagtga

SEQ ID NO: 50704 - protein, 113 aa, Vibrio vulnificus YJ016
MSHMRIPKEWTIQRSTPFFTKQTVPAALLTHHNTAQGVFGQLCVMEGTVTYYGFANEEATEAEQVVVITAGQFATSPPQYWHRIEMSDDAQFNINFWSDRDKRNEVMFHAKTE

SEQ ID NO: 50705 - DNA, 861 bp, Erwinia carotovora subsp. atroseptica SCRI1043
  CDS (1)..(861): transl_table=11
atgcaagatctcatttgttataagaagatgccacagtggaacagccagacgctacctgccgcgtttcaggaaaagcacaacacacaagaaggcacttgggcaaaactgaccgtgttgaaaggggaaatgaccttttccatgctgaccgaagatggcgatacgctggagacgttccacttctctgagcaaaatcagccgccgtttgtggagccgcaggcgtggcatcgcatcgtctcgttctctgacgatctggaatgtcagcttagctttttctgttcggcggaagatttctaccataaaaaatacggtctgacgcaaacccattccgaagtgatcaacgcagtacagcacattaagccgggcaaaacgctggatttaggctgcggtggcgggcgcaactcgctgtatctaaacctgcgcgggtttgacgtaactgcctgtgacaagcacgagcaaagcattgattcgctgaataacatcatccagagcgaagcactggaaaacatccgggcgggcgtttacaacatcaatctggcagaaatcaaagagcagtacgatttcatcctgtcgaccgttgtgctgatgttcctagaacgtgaccgtattccgcacatcatcagtaatatgcaaggcagcaccgttgacggtggctataaccttattatcgcagcgatgtcgacggaagattgtccgtgcccgatgcccttctcgtttacctttaaagaagacgagttgaagaactattacgccgattgggagatcctcaaatataacgaggatatgggcgaactacacaagacagatgcacagggtaatcgcatcaagctgcgtttcgctacgctgctggcaagaaagccctaa

SEQ ID NO: 50706 - protein, 286 aa, Erwinia carotovora subsp. atroseptica SCRI1043
MQDLICYKKMPQWNSQTLPAAFQEKHNTQEGTWAKLTVLKGEMTFSMLTEDGDTLETFHFSEQNQPPFVEPQAWHRIVSFSDDLECQLSFFCSAEDFYHKKYGLTQTHSEVINAVQHIKPGKTLDLGCGGGRNSLYLNLRGFDVTACDKHEQSIDSLNNIIQSEALENIRAGVYNINLAEIKEQYDFILSTVVLMFLERDRIPHIISNMQGSTVDGGYNLIIAAMSTEDCPCPMPFSFTFKEDELKNYYADWEILKYNEDMGELHKTDAQGNRIKLRFATLLARKP

SEQ ID NO: 50707 - DNA, 333 bp, Erwinia carotovora subsp. atroseptica SCRI1043
  CDS (1)..(333): transl_table=11
atggaacgaattgtcatgccagcgaattatgttcatacccgtacaacaccgttttggacaaaggagactgctcccgcgtctatctggcggcgccatttggatgcaggaacaagacaaggtgtttacccgcgtttgtgcgtgatgcaagggacaattcgttattacggttatgccgatgaaaccagtcctgagccagtcgaaacgctgaccattgaagcaggacaatttggcgtattccctccagagaaatggcacagaattgaagcgttatctgatgatacgttattcaacgtagatttttatgtcgatccaaaaattctgatagaaggttga

SEQ ID NO: 50708 - protein, 110 aa, Erwinia carotovora subsp. atroseptica SCRI1043
MERIVMPANYVHTRTTPFWTKETAPASIWRRHLDAGTRQGVYPRLCVMQGTIRYYGYADETSPEPVETLTIEAGQFGVFPPEKWHRIEALSDDTLFNVDFYVDPKILIEG

SEQ ID NO: 50709 - DNA, 864 bp, Mannheimia succiniciproducens MBEL55E
  CDS (1)..(864): transl_table=11
atgaaatccgagcttatttgctataaaaaaatgcctgtgtggaacaaaaattcactgccgaaaatgtttcaggaaaaacacaataccaaagcaggcacttggggaaaattaacggttttacaaggtaaattaaaattctatacgctgaatgaagacggctctatagtaaacgaacatattttctccgctaatacggataccccttttgttgagccgcaacaatggcacaaagttgaagcgctttccgacgatttagaatgctatttggaattttattgcacaaaagaagattatttcggcaaaaaatataatatgacggcaacccacagcgatgtactgaaaaccgctaaaataattacaccctgtaaagtgctggatttaggttgcggtcacggacgaaattcgctttatttggcactgaaaggctatgatgtgacatcttgggatcataatgcagccagtattgcctttttagccgatagcgccgcgaaagaaaatctgcaaattcagaccgcagtttacgatataaacaatgcaaatattcaagaaaattatgatcttattctctctacggtggtatttatgtttttagaccgggaagccgtaccagcgattattgataatatgcaaaaacacacgaatgcgggtggttataatttaattgttgcggcgatgtccactgaggatatgccttgcccgattcctttcgcttttacttttggcgaaaacgaattgaaaaattattatcagggctgggagtttgtggaatataacgaaaacataggtgaattacacaaaaccgataaaaacggcaatcgttataaaatgaagtttgtgaccatgttggcgaagaaagttaaataa

SEQ ID NO: 50710 - protein, 287 aa, Mannheimia succiniciproducens MBEL55E
MKSELICYKKMPVWNKNSLPKMFQEKHNTKAGTWGKLTVLQGKLKFYTLNEDGSIVNEHIFSANTDTPFVEPQQWHKVEALSDDLECYLEFYCTKEDYFGKKYNMTATHSDVLKTAKIITPCKVLDLGCGHGRNSLYLALKGYDVTSWDHNAASIAFLADSAAKENLQIQTAVYDINNANIQENYDLILSTVVFMFLDREAVPAIIDNMQKHTNAGGYNLIVAAMSTEDMPCPIPFAFTFGENELKNYYQGWEFVEYNENIGELHKTDKNGNRYKMKFVTMLAKKVK

SEQ ID NO: 50711 - DNA, 339 bp, Photobacterium profundum SS9
  CDS (1)..(339): transl_table=11
atgagccacttacgaattccgaataattggaaaatacaacgttcgactcctttctttaccaaagataatgtaccagccgctttgctctctcatcacaatacagctgaaggtgttttcggtcagctttgtgtaatggaaggcactgtcacatattatggttttgcggatgagaatgcgacagagccagaagccatcattgtcattaacgctgggcagtttgcgaccagccctcctgaatactggcatcgtgtcgaattatctgaggatgcccaattcaacattaatttttggtcagacaaagataaaaccgatcaagtgttatttaatgcaaagaagtag

SEQ ID NO: 50712 - protein, 112 aa, Photobacterium profundum SS9
MSHLRIPNNWKIQRSTPFFTKDNVPAALLSHHNTAEGVFGQLCVMEGTVTYYGFADENATEPEAIIVINAGQFATSPPEYWHRVELSEDAQFNINFWSDKDKTDQVLFNAKK

SEQ ID NO: 50713 - DNA, 342 bp, Salmonella enterica subsp. enterica serovar Paratyphi A str. ATCC
  CDS (1)..(342): transl_table=11
atgtcccacttacgcatcccggcaaactggaaagttaaacgctctaccccctttttcaccaaagaaaatgttccggcggcactgctctctcatcacaacacagcggcaggcgttttcggacaactctgcgtgatggaaggcaccgtgacctactatggctttgcgaatgaaaccgcgacagaaccagaagtgaaagtggtaattaatgccgggcaattcgccaccagtccgccgcaatactggcatcgggtagagctgagcgatgatgcgcggttcaacatccatttttgggtagaggaagaccatcagggcgaggaaatgtatcaacagaaaaaagcctga

SEQ ID NO: 50714 - protein, 113 aa, Salmonella enterica subsp. enterica serovar Paratyphi A str. ATCC
MSHLRIPANWKVKRSTPFFTKENVPAALLSHHNTAAGVFGQLCVMEGTVTYYGFANETATEPEVKVVINAGQFATSPPQYWHRVELSDDARFNIHFWVEEDHQGEEMYQQKKA

SEQ ID NO: 50715 - DNA, 363 bp, Salmonella enterica subsp. enterica serovar Paratyphi A str. ATCC
  CDS (1)..(363): transl_table=11
atgcggcaaattccacaaaatcatattcatacacgttccacgccattctggaacaaagagacggcgcctgccggaattttcgaacgccaccttgataagggaacgcgacccggcgtttatcctcgcctctcggtgatgcagggggcggtcaaatatctcggatacgctgatgaacattgctctgagccggaagagatcatggtgatcaatgccggcgagtttggcgtgtttcctccggaaaagtggcacaatattgaggtcatgacggatgatacctattttaacatcgacttttttgtcgcgccggaagtactgatggaaggggcgacctcacgaaaagtcattcatgccgggagagaataa

SEQ ID NO: 50716 - protein, 120 aa, Salmonella enterica subsp. enterica serovar Paratyphi A str. ATCC
MRQIPQNHIHTRSTPFWNKETAPAGIFERHLDKGTRPGVYPRLSVMQGAVKYLGYADEHCSEPEEIMVINAGEFGVFPPEKWHNIEVMTDDTYFNIDFFVAPEVLMEGATSRKVIHAGRE

SEQ ID NO: 50717 - DNA, 336 bp, Vibrio fischeri ES114
  CDS (1)..(336): transl_table=11
atgagtcatttacgtatcccaaaaaattggacaattcaacgttcaacgccattctttactaaagataatgtacctgaggcactactaactcatcataatacagctgtagatgtattcggacagatctgtgttatggaaggggttgtcacttattatggatttgcaaattcagaagcaacagaacctgagattaaagttgttattaatgcaggacagtttgctacaagcccacctcaatattggcatcgtattgagttaagtgacgatgctcaattcaatattaatttttggtctgatcaagataaaagcggtaaaaaaatgttcaatacgaaatag

SEQ ID NO: 50718 - protein, 111 aa, Vibrio fischeri ES114
MSHLRIPKNWTIQRSTPFFTKDNVPEALLTHHNTAVDVFGQICVMEGVVTYYGFANSEATEPEIKVVINAGQFATSPPQYWHRIELSDDAQFNINFWSDQDKSGKKMFNTK

SEQ ID NO: 50719 - DNA, 861 bp, Haemophilus influenzae 86-028NP
  CDS (1)..(861): transl_table=11
atgaaaaacgaattaatctgctataaacaaatgccagtgtggacaaaagacaaattgccacaaatgttccaagaaaagcacaacacaaaagtcggcacttggggaaaattaaccgtattaaaaggtaagcttaaattttatgagctaacagaaaatggcgatgttattgccgagcatatttttaccccagaaagccacattccttttgttgaacctcaagcatggcatcgtgttgaagctctttctgatgacctagaatgtaccctaggtttctattgcaaaaaagaagattatttcagtaaaaaatacaacatgactgccattcacggcgatgtggtggatgcagcaaaaattatctcgccttgtaaagtattagatttaggttgcggacaagggcgtaattcactttatttaagtttattaggctatgatgtaacctcttgggatcacaatgaaaacagcattgcctttttaaatgaaaccaaagagaaagaaaaccttaatatttctaccgcactttacgacattaacgccgccaacattcaagaaaactatgattttattgtttcaacggtggtgtttatgttcttaaatcgtgaacgtgtgccgtcaatcatcaaaaatatgcaagaacataccaatgttggcggatataatttaatcgttgccgcaatgtccacagatgatgtgccttgcccacttccattctcattcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaataa

SEQ ID NO: 50720 - protein, 286 aa, Haemophilus influenzae 86-028NP
MKNELICYKQMPVWTKDKLPQMFQEKHNTKVGTWGKLTVLKGKLKFYELTENGDVIAEHIFTPESHIPFVEPQAWHRVEALSDDLECTLGFYCKKEDYFSKKYNMTAIHGDVVDAAKIISPCKVLDLGCGQGRNSLYLSLLGYDVTSWDHNENSIAFLNETKEKENLNISTALYDINAANIQENYDFIVSTVVFMFLNRERVPSIIKNMQEHTNVGGYNLIVAAMSTDDVPCPLPFSFTFAENELKEYYKDWEFLEYNENMGELHKTDENGNRIKMKFATMLARKK

SEQ ID NO: 50721 - DNA, 873 bp, Actinobacillus pleuropneumoniae serovar 1 str. 4074
  CDS (1)..(873)
atgcaaaacttaatttgctataaacaaatgccggtttggaccaaagacagcctgccacaaatgttccaagaaaaacacaatactaaggaaggtacttgggcaaaactgactatacttaaaggcgaattaaaattttatgaattgaccgaacaaggcgaagaagtcaatagcgtgatttttacccctgaaaatcagccgccgtttgtcgagccgcaactttggcataaagtcgaagcgctgtccgatgatttggaatgtcagctcgcattctattgcgaagcgaaagattactatgcgaaaaaatataatctcaccacgactcattccgaagtgttaaatgcggttaattatgtaaaaggtggtaaagcgttggatttaggttgcggacgcggacgcaattcgctctatctgaatttattaggttttgatgtaacggcggttgatcataatgtcgagagtatcgaattcttaaactatatgattgagaaagagaatctgcaaaatatcgaaaccggtgtttatgatattaaccaagccactatcggcagccaaagcggtgaatatgatctaattatttctacggttgtgatgatgttcttaaaccgtgaacgcattccggcaattattgaaaatatgcagaaaaacaccaaggtcggcggctataacttaattgtgtgtgcgatgagtaccgaagaatatccgtgtccgatgccgttctcatttaccttcggcgagcgagaattagcgaactattaccaaggttgggaattagtgaagtacaatgaagatttgggtgaattgcataaaaccgatgcgaacggcaaccgtattaaaatgcgtttcgcaaccatgttagccaagaaaacagcgtaa

SEQ ID NO: 50722 - protein, 290 aa, Actinobacillus pleuropneumoniae serovar 1 str. 4074
MQNLICYKQMPVWTKDSLPQMFQEKHNTKEGTWAKLTILKGELKFYELTEQGEEVNSVIFTPENQPPFVEPQLWHKVEALSDDLECQLAFYCEAKDYYAKKYNLTTTHSEVLNAVNYVKGGKALDLGCGRGRNSLYLNLLGFDVTAVDHNVESIEFLNYMIEKENLQNIETGVYDINQATIGSQSGEYDLIISTVVMMFLNRERIPAIIENMQKNTKVGGYNLIVCAMSTEEYPCPMPFSFTFGERELANYYQGWELVKYNEDLGELHKTDANGNRIKMRFATMLAKKTA

SEQ ID NO: 50723 - DNA, 861 bp, Haemophilus influenzae R2866
  CDS (1)..(861)
atgaaaaacgaattaatttgctataaacaaatgccagtgtggacaaaagacaacttgccacaaatgttccaagaaaagcacaatacaaaagtcggcacttggggaaaattaactgtattaaaaggcaaactcaaattttatgagctaaccgaaaatggcgatgttattgccgagcatatttttaccccagaaagcgagattccttttgtcgaacctcaagcatggcatcgtgtagaagcactttctgatgatttagaatgtaccctaggtttctattgcaaaaaagaagattatttcagtaaaaaatacaacatgactgccattcacggcgatgtggtggatgcagcaaaaattatctcgccttgtaaagtattagatttaggttgcggacaagggcgtaattcactttatttaagtttattaggctatgatgtaacctcttgggatcacaatgaaaacagcattgcctttttaaatgaaaccaaagagaaagaaaaccttaatatttctaccgcactttacgacattaacgccgccaacattcaagaaaactatgattttattgtttcaacggtggtgtttatgttcttaaatcgtgaacgtgtgccgtcaatcattaaaaatatgcaagaacataccaatgttggcggatataacttaatcgttgctgcaatatccactgatgatgtgccttgcccacttccattctctttcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaataa

SEQ ID NO: 50724 - protein, 286 aa, Haemophilus influenzae R2866
MKNELICYKQMPVWTKDNLPQMFQEKHNTKVGTWGKLTVLKGKLKFYELTENGDVIAEHIFTPESEIPFVEPQAWHRVEALSDDLECTLGFYCKKEDYFSKKYNMTAIHGDVVDAAKIISPCKVLDLGCGQGRNSLYLSLLGYDVTSWDHNENSIAFLNETKEKENLNISTALYDINAANIQENYDFIVSTVVFMFLNRERVPSIIKNMQEHTNVGGYNLIVAAISTDDVPCPLPFSFTFAENELKEYYKDWEFLEYNENMGELHKTDENGNRIKMKFATMLARKK

SEQ ID NO: 50725 - DNA, 411 bp, Streptococcus pneumoniae TIGR4
  CDS (1)..(411)
atggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcagggcgtaattctctttttctag

SEQ ID NO: 50726 - protein, 136 aa, Streptococcus pneumoniae TIGR4
MEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGVILFF

SEQ ID NO: 50727 - DNA, 339 bp, Shewanella baltica OS155
  CDS (1)..(339): transl_table=11
atggccttagtccctaaagattttgttaattataaatcaacgccggttttcagccgtgacaacgtccctaaaatgttgttgcacatgcacaatactaaggctggcgtgtatgggcagatccaagtgctaacgggcagcttaaagttctatggctttacgggcagcagaggcgagttaggtaaagagatcatcattcgcgccggtgaaacggccatttctcatcccgagtattggcacaaagtggagctactgactgaagatacccagttcagactccatttttatgcccataaagattccgccatagcggcacagcagcaatccgagcgaagtgaatag

SEQ ID NO: 50728 - protein, 112 aa, Shewanella baltica OS155
MALVPKDFVNYKSTPVFSRDNVPKMLLHMHNTKAGVYGQIQVLTGSLKFYGFTGSRGELGKEIIIRAGETAISHPEYWHKVELLTEDTQFRLHFYAHKDSAIAAQQQSERSE

SEQ ID NO: 50729 - DNA, 423 bp, Shewanella amazonensis SB2B
  CDS (1)..(423): transl_table=11
atggcattgataccgaaaaattatgttccagtgggttccacccggatattcggcggtaatgatatacctgaaatgctgttgtcgcagcatcgtacccgaaatggcttttacagccagattgaggtcattgaaggtgagctcttatggcaaggttttggcgacacagatggcaagcccggtattgaggtgcacctgcgcgccaacgacagggccatgacccaccccggcaagtgttacagcgtgaagctgctcagcgatgagacccgtttcagactcaatgtgtttgcccatcaaagcctgcaggaaagcaatgtcgatgtcagcagcacagtggggctctttctcgaaccccttgctccggacctgacgcctgtggctaaacagactgaggatactgattgcgaacttcaggcagatcgctga

SEQ ID NO: 50730 - protein, 140 aa, Shewanella amazonensis SB2B
MALIPKNYVPVGSTRIFGGNDIPEMLLSQHRTRNGFYSQIEVIEGELLWQGFGDTDGKPGIEVHLRANDRAMTHPGKCYSVKLLSDETRFRLNVFAHQSLQESNVDVSSTVGLFLEPLAPDLTPVAKQTEDTDCELQADR

SEQ ID NO: 50731 - DNA, 336 bp, Shewanella frigidimarina NCIMB 400
  CDS (1)..(336): transl_table=11
atgtctcatcaacgtatcccagcaaattggactattcagcgttctacgccatttttcaccactaaaaatgtgcctgatgcactactgactcatcacaataccgccgaaggagtatttgggcagttatgtgtaatggaaggtgtagtcacgtattttggttttgctaacagcgaagcaactgagcctgaagtgaaagtggtgattaatgccggacaatttgccaccagcccaccagagtactggcaccgtattgaattaagccctgatgcccagttcaatattaatttctggtctgaaaaagataaaaccggccaagcgatgtttaataagaaataa

SEQ ID NO: 50732 - protein, 111 aa, Shewanella frigidimarina NCIMB 400
MSHQRIPANWTIQRSTPFFTTKNVPDALLTHHNTAEGVFGQLCVMEGVVTYFGFANSEATEPEVKVVINAGQFATSPPEYWHRIELSPDAQFNINFWSEKDKTGQAMFNKK

SEQ ID NO: 50733 - DNA, 1326 bp, Streptococcus pneumoniae
  CDS (1)..(1326): transl_table=11
atggcaaagggcgagggaaaggtcgtcgcacaaaataaaaaggcacgccacgactatacaatcgtagatacgctagaggcagggatggtcctgactggaactgaaatcaagagtgtacgagctgctcgaattaatctcaaggatggctttgctcaagtgaaaaatggagaagtttggctgagtaatgttcatatcgcgccttacgaagagggcaatatctggaaccaggaaccagaacgtcgtcgtaaactcctgctccataaaaagcaaattcaaaaattggaacaagagaccaaagggacaggaatgaccttagttccccttaaggtctatataaaagatggctacgctaagcttcttttaggacttgccaaagggaagcatgactatgacaaacgggagtctatcaaacgtcgtgagcaaaatcgagatatcgcgcgtgtgatgaaagctgttaatcagcgattaaaagaggaattgaaaatggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttggcctttacgatatcaattcagctagcattgaacaagaatatgattttatcgtttcaacagttgttctcatgtttctacaagcggaccgcattccagctattattcaaaatatgcaggagaaaaccagtgttggtggttacaacctatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactag

SEQ ID NO: 50734 - protein, 441 aa, Streptococcus pneumoniae
MAKGEGKVVAQNKKARHDYTIVDTLEAGMVLTGTEIKSVRAARINLKDGFAQVKNGEVWLSNVHIAPYEEGNIWNQEPERRRKLLLHKKQIQKLEQETKGTGMTLVPLKVYIKDGYAKLLLGLAKGKHDYDKRESIKRREQNRDIARVMKAVNQRLKEELKMEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGRNSLFLAQQDFDVTAVDQNGLALEILQSIVEQEDLDMPVGLYDINSASIEQEYDFIVSTVVLMFLQADRIPAIIQNMQEKTSVGGYNLSFVPWTRRIILARLTSHSPLKKENWQTITRIGNWLSTMKIQAICTVAMRMAIVFNYALRPY

SEQ ID NO: 50735 - DNA, 864 bp, Eikenella corrodens
  CDS (1)..(864): transl_table=11
atgaatccagaactcatctgctacaaaaccatgccggtatgggataaagccactattccggcggcagttttgtcgcagcacaacacacaggttggcacatatggcaagctgcgcgtattgcgtgggcggctgaagttttatgaattgcaagaagatggcgtggtactcgcggaacatgtgttgcagccggaaagtgggctgtggacgatttacccgcaggcttggcataaagtggaaccactggatgatgattttgccgtgcagctggaatttcattgcgaaaaagccgactttttccacaaaaaatacggcatgactgctacccattccgccatccgcgaagcagtgcagactgtgccgccgtgtaaaacgttggatttaggctgtgggcaagggcgtaatgcgctgtttttgagcttggccggatacgatgtgcatgctgtggatcacagcccggcggcagtagcttcagtgctggatatggctgcgcgcgaacagttgccgctgcgggcagatgcttacgatattaatgctgccgctttgagtgaagattacgattttatcttctccactgtggtgtttatgtttctccaagccaaccgtgtgtcggagattattgccgatatgcaggtacatacccgatccggtggctataacctgattgtgtcggcaatggatacggcagactacccctgccatatgccgttttcgttcacatttaaagaagacgaattgcggcagtattacgccggctgggaattgctgaaatacgaagaagcggtgggttcgatgcacgctaccgatgcgcaaggtcgaccgattcaattgaagtttgtgacgatgttggcgaaaaagcccggttga

SEQ ID NO: 50736 - protein, 287 aa, Eikenella corrodens
MNPELICYKTMPVWDKATIPAAVLSQHNTQVGTYGKLRVLRGRLKFYELQEDGVVLAEHVLQPESGLWTIYPQAWHKVEPLDDDFAVQLEFHCEKADFFHKKYGMTATHSAIREAVQTVPPCKTLDLGCGQGRNALFLSLAGYDVHAVDHSPAAVASVLDMAAREQLPLRADAYDINAAALSEDYDFIFSTVVFMFLQANRVSEIIADMQVHTRSGGYNLIVSAMDTADYPCHMPFSFTFKEDELRQYYAGWELLKYEEAVGSMHATDAQGRPIQLKFVTMLAKKPG

SEQ ID NO: 50737 - DNA, 861 bp, Actinobacillus succinogenes 130Z
  CDS (1)..(861)
atgaaaacagaattaatcagctacaaaaaaatgccgatatggaccaaaaacagcctgccccgaatgtttcaggaaaaacacaacactaaaagcggaacttggggcaaaatcaccgttttaaaaggccaattaaaattctatgtattagcggaaaacggcgaagtaatcagcgaccacctctttacgccggcgaatgacacgccattcgtcgaaccgcaagtatggcaccgcgtagaagcggcgtccgacgatttagaatgttatctggaattctattgtactaaagcggattacttcagcaaaaaatacaatatgacggcaacccattccgaagtgaaagctgcggcagaacggattcgaccgtgtaaaacattggatttaggctgcggacaagggcgcaattcgttatttttaagtctgttgggatacgatgtgacttctcgggatcacaacgaaaccagtctggcatttttgcaggaaactgcggaaaaagaaaatcttcctgtttccaccgcgctttatgacattaactcggcgaatattcaggaaaactacgattttattttatctactgtggtttttatgtttttaaaccgcgacgccgtgccgtcaatcattcaaaatatgcagacccacaccaacagcggcggttataatctgattgtcgccgccatggatacggccgatacgccttgtccgattccgttttctttcaccttcaaagaaggagaattgagccgttattaccgggactgggaattaataaaatataatgaaaaaccgggcgagctgcataagaccgatgacaacggcaaccggattaaaatgaaattcgtgaccatgttggcgcgcaaaaaataa

SEQ ID NO: 50738 - protein, 286 aa, Actinobacillus succinogenes 130Z
MKTELISYKKMPIWTKNSLPRMFQEKHNTKSGTWGKITVLKGQLKFYVLAENGEVISDHLFTPANDTPFVEPQVWHRVEAASDDLECYLEFYCTKADYFSKKYNMTATHSEVKAAAERIRPCKTLDLGCGQGRNSLFLSLLGYDVTSRDHNETSLAFLQETAEKENLPVSTALYDINSANIQENYDFILSTVVFMFLNRDAVPSIIQNMQTHTNSGGYNLIVAAMDTADTPCPIPFSFTFKEGELSRYYRDWELIKYNEKPGELHKTDDNGNRIKMKFVTMLARKK

SEQ ID NO: 50739 - DNA, 363 bp, Pseudoalteromonas haloplanktis TAC125
  CDS (1)..(363): transl_table=11
atgagtcacttaactataccaagtcactggaaaataaaacgctccactcacttttttactaaagataacattccaaaagcgttacttactcaccacaacacagccgagggtgtgtttggccaaatttgcgttatgcaaggcactgttaccttttacggatttgcaaatgaagccgccacagagcctgagcaaactattgtaattaacgcggggcaatttgctaccagcccgccacaatactggcataaagtagagctaagcgacggcgcgcaatttaatatcaacttttgggccgaagccgatacaggcaataaagccctgtttaaaagttcacgtattcatagcaaacctattttagattaa

SEQ ID NO: 50740 - protein, 120 aa, Pseudoalteromonas haloplanktis TAC125
MSHLTIPSHWKIKRSTHFFTKDNIPKALLTHHNTAEGVFGQICVMQGTVTFYGFANEAATEPEQTIVINAGQFATSPPQYWHKVELSDGAQFNINFWAEADTGNKALFKSSRIHSKPILD

SEQ ID NO: 50741 - DNA, 342 bp, Salmonella enterica VII
  CDS (1)..(342): transl_table=11
atgtcccacctatgcatcccggtaaactggaaagttaaacgctccactccctttttcaccaaagagaatgtcccggcggcattgctctctcatcacaatacggcggcaggcgttttcggacaactttgcgtgatggagggtaccgtgacctactatggctttgcgaatgaagctgcgacagaaccagaagtaaaagtggtgattaatgccgggcaattcgccaccagcccgccgcaatactggcatcgggtagaacttagcgatgatgcgcggttcaacattcatttttgggtagaggaaggccatcagggcgaagagttgtatcaacaaaaaaaagcctga

SEQ ID NO: 50742 - protein, 113 aa, Salmonella enterica VII
MSHLCIPVNWKVKRSTPFFTKENVPAALLSHHNTAAGVFGQLCVMEGTVTYYGFANEAATEPEVKVVINAGQFATSPPQYWHRVELSDDARFNIHFWVEEGHQGEELYQQKKA

SEQ ID NO: 50743 - DNA, 861 bp, Streptococcus pneumoniae
  CDS (1)..(861): transl_table=11
atggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatggagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttggcctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaa

SEQ ID NO: 50744 - protein, 286 aa, Streptococcus pneumoniae
MEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMETVKQGKALDLGCGQGRNSLFLAQQDFDVTAVDQNGLALEILQSIVEQEDLDMPVGLYDINSASIEQEYDFIVSTVVLMFLQADRIPAIIQNMQEKTSVGGYNLIVCAMDTEDYPCSVNFPFTFKEGELADYYKDWELVKYNENPGHLHRRDENGNRIQLRFATLLAKKIK

SEQ ID NO: 50745 - DNA, 861 bp, Haemophilus influenzae
  CDS (1)..(861): transl_table=11
atgaaaaacgaattaatttgctataaacaaatgccagtgtggacaaaagacaacttgccacaaatgttccaagaaaagcacaatacaaaagtcggcacttggggaaaattaactgtattaaaaggtaagcttaaattttatgagctaaccgaaaatggcgatgttattgccgagcatatttttaccccagaaagccacattccttttgttgaacctcaagcatggcatcgtgtagaagcactttctgatgacctagaatgtaccctaggtttctattgcaaaaaagaagattatttcagtaaaaaatacaacacgactgccattcacggcgatgtggtggatgctgcaaaaattatctcgccttgtaaagtattagatttaggttgcggacaagggcgtaattcactttatttaagtttattaggctatgatgtgacctcttgggatcacaatgaaaacagcattgcctttttaaatgaaactaaagagaaagaaaatcttaatatttctaccgcactttacgacattaacgccgccaacattcaagaaaactatgattttattgtttcaacggtggtatttatgttcttaaatcgtgaacgtgtgccatcaatcattaaaaatatgaaagaacataccaatgttggcgggtataacttaatcgttgccgccatgtccacagatgatgtgccttgcccacttccattctctttcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaataa

SEQ ID NO: 50746 - protein, 286 aa, Haemophilus influenzae
MKNELICYKQMPVWTKDNLPQMFQEKHNTKVGTWGKLTVLKGKLKFYELTENGDVIAEHIFTPESHIPFVEPQAWHRVEALSDDLECTLGFYCKKEDYFSKKYNTTAIHGDVVDAAKIISPCKVLDLGCGQGRNSLYLSLLGYDVTSWDHNENSIAFLNETKEKENLNISTALYDINAANIQENYDFIVSTVVFMFLNRERVPSIIKNMKEHTNVGGYNLIVAAMSTDDVPCPLPFSFTFAENELKEYYKDWEFLEYNENMGELHKTDENGNRIKMKFATMLARKK

SEQ ID NO: 50747 - DNA, 26 bp, Artificial sequence
  (1)..(26): primer
atgcttcaaatcccacagaattatat

SEQ ID NO: 50748 - DNA, 27 bp, Artificial sequence
  (1)..(27): primer
ttatttcccgttatgaatgactttccg

SEQ ID NO: 50749 - protein, 88 aa, Artificial sequence
  Variant (2)..(3): xaa in position 2 to 3 is any amino acid
  Variant (5)..(5): xaa in position 5 is any amino acid
  Variant (7)..(7): xaa in position 7 is any amino acid
  Variant (9)..(10): xaa in position 9 to 10 is any amino acid
  Variant (13)..(18): xaa in position 13 to 18 is any amino acid
  Variant (21)..(23): xaa in position 21 to 23 is any or no amino acid
  Variant (25)..(26): xaa in position 25 to 26 is any amino acid
  Variant (28)..(28): xaa in position 28 is any amino acid
  Variant (31)..(31): xaa in position 31 is any amino acid
  Variant (33)..(33): xaa in position 33 is any amino acid
  Variant (36)..(36): xaa in position 36 is any amino acid
  Variant (38)..(38): xaa in position 38 is any amino acid
  Variant (40)..(40): xaa in position 40 is any amino acid
  Variant (42)..(47): xaa in position 42 to 47 is any amino acid
  Variant (48)..(48): xaa in position 48 is any or no amino acid
  Variant (50)..(54): xaa in position 50 to 54 is any amino acid
  Variant (55)..(55): xaa in position 55 is any or no amino acid
  Variant (57)..(67): xaa in position 57 to 67 is any amino acid
  Variant (69)..(70): xaa in position 69 to 70 is any amino acid
  Variant (76)..(77): xaa in position 76 to 77 is any amino acid
  Variant (78)..(78): xaa in position 78 is any or no amino acid
  Variant (81)..(84): xaa in position 81 to 84 is any amino acid
  Variant (86)..(86): xaa in position 86 is any amino acid
KXXPXWXKXXVPXXXXXXHNXXXTXXGXWGXLXVLXGXLXFXXXXXXXGXXXXXXIXXXXXXXXXXXPXXWHRVEXXXDDXXXXLXFY

SEQ ID NO: 50750 - protein, 34 aa, Artificial sequence
  Variant (2)..(2): xaa in position 2 is Phe, Ile, Leu or Val
  Variant (3)..(3): xaa in position 3 is Phe, Trp or Tyr
  Variant (4)..(4): xaa in position 4 is Asp, Asn or Thr
  Variant (6)..(6): xaa in position 6 is Ala, Asp, Glu, Asn or Gln
  Variant (7)..(8): xaa in position 7 to 8 is any amino acid
  Variant (10)..(11): xaa in position 10 to 11 is any amino acid
  Variant (12)..(12): xaa in position 12 is Phe, Ile, Leu or Val
  Variant (13)..(15): xaa in position 13 to 15 is any amino acid
  Variant (17)..(17): xaa in position 17 is any amino acid
  Variant (18)..(20): xaa in position 18 to 20 is any or no amino acid
  Variant (22)..(23): xaa in position 22 to 23 is any amino acid
  Variant (24)..(24): xaa in position 24 is Asp or Gly
  Variant (25)..(25): xaa in position 25 is Thr or Val
  Variant (26)..(26): xaa in position 26 is Phe, Trp or Tyr
  Variant (27)..(27): xaa in position 27 is Ala, Gly or Pro
  Variant (28)..(28): xaa in position 28 is any amino acid
  Variant (29)..(29): xaa in position 29 is Ile or Leu
  Variant (30)..(30): xaa in position 30 is any amino acid
  Variant (31)..(31): xaa in position 31 is Ile or Val
  Variant (32)..(32): xaa in position 32 is Leu or Met
  Variant (33)..(33): xaa in position 33 is any amino acid
PXXXKXXXPXXXXXXHXXXXTXXXXXXXXXXXXG

SEQ ID NO: 50751 - protein, 20 aa, Artificial sequence
  Variant (2)..(2): xaa in position 2 is Glu or Gln
  Variant (3)..(3): xaa in position 3 is any amino acid
  Variant (6)..(6): xaa in position 6 is any amino acid
  Variant (7)..(7): xaa in position 7 is Ile or Val
  Variant (9)..(10): xaa in position 9 to 10 is any amino acid
  Variant (11)..(11): xaa in position 11 is Asp, Glu, Ser or Thr
  Variant (13)..(14): xaa in position 13 to 14 is any amino acid
  Variant (15)..(19): xaa in position 15 to 19 is any or no amino acid
PXXWHXXEXXXDXXXXXXXF

SEQ ID NO: 50752 - DNA, 1113 bp, Saccharomyces cerevisiae; identical to SEQ ID NO: 1363
  CDS (1)..(1113)

SEQ ID NO: 50753 - protein, 370 aa, Saccharomyces cerevisiae; identical to SEQ ID NO: 1364

SEQ ID NO: 50754 - DNA, 1086 bp, Deinococcus radiodurans; identical to SEQ ID NO: 1327
  CDS (1)..(1086)

SEQ ID NO: 50755 - protein, 361 aa, Deinococcus radiodurans; identical to SEQ ID NO: 1328

SEQ ID NO: 50756 - DNA, 1071 bp, Salmonella enterica subsp. enterica serovar Typhi; identical to SEQ ID NO: 2245
  CDS (1)..(1071)

SEQ ID NO: 50757 - protein, 356 aa, Salmonella enterica subsp. enterica serovar Typhi; identical to SEQ ID NO: 2246

SEQ ID NO: 50758 - DNA, 1071 bp, Yersinia pestis; identical to SEQ ID NO: 2247
  CDS (1)..(1071)

SEQ ID NO: 50759 - protein, 356 aa, Yersinia pestis; identical to SEQ ID NO: 2248

SEQ ID NO: 50760 - DNA, 1047 bp, Yersinia pestis; identical to SEQ ID NO: 1331
  CDS (1)..(1047)

SEQ ID NO: 50761 - protein, 348 aa, Yersinia pestis; identical to SEQ ID NO: 1332

SEQ ID NO: 50762 - DNA, 1053 bp, Escherichia coli; identical to SEQ ID NO: 2251
  CDS (1)..(1053)

SEQ ID NO: 50763 - protein, 350 aa, Escherichia coli; identical to SEQ ID NO: 1580

SEQ ID NO: 50764 - DNA, 1071 bp, Escherichia coli; identical to SEQ ID NO: 1333
  CDS (1)..(1071)

SEQ ID NO: 50765 - protein, 356 aa, Escherichia coli; identical to SEQ ID NO: 1334

SEQ ID NO: 50766 - DNA, 1131 bp, Nostoc sp. PCC 7120; identical to SEQ ID NO: 1335
  CDS (1)..(1131)

SEQ ID NO: 50767 - protein, 376 aa, Nostoc sp. PCC 7120; identical to SEQ ID NO: 1336

SEQ ID NO: 50768 - DNA, 1053 bp, Salmonella enterica subsp. enterica serovar Typhi; identical to SEQ ID NO: 1337
  CDS (1)..(1053)

SEQ ID NO: 50769 - protein, 350 aa, Salmonella enterica subsp. enterica serovar Typhi; identical to SEQ ID NO: 1338

SEQ ID NO: 50770 - DNA, 1077 bp, Pseudomonas aeruginosa; identical to SEQ ID NO: 1339
  CDS (1)..(1077)

SEQ ID NO: 50771 - protein, 358 aa, Pseudomonas aeruginosa; identical to SEQ ID NO: 1340

SEQ ID NO: 50772 - DNA, 1074 bp, Vibrio cholerae; identical to SEQ ID NO: 1343
  CDS (1)..(1074)

SEQ ID NO: 50773 - protein, 357 aa, Vibrio cholerae; identical to SEQ ID NO: 1344

SEQ ID NO: 50774 - DNA, 1038 bp, Lactococcus lactis subsp. lactis; identical to SEQ ID NO: 1345
  CDS (1)..(1038)

SEQ ID NO: 50775 - protein, 345 aa, Lactococcus lactis subsp. lactis; identical to SEQ ID NO: 1346

SEQ ID NO: 50776 - DNA, 1023 bp, Lactococcus lactis subsp. lactis; identical to SEQ ID NO: 1347
  CDS (1)..(1023)

SEQ ID NO: 50777 - protein, 340 aa, Lactococcus lactis subsp. lactis; identical to SEQ ID NO: 1348

SEQ ID NO: 50778 - DNA, 1032 bp, Streptococcus pneumoniae; identical to SEQ ID NO: 1349
  CDS (1)..(1032)

SEQ ID NO: 50779 - protein, 343 aa, Streptococcus pneumoniae; identical to SEQ ID NO: 1350

SEQ ID NO: 50780 - DNA, 1056 bp, Neisseria meningitidis; identical to SEQ ID NO: 2269
  CDS (1)..(1056)

SEQ ID NO: 50781 - protein, 351 aa, Neisseria meningitidis; identical to SEQ ID NO: 2270

SEQ ID NO: 50782 - DNA, 1095 bp, Pseudomonas aeruginosa; identical to SEQ ID NO: 1351
  CDS (1)..(1095)

SEQ ID NO: 50783 - protein, 364 aa, Pseudomonas aeruginosa; identical to SEQ ID NO: 1352

SEQ ID NO: 50784 - DNA, 1032 bp, Streptococcus pneumoniae; identical to SEQ ID NO: 1355
  CDS (1)..(1032)

SEQ ID NO: 50785 - protein, 343 aa, Streptococcus pneumoniae; identical to SEQ ID NO: 1356

SEQ ID NO: 50786 - DNA, 1143 bp, Xylella fastidiosa; identical to SEQ ID NO: 1603
  CDS (1)..(1143)

SEQ ID NO: 50787 - protein, 380 aa, Xylella fastidiosa; identical to SEQ ID NO: 1604

SEQ ID NO: 50788 - DNA, 1047 bp, Buchnera aphidicola; identical to SEQ ID NO: 1357
  CDS (1)..(1047)

SEQ ID NO: 50789 - protein, 348 aa, Buchnera aphidicola; identical to SEQ ID NO: 1358

SEQ ID NO: 50790 - DNA, 1104 bp, Corynebacterium glutamicum; identical to SEQ ID NO: 2279
  CDS (1)..(1104)

SEQ ID NO: 50791 - protein, 367 aa, Corynebacterium glutamicum; identical to SEQ ID NO: 2280

SEQ ID NO: 50792 - DNA, 1089 bp, Haemophilus influenzae; identical to SEQ ID NO: 1359
  CDS (1)..(1089)

SEQ ID NO: 50793 - protein, 362 aa, Haemophilus influenzae; identical to SEQ ID NO: 1360

SEQ ID NO: 50794 - DNA, 1502 bp, Candida albicans; identical to SEQ ID NO: 1361
  CDS (336)..(1442)

SEQ ID NO: 50795 - protein, 368 aa, Candida albicans; identical to SEQ ID NO: 1362

SEQ ID NO: 50796 - DNA, 2048 bp, Saccharomyces cerevisiae; identical to SEQ ID NO: 1365
  CDS (619)..(1731)

SEQ ID NO: 50797 - protein, 370 aa, Saccharomyces cerevisiae; identical to SEQ ID NO: 1366

SEQ ID NO: 50798 - DNA, 1107 bp, Schizosaccharomyces pombe; identical to SEQ ID NO: 1367
  CDS (1)..(1107)

SEQ ID NO: 50799 - protein, 368 aa, Schizosaccharomyces pombe; identical to SEQ ID NO: 1368

SEQ ID NO: 50800 - DNA, 1089 bp, Amycolatopsis orientalis; identical to SEQ ID NO: 1369
  CDS (1)..(1089)

SEQ ID NO: 50801 - protein, 362 aa, Amycolatopsis orientalis; identical to SEQ ID NO: 1370

SEQ ID NO: 50802 - DNA, 1119 bp, Schizosaccharomyces pombe; identical to SEQ ID NO: 1371
  CDS (1)..(1119)

SEQ ID NO: 50803 - protein, 372 aa, Schizosaccharomyces pombe; identical to SEQ ID NO: 1372

SEQ ID NO: 50804 - DNA, 1083 bp, Methylophilus methylotrophus; identical to SEQ ID NO: 1375
  CDS (1)..(1083)

SEQ ID NO: 50805 - protein, 360 aa, Methylophilus methylotrophus; identical to SEQ ID NO: 1376

SEQ ID NO: 50806 - DNA, 1770 bp, Debaryomyces hansenii; identical to SEQ ID NO: 2295
  CDS (1)..(1770)

SEQ ID NO: 50807 - protein, 589 aa, Debaryomyces hansenii; identical to SEQ ID NO: 2296

SEQ ID NO: 50808 - DNA, 1107 bp, Debaryomyces hansenii; identical to SEQ ID NO: 1377
  CDS (1)..(1107)

SEQ ID NO: 50809 - protein, 368 aa, Debaryomyces hansenii; identical to SEQ ID NO: 1378

SEQ ID NO: 50810 - DNA, 1074 bp, Yarrowia lipolytica; identical to SEQ ID NO: 1379
  CDS (1)..(1074)

SEQ ID NO: 50811 - protein, 357 aa, Yarrowia lipolytica; identical to SEQ ID NO: 1380

SEQ ID NO: 50812 - DNA, 1089 bp, Yarrowia lipolytica; identical to SEQ ID NO: 1381
  CDS (1)..(1089)

SEQ ID NO: 50813 - protein, 362 aa, Yarrowia lipolytica; identical to SEQ ID NO: 1382

SEQ ID NO: 50814 - DNA, 1119 bp, Kluyveromyces lactis; identical to SEQ ID NO: 1383
  CDS (1)..(1119)

SEQ ID NO: 50815 - protein, 372 aa, Kluyveromyces lactis; identical to SEQ ID NO: 1384

SEQ ID NO: 50816 - DNA, 1095 bp, Kluyveromyces lactis; identical to SEQ ID NO: 1385
  CDS (1)..(1095)

SEQ ID NO: 50817 - protein, 364 aa, Kluyveromyces lactis; identical to SEQ ID NO: 1386

SEQ ID NO: 50818 - DNA, 1074 bp, Erwinia carotovora subsp; identical to SEQ ID NO: 1387
  CDS (1)..(1074)

SEQ ID NO: 50819 - protein, 357 aa, Erwinia carotovora subsp; identical to SEQ ID NO: 1388

SEQ ID NO: 50820 - DNA, 1047 bp, Erwinia carotovora subsp; identical to SEQ ID NO: 1389
  CDS (1)..(1047)

SEQ ID NO: 50821 - protein, 348 aa, Erwinia carotovora subsp; identical to SEQ ID NO: 1390

SEQ ID NO: 50822 - DNA, 1056 bp, Erwinia carotovora subsp; identical to SEQ ID NO: 1391
  CDS (1)..(1056)

SEQ ID NO: 50823 - protein, 351 aa, Erwinia carotovora subsp; identical to SEQ ID NO: 1392

SEQ ID NO: 50824 - DNA, 1113 bp, Acinetobacter sp; identical to SEQ ID NO: 1393
  CDS (1)..(1113)

SEQ ID NO: 50825 - protein, 370 aa, Acinetobacter sp; identical to SEQ ID NO: 1394

SEQ ID NO: 50826 - DNA, 1056 bp, Acinetobacter sp; identical to SEQ ID NO: 1395
  CDS (1)..(1056)

SEQ ID NO: 50827 - protein, 351 aa, Acinetobacter sp; identical to SEQ ID NO: 1396

SEQ ID NO: 50828 - DNA, 1119 bp, Candida glabrata; identical to SEQ ID NO: 1397
  CDS (1)..(1119)

SEQ ID NO: 50829 - protein, 372 aa, Candida glabrata; identical to SEQ ID NO: 1398

SEQ ID NO: 50830 - DNA, 1071 bp, Candida glabrata; identical to SEQ ID NO: 1399
  CDS (1)..(1071)

SEQ ID NO: 50831 - protein, 356 aa, Candida glabrata; identical to SEQ ID NO: 1400

SEQ ID NO: 50832 - DNA, 1083 bp, Photobacterium profundum; identical to SEQ ID NO: 1401
  CDS (1)..(1083)

SEQ ID NO: 50833 - protein, 360 aa, Photobacterium profundum; identical to SEQ ID NO: 1402

SEQ ID NO: 50834 - DNA, 1053 bp, Photobacterium profundum; identical to SEQ ID NO: 1403
  CDS (1)..(1053)

SEQ ID NO: 50835 - protein, 350 aa, Photobacterium profundum; identical to SEQ ID NO: 1404

SEQ ID NO: 50836 - DNA, 1113 bp, Photobacterium profundum; identical to SEQ ID NO: 1405
  CDS (1)..(1113)

SEQ ID NO: 50837 - protein, 370 aa, Photobacterium profundum; identical to SEQ ID NO: 1406

SEQ ID NO: 50838 - DNA, 1056 bp, Photobacterium profundum; identical to SEQ ID NO: 1407
  CDS (1)..(1056)

SEQ ID NO: 50839 - protein, 351 aa, Photobacterium profundum; identical to SEQ ID NO: 1408

SEQ ID NO: 50840 - DNA, 1092 bp, Parachlamydia sp; identical to SEQ ID NO: 1409
  CDS (1)..(1092)

SEQ ID NO: 50841 - protein, 363 aa, Parachlamydia sp; identical to SEQ ID NO: 1410

SEQ ID NO: 50842 - DNA, 1095 bp, Rhodopseudomonas palustris; identical to SEQ ID NO: 1411
  CDS (1)..(1095)

SEQ ID NO: 50843 - protein, 364 aa, Rhodopseudomonas palustris; identical to SEQ ID NO: 1412

SEQ ID NO: 50844 - DNA, 1100 bp, Amycolatopsis methanolica; identical to SEQ ID NO: 1413
  CDS (1)..(1086)

SEQ ID NO: 50845 - protein, 361 aa, Amycolatopsis methanolica; identical to SEQ ID NO: 1414

SEQ ID NO: 50846 - DNA, 1071 bp, Treponema denticola; identical to SEQ ID NO: 1415
  CDS (1)..(1071)

SEQ ID NO: 50847 - protein, 356 aa, Treponema denticola; identical to SEQ ID NO: 1416

SEQ ID NO: 50848 - DNA, 1068 bp, Geobacter sulfurreducens; identical to SEQ ID NO: 1417
  CDS (1)..(1068)

SEQ ID NO: 50849 - protein, 355 aa, Geobacter sulfurreducens; identical to SEQ ID NO: 1418

SEQ ID NO: 50850 - DNA, 1095 bp, Ashbya gossypii; identical to SEQ ID NO: 1419
  CDS (1)..(1095)

SEQ ID NO: 50851 - protein, 364 aa, Ashbya gossypii; identical to SEQ ID NO: 1420

SEQ ID NO: 50852 - DNA, 1122 bp, Ashbya gossypii; identical to SEQ ID NO: 1421
  CDS (1)..(1122)

SEQ ID NO: 50853 - protein, 373 aa, Ashbya gossypii; identical to SEQ ID NO: 1422

SEQ ID NO: 50854 - DNA, 1098 bp, Amycolatopsis balhimycina; identical to SEQ ID NO: 1423
  CDS (1)..(1098)

SEQ ID NO: 50855 - protein, 365 aa, Amycolatopsis balhimycina; identical to SEQ ID NO: 1424

SEQ ID NO: 50856 - DNA, 1053 bp, Vibrio vulnificus; identical to SEQ ID NO: 2345
  CDS (1)..(1053)

SEQ ID NO: 50857 - protein, 350 aa, Vibrio vulnificus; identical to SEQ ID NO: 2346

SEQ ID NO: 50858 - DNA, 1047 bp, Photorhabdus luminescens; identical to SEQ ID NO: 1427
  CDS (1)..(1047)

SEQ ID NO: 50859 - protein, 348 aa, Photorhabdus luminescens; identical to SEQ ID NO: 1428

SEQ ID NO: 50860 - DNA, 1053 bp, Photorhabdus luminescens; identical to SEQ ID NO: 1429
  CDS (1)..(1053)

SEQ ID NO: 50861 - protein, 350 aa, Photorhabdus luminescens; identical to SEQ ID NO: 1430

SEQ ID NO: 50862 - DNA, 1095 bp, Photorhabdus luminescens; identical to SEQ ID NO: 1431
  CDS (1)..(1095)

SEQ ID NO: 50863 - protein, 364 aa, Photorhabdus luminescens; identical to SEQ ID NO: 1432

SEQ ID NO: 50864 - DNA, 1119 bp, Gloeobacter violaceus; identical to SEQ ID NO: 1433
  CDS (1)..(1119)

SEQ ID NO: 50865 - protein, 372 aa, Gloeobacter violaceus; identical to SEQ ID NO: 1434

SEQ ID NO: 50866 - DNA, 1107 bp, Chromobacterium violaceum; identical to SEQ ID NO: 1435
  CDS (1)..(1107)

SEQ ID NO: 50867 - protein, 368 aa, Chromobacterium violaceum; identical to SEQ ID NO: 1436

SEQ ID NO: 50868 - DNA, 1059 bp, Chromobacterium violaceum; identical to SEQ ID NO: 1437
  CDS (1)..(1059)

SEQ ID NO: 50869 - protein, 352 aa, Chromobacterium violaceum; identical to SEQ ID NO: 1438

SEQ ID NO: 50870 - DNA, 1140 bp, Neurospora crassa; identical to SEQ ID NO: 1439
  CDS (1)..(1140)

SEQ ID NO: 50871 - protein, 379 aa, Neurospora crassa; identical to SEQ ID NO: 1440

SEQ ID NO: 50872 - DNA, 1092 bp, Neurospora crassa; identical to SEQ ID NO: 1441
  CDS (1)..(1092)

SEQ ID NO: 50873 - protein, 363 aa, Neurospora crassa; identical to SEQ ID NO: 1442

SEQ ID NO: 50874 - DNA, 1068 bp, Synechococcus sp; identical to SEQ ID NO: 1443
  CDS (1)..(1068)

SEQ ID NO: 50875 - protein, 355 aa, Synechococcus sp; identical to SEQ ID NO: 1444

SEQ ID NO: 50876 - DNA, 1053 bp, Rhodopirellula baltica; identical to SEQ ID NO: 1445
  CDS (1)..(1053)

SEQ ID NO: 50877 - protein, 350 aa, Rhodopirellula baltica; identical to SEQ ID NO: 1446

SEQ ID NO: 50878 - DNA, 1068 bp, Prochlorococcus marinus subsp; identical to SEQ ID NO: 1447
  CDS (1)..(1068)

SEQ ID NO: 50879 - protein, 355 aa, Prochlorococcus marinus subsp; identical to SEQ ID NO: 1448

SEQ ID NO: 50880 - DNA, 1083 bp, Prochlorococcus marinus; identical to SEQ ID NO: 1449
  CDS (1)..(1083)

SEQ ID NO: 50881 - protein, 360 aa, Prochlorococcus marinus; identical to SEQ ID NO: 1450

SEQ ID NO: 50882 - DNA, 1074 bp, Prochlorococcus marinus; identical to SEQ ID NO: 1451
  CDS (1)..(1074)

SEQ ID NO: 50883 - protein, 357 aa, Prochlorococcus marinus; identical to SEQ ID NO: 1452

SEQ ID NO: 50884 - DNA, 1113 bp, Haemophilus ducreyi; identical to SEQ ID NO: 1453
  CDS (1)..(1113)

SEQ ID NO: 50885 - protein, 370 aa, Haemophilus ducreyi; identical to SEQ ID NO: 1454

SEQ ID NO: 50886 - DNA, 1080 bp, Haemophilus ducreyi; identical to SEQ ID NO: 1455
  CDS (1)..(1080)

SEQ ID NO: 50887 - protein, 359 aa, Haemophilus ducreyi; identical to SEQ ID NO: 1456

SEQ ID NO: 50888 - DNA, 1086 bp, Candidatus Blochmannia floridanus; identical to SEQ ID NO: 1457
  CDS (1)..(1086)

SEQ ID NO: 50889 - protein, 361 aa, Candidatus Blochmannia floridanus; identical to SEQ ID NO: 1458

SEQ ID NO: 50890 - DNA, 1074 bp, Bordetella pertussis; identical to SEQ ID NO: 2379
  CDS (1)..(1074)

SEQ ID NO: 50891 - protein, 357 aa, Bordetella pertussis; identical to SEQ ID NO: 1460

SEQ ID NO: 50892 - DNA, 1119 bp, Bordetella bronchiseptica; identical to SEQ ID NO: 1461
  CDS (1)..(1119)

SEQ ID NO: 50893 - protein, 372 aa, Bordetella bronchiseptica; identical to SEQ ID NO: 1462

SEQ ID NO: 50894 - DNA, 1179 bp, Nitrosomonas europaea; identical to SEQ ID NO: 1463
  CDS (1)..(1179)

SEQ ID NO: 50895 - protein, 392 aa, Nitrosomonas europaea; identical to SEQ ID NO: 1464

SEQ ID NO: 50896 - DNA, 1083 bp, Coxiella burnetii; identical to SEQ ID NO: 1465
  CDS (1)..(1083)

SEQ ID NO: 50897 - protein, 360 aa, Coxiella burnetii; identical to SEQ ID NO: 1466

SEQ ID NO: 50898 - DNA, 1053 bp, Vibrio parahaemolyticus; identical to SEQ ID NO: 1471
  CDS (1)..(1053)

SEQ ID NO: 50899 - protein, 350 aa, Vibrio parahaemolyticus; identical to SEQ ID NO: 1472

SEQ ID NO: 50900 - DNA, 1053 bp, Vibrio parahaemolyticus; identical to SEQ ID NO: 1473
  CDS (1)..(1053)

SEQ ID NO: 50901 - protein, 350 aa, Vibrio parahaemolyticus; identical to SEQ ID NO: 1474

SEQ ID NO: 50902 - DNA, 1074 bp, Vibrio parahaemolyticus; identical to SEQ ID NO: 1475
  CDS (1)..(1074)

SEQ ID NO: 50903 - protein, 357 aa, Vibrio parahaemolyticus; identical to SEQ ID NO: 1476

SEQ ID NO: 50904 - DNA, 1083 bp, Pseudomonas syringae; identical to SEQ ID NO: 1477
  CDS (1)..(1083)

SEQ ID NO: 50905 - protein, 360 aa, Pseudomonas syringae; identical to SEQ ID NO: 1478

SEQ ID NO: 50906 - DNA, 1077 bp, Pseudomonas syringae; identical to SEQ ID NO: 1479
  CDS (1)..(1077)

SEQ ID NO: 50907 - protein, 358 aa, Pseudomonas syringae; identical to SEQ ID NO: 1480

SEQ ID NO: 50908 - DNA, 1062 bp, Pseudomonas putida; identical to SEQ ID NO: 1481
  CDS (1)..(1062)

SEQ ID NO: 50909 - protein, 353 aa, Pseudomonas putida; identical to SEQ ID NO: 1482

SEQ ID NO: 50910 - DNA, 1113 bp, Pseudomonas putida; identical to SEQ ID NO: 1483
  CDS (1)..(1113)

SEQ ID NO: 50911 - protein, 370 aa, Pseudomonas putida; identical to SEQ ID NO: 1484

SEQ ID NO: 50912 - DNA, 1086 bp, Bradyrhizobium japonicum; identical to SEQ ID NO: 1485
  CDS (1)..(1086)

SEQ ID NO: 50913 - protein, 361 aa, Bradyrhizobium japonicum; identical to SEQ ID NO: 1486

SEQ ID NO: 50914 - DNA, 1053 bp, Yersinia pestis; identical to SEQ ID NO: 1487
  CDS (1)..(1053)

SEQ ID NO: 50915 - protein, 350 aa, Yersinia pestis; identical to SEQ ID NO: 1488

SEQ ID NO: 50916 - DNA, 1038 bp, Wigglesworthia glossinidia brevipalpis; identical to SEQ ID NO: 1491
  CDS (1)..(1038)

SEQ ID NO: 50917 - protein, 345 aa, Wigglesworthia glossinidia brevipalpis; identical to SEQ ID NO: 1492

SEQ ID NO: 50918 - DNA, 1071 bp, Vibrio vulnificus; identical to SEQ ID NO: 1739
  CDS (1)..(1071)

SEQ ID NO: 50919 - protein, 356 aa, Vibrio vulnificus; identical to SEQ ID NO: 1740

SEQ ID NO: 50920 - DNA, 1053 bp, Vibrio vulnificus; identical to SEQ ID NO: 1493
  CDS (1)..(1053)

SEQ ID NO: 50921 - protein, 350 aa, Vibrio vulnificus; identical to SEQ ID NO: 1494

SEQ ID NO: 50922 - DNA, 1071 bp, Vibrio vulnificus; identical to SEQ ID NO: 1497
  CDS (1)..(1071)

SEQ ID NO: 50923 - protein, 356 aa, Vibrio vulnificus; identical to SEQ ID NO: 1498

SEQ ID NO: 50924 - DNA, 1062 bp, Synechococcus elongatus; identical to SEQ ID NO: 1499
  CDS (1)..(1062)

SEQ ID NO: 50925 - protein, 353 aa, Synechococcus elongatus; identical to SEQ ID NO: 1500

SEQ ID NO: 50926 - DNA, 1032 bp, Streptococcus mutans; identical to SEQ ID NO: 1501
  CDS (1)..(1032)

SEQ ID NO: 50927 - protein, 343 aa, Streptococcus mutans; identical to SEQ ID NO: 1502

SEQ ID NO: 50928 - DNA, 1035 bp, Streptococcus mutans; identical to SEQ ID NO: 1503
  CDS (1)..(1035)

SEQ ID NO: 50929 - protein, 344 aa, Streptococcus mutans; identical to SEQ ID NO: 1504

SEQ ID NO: 50930 - DNA, 1008 bp, Streptococcus agalactiae; identical to SEQ ID NO: 1505
  CDS (1)..(1008)

SEQ ID NO: 50931 - protein, 335 aa, Streptococcus agalactiae; identical to SEQ ID NO: 1506

SEQ ID NO: 50932 - DNA, 1065 bp, Shewanella oneidensis; identical to SEQ ID NO: 1507
  CDS (1)..(1065)

SEQ ID NO: 50933 - protein, 354 aa, Shewanella oneidensis; identical to SEQ ID NO: 1508

SEQ ID NO: 50934 - DNA, 1092 bp, Shewanella oneidensis; identical to SEQ ID NO: 1509
  CDS (1)..(1092)

SEQ ID NO: 50935 - protein, 363 aa, Shewanella oneidensis; identical to SEQ ID NO: 1510

SEQ ID NO: 50936 - DNA, 1059 bp, Shewanella oneidensis; identical to SEQ ID NO: 1511
  CDS (1)..(1059)

SEQ ID NO: 50937 - protein, 352 aa, Shewanella oneidensis; identical to SEQ ID NO: 1512

SEQ ID NO: 50938 - DNA, 1170 bp, Corynebacterium efficiens; identical to SEQ ID NO: 1515
  CDS (1)..(1170)

SEQ ID NO: 50939 - protein, 389 aa, Corynebacterium efficiens; identical to SEQ ID NO: 1516

SEQ ID NO: 50940 - DNA, 1134 bp, Bifidobacterium longum; identical to SEQ ID NO: 1517
  CDS (1)..(1134)

SEQ ID NO: 50941 - protein, 377 aa, Bifidobacterium longum; identical to SEQ ID NO: 1518

SEQ ID NO: 50942 - DNA, 1233 bp, Bifidobacterium longum; identical to SEQ ID NO: 1519
  CDS (1)..(1233)

SEQ ID NO: 50943 - protein, 410 aa, Bifidobacterium longum; identical to SEQ ID NO: 1520

SEQ ID NO: 50944 - DNA, 1221 bp, Phytophthora infestans; identical to SEQ ID NO: 1521
  CDS (20)..(1153)

SEQ ID NO: 50945 - protein, 377 aa, Phytophthora infestans; identical to SEQ ID NO: 1522

SEQ ID NO: 50946 - DNA, 1062 bp, Chlorobium tepidum; identical to SEQ ID NO: 1523
  CDS (1)..(1062)

SEQ ID NO: 50947 - protein, 353 aa, Chlorobium tepidum; identical to SEQ ID NO: 1524

SEQ ID NO: 50948 - DNA, 1074 bp, Xanthomonas campestris; identical to SEQ ID NO: 1525
  CDS (1)..(1074)

SEQ ID NO: 50949 - protein, 357 aa, Xanthomonas campestris; identical to SEQ ID NO: 1526

SEQ ID NO: 50950 - DNA, 1074 bp, Xanthomonas axonopodis; identical to SEQ ID NO: 1527
  CDS (1)..(1074)

SEQ ID NO: 50951 - protein, 357 aa, Xanthomonas axonopodis; identical to SEQ ID NO: 1528

SEQ ID NO: 50952 - DNA, 1080 bp, Ralstonia solanacearum; identical to SEQ ID NO: 1529
  CDS (1)..(1080)

SEQ ID NO: 50953 - protein, 359 aa, Ralstonia solanacearum; identical to SEQ ID NO: 1530

SEQ ID NO: 50954 - DNA, 1179 bp, Ralstonia solanacearum; identical to SEQ ID NO: 1531
  CDS (1)..(1179)

SEQ ID NO: 50955 - protein, 392 aa, Ralstonia solanacearum; identical to SEQ ID NO: 1532

SEQ ID NO: 50956 - DNA, 1065 bp, Synechococcus sp; identical to SEQ ID NO: 1533
  CDS (1)..(1065)

SEQ ID NO: 50957 - protein, 354 aa, Synechococcus sp; identical to SEQ ID NO: 1534

SEQ ID NO: 50958 - DNA, 1035 bp, Escherichia coli; identical to SEQ ID NO: 1535
  CDS (1)..(1035)

SEQ ID NO: 50959 - protein, 344 aa, Escherichia coli; identical to SEQ ID NO: 1536

SEQ ID NO: 50960 - DNA, 1200 bp, Stigmatella aurantiaca; identical to SEQ ID NO: 1537
  CDS (62)..(1147)

SEQ ID NO: 50961 - protein, 361 aa, Stigmatella aurantiaca; identical to SEQ ID NO: 1538

SEQ ID NO: 50962 - DNA, 1083 bp, Amycolatopsis mediterranei; identical to SEQ ID NO: 1541
  CDS (1)..(1083)

SEQ ID NO: 50963 - protein, 360 aa, Amycolatopsis mediterranei; identical to SEQ ID NO: 1542

SEQ ID NO: 50964 - DNA, 1053 bp, Pasteurella multocida; identical to SEQ ID NO: 1543
  CDS (1)..(1053)

SEQ ID NO: 50965 - protein, 350 aa, Pasteurella multocida; identical to SEQ ID NO: 1544

SEQ ID NO: 50966 - DNA, 1086 bp, Pasteurella multocida; identical to SEQ ID NO: 1545
  CDS (1)..(1086)

SEQ ID NO: 50967 - protein, 361 aa, Pasteurella multocida; identical to SEQ ID NO: 1546

SEQ ID NO: 50968 - DNA, 1125 bp, Emericella nidulans; identical to SEQ ID NO: 1547
  CDS (1)..(1125)

SEQ ID NO: 50969 - protein, 374 aa, Emericella nidulans; identical to SEQ ID NO: 1548

SEQ ID NO: 50970 - DNA, 1089 bp, Emericella nidulans; identical to SEQ ID NO: 1549
  CDS (1)..(1089)

SEQ ID NO: 50971 - protein, 362 aa, Emericella nidulans; identical to SEQ ID NO: 1550

SEQ ID NO: 50972 - DNA, 1239 bp, Vibrio cholerae; identical to SEQ ID NO: 1551
  CDS (114)..(1175)

SEQ ID NO: 50973 - protein, 353 aa, Vibrio cholerae; identical to SEQ ID NO: 1552

SEQ ID NO: 50974 - DNA, 2184 bp, Candida albicans; identical to SEQ ID NO: 1553
  CDS (461)..(1573)

SEQ ID NO: 50975 - protein, 370 aa, Candida albicans; identical to SEQ ID NO: 1554

SEQ ID NO: 50976 - DNA, 1047 bp, Buchnera aphidicola; identical to SEQ ID NO: 1555
  CDS (1)..(1047)

SEQ ID NO: 50977 - protein, 348 aa, Buchnera aphidicola; identical to SEQ ID NO: 1556

SEQ ID NO: 50978 - DNA, 1047 bp, Buchnera aphidicola; identical to SEQ ID NO: 1557
  CDS (1)..(1047)

SEQ ID NO: 50979 - protein, 348 aa, Buchnera aphidicola; identical to SEQ ID NO: 1558

SEQ ID NO: 50980 - DNA, 1047 bp, Erwinia herbicola; identical to SEQ ID NO: 1559
  CDS (1)..(1047)

SEQ ID NO: 50981 - protein, 348 aa, Erwinia herbicola; identical to SEQ ID NO: 1560

SEQ ID NO: 50982 - DNA, 1047 bp, Salmonella typhimurium; identical to SEQ ID NO: 1561
  CDS (1)..(1047)

SEQ ID NO: 50983 - protein, 348 aa, Salmonella typhimurium; identical to SEQ ID NO: 1562

SEQ ID NO: 50984 - DNA, 1047 bp, Shigella flexneri; identical to SEQ ID NO: 2473
  CDS (1)..(1047)

SEQ ID NO: 50985 - protein, 348 aa, Shigella flexneri; identical to SEQ ID NO: 2474

SEQ ID NO: 50986 - DNA, 25 bp, Artificial sequence
  (1)..(25): primer
atgttcattaaaaacgatcacgccg

SEQ ID NO: 50987 - DNA, 25 bp, Artificial sequence
  (1)..(25): primer
ctattttttcaaggcctttcttctg

SEQ ID NO: 50988 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 50989 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 50990 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 50991 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 50992 - DNA, 1392 bp, Escherichia coli K12; identical to SEQ ID NO: 28298
  CDS (1)..(1392): transl_table=11

SEQ ID NO: 50993 - protein, 463 aa, Escherichia coli K12; identical to SEQ ID NO: 28299

SEQ ID NO: 50994 - DNA, 1428 bp, Aquifex aeolicus VF5; identical to SEQ ID NO: 28300
  CDS (1)..(1428): transl_table=11

SEQ ID NO: 50995 - protein, 475 aa, Aquifex aeolicus VF5; identical to SEQ ID NO: 28301

SEQ ID NO: 50996 - DNA, 1212 bp, Pseudomonas aeruginosa PAO1; identical to SEQ ID NO: 28302
  CDS (1)..(1212): transl_table=11

SEQ ID NO: 50997 - protein, 403 aa, Pseudomonas aeruginosa PAO1; identical to SEQ ID NO: 28303

SEQ ID NO: 50998 - DNA, 1407 bp, Pseudomonas aeruginosa PAO1; identical to SEQ ID NO: 28304
  CDS (1)..(1407): transl_table=11

SEQ ID NO: 50999 - protein, 468 aa, Pseudomonas aeruginosa PAO1; identical to SEQ ID NO: 28305

SEQ ID NO: 51000 - DNA, 1296 bp, Pseudomonas aeruginosa PAO1; identical to SEQ ID NO: 28306
  CDS (1)..(1296): transl_table=11

SEQ ID NO: 51001 - protein, 431 aa, Pseudomonas aeruginosa PAO1; identical to SEQ ID NO: 28307

SEQ ID NO: 51002 - DNA, 1554 bp, Mycobacterium leprae TN; identical to SEQ ID NO: 28308
  CDS (1)..(1554): transl_table=11

SEQ ID NO: 51003 - protein, 517 aa, Mycobacterium leprae TN; identical to SEQ ID NO: 28309

SEQ ID NO: 51004 - DNA, 1389 bp, Escherichia coli O157:H7; identical to SEQ ID NO: 28310
  CDS (1)..(1389): transl_table=11

SEQ ID NO: 51005 - protein, 462 aa, Escherichia coli O157:H7; identical to SEQ ID NO: 28311

SEQ ID NO: 51006 - DNA, 1410 bp, Mycobacterium tuberculosis CDC1551; identical to SEQ ID NO: 28312
  CDS (1)..(1410): transl_table=11

SEQ ID NO: 51007 - protein, 469 aa, Mycobacterium tuberculosis CDC1551; identical to SEQ ID NO: 28313

SEQ ID NO: 51008 - DNA, 1392 bp, Mycobacterium tuberculosis CDC1551; identical to SEQ ID NO: 28314
  CDS (1)..(1392): transl_table=11

SEQ ID NO: 51009 - protein, 463 aa, Mycobacterium tuberculosis CDC1551; identical to SEQ ID NO: 28315

SEQ ID NO: 51010 - DNA, 1188 bp, Mycobacterium tuberculosis CDC1551; identical to SEQ ID NO: 28316
  CDS (1)..(1188): transl_table=11

SEQ ID NO: 51011 - protein, 395 aa, Mycobacterium tuberculosis CDC1551; identical to SEQ ID NO: 28317

SEQ ID NO: 51012 - DNA, 1548 bp, Mycobacterium tuberculosis CDC1551; identical to SEQ ID NO: 28318
  CDS (1)..(1548): transl_table=11

SEQ ID NO: 51013 - protein, 515 aa, Mycobacterium tuberculosis CDC1551; identical to SEQ ID NO: 28319

SEQ ID NO: 51014 - DNA, 1170 bp, Staphylococcus aureus subsp. aureus Mu50; identical to SEQ ID NO: 28320
  CDS (1)..(1170): transl_table=11

SEQ ID NO: 51015 - protein, 389 aa, Staphylococcus aureus subsp. aureus Mu50; identical to SEQ ID NO: 28321

SEQ ID NO: 51016 - DNA, 1422 bp, Caulobacter crescentus CB15; identical to SEQ ID NO: 28322
  CDS (1)..(1422): transl_table=11

SEQ ID NO: 51017 - protein, 473 aa, Caulobacter crescentus CB15; identical to SEQ ID NO: 28323

SEQ ID NO: 51018 - DNA, 1275 bp, Sinorhizobium meliloti 1021; identical to SEQ ID NO: 28324
  CDS (1)..(1275): transl_table=11

SEQ ID NO: 51019 - protein, 424 aa, Sinorhizobium meliloti 1021; identical to SEQ ID NO: 28325

SEQ ID NO: 51020 - DNA, 1398 bp, Salmonella typhimurium LT2; identical to SEQ ID NO: 28326
  CDS (1)..(1398): transl_table=11

SEQ ID NO: 51021 - protein, 465 aa, Salmonella typhimurium LT2; identical to SEQ ID NO: 28327

SEQ ID NO: 51022 - DNA, 1314 bp, Ralstonia solanacearum GMI1000; identical to SEQ ID NO: 28328
  CDS (1)..(1314): transl_table=11

SEQ ID NO: 51023 - protein, 437 aa, Ralstonia solanacearum GMI1000; identical to SEQ ID NO: 28329

SEQ ID NO: 51024 - DNA, 1386 bp, Ralstonia solanacearum GMI1000; identical to SEQ ID NO: 28330
  CDS (1)..(1386): transl_table=11

SEQ ID NO: 51025 - protein, 461 aa, Ralstonia solanacearum GMI1000; identical to SEQ ID NO: 28331

SEQ ID NO: 51026 - DNA, 2856 bp, Brucella melitensis 16M; identical to SEQ ID NO: 28332
  CDS (1)..(2856): transl_table=11

SEQ ID NO: 51027 - protein, 951 aa, Brucella melitensis 16M; identical to SEQ ID NO: 28333

SEQ ID NO: 51028 - DNA, 1293 bp, Clostridium perfringens str. 13; identical to SEQ ID NO: 28334
  CDS (1)..(1293): transl_table=11

SEQ ID NO: 51029 - protein, 430 aa, Clostridium perfringens str. 13; identical to SEQ ID NO: 28335

SEQ ID NO: 51030 - DNA, 1338 bp, Corynebacterium glutamicum ATCC 13032; identical to SEQ ID NO: 28336
  CDS (1)..(1338): transl_table=11

SEQ ID NO: 51031 - protein, 445 aa, Corynebacterium glutamicum ATCC 13032; identical to SEQ ID NO: 28337

SEQ ID NO: 51032 - DNA, 1239 bp, Streptomyces coelicolor A3(2); identical to SEQ ID NO: 28338
  CDS (1)..(1239): transl_table=11

SEQ ID NO: 51033 - protein, 412 aa, Streptomyces coelicolor A3(2); identical to SEQ ID NO: 28339

SEQ ID NO: 51034 - DNA, 1359 bp, Streptomyces coelicolor A3(2); identical to SEQ ID NO: 28340
  CDS (1)..(1359): transl_table=11

SEQ ID NO: 51035 - protein, 452 aa, Streptomyces coelicolor A3(2); identical to SEQ ID NO: 28341

SEQ ID NO: 51036 - DNA, 1236 bp, Xanthomonas campestris pv. campestris str. ATCC 33913; identical to SEQ ID NO: 28342
  CDS (1)..(1236): transl_table=11

SEQ ID NO: 51037 - protein, 411 aa, Xanthomonas campestris pv. campestris str. ATCC 33913; identical to SEQ ID NO: 28343

SEQ ID NO: 51038 - DNA, 2688 bp, Brucella suis 1330; identical to SEQ ID NO: 28344
  CDS (1)..(2688): transl_table=11

SEQ ID NO: 51039 - protein, 895 aa, Brucella suis 1330; identical to SEQ ID NO: 28345

SEQ ID NO: 51040 - DNA, 1389 bp, Shigella flexneri 2a str. 301; identical to SEQ ID NO: 28346
  CDS (1)..(1389): transl_table=11

SEQ ID NO: 51041 - protein, 462 aa, Shigella flexneri 2a str. 301; identical to SEQ ID NO: 28347

SEQ ID NO: 51042 - DNA, 1434 bp, Corynebacterium efficiens YS-314; identical to SEQ ID NO: 28348
  CDS (1)..(1434): transl_table=11

SEQ ID NO: 51043 - protein, 477 aa, Corynebacterium efficiens YS-314; identical to SEQ ID NO: 28349

SEQ ID NO: 51044 - DNA, 1302 bp, Corynebacterium efficiens YS-314; identical to SEQ ID NO: 28350
  CDS (1)..(1302): transl_table=11

SEQ ID NO: 51045 - protein, 433 aa, Corynebacterium efficiens YS-314; identical to SEQ ID NO: 28351

SEQ ID NO: 51046 - DNA, 1236 bp, Pseudomonas putida KT2440; identical to SEQ ID NO: 28352
  CDS (1)..(1236): transl_table=11

SEQ ID NO: 51047 - protein, 411 aa, Pseudomonas putida KT2440; identical to SEQ ID NO: 28353

SEQ ID NO: 51048 - DNA, 1164 bp, Staphylococcus epidermidis ATCC 12228; identical to SEQ ID NO: 28354
  CDS (1)..(1164): transl_table=11

SEQ ID NO: 51049 - protein, 387 aa, Staphylococcus epidermidis ATCC 12228; identical to SEQ ID NO: 28355

SEQ ID NO: 51050 - DNA, 1380 bp, Bradyrhizobium japonicum USDA 110; identical to SEQ ID NO: 28356
  CDS (1)..(1380): transl_table=11

SEQ ID NO: 51051 - protein, 459 aa, Bradyrhizobium japonicum USDA 110; identical to SEQ ID NO: 28357

SEQ ID NO: 51052 - DNA, 1191 bp, Lactobacillus plantarum WCFS1; identical to SEQ ID NO: 28358
  CDS (1)..(1191): transl_table=11

SEQ ID NO: 51053 - protein, 396 aa, Lactobacillus plantarum WCFS1; identical to SEQ ID NO: 28359

SEQ ID NO: 51054 - DNA, 1212 bp, Pseudomonas syringae pv. tomato str. DC3000; identical to SEQ ID NO: 28360
  CDS (1)..(1212): transl_table=11

SEQ ID NO: 51055 - protein, 403 aa, Pseudomonas syringae pv. tomato str. DC3000; identical to SEQ ID NO: 28361

SEQ ID NO: 51056 - DNA, 1389 bp, Salmonella enterica subsp. enterica serovar Typhi Ty2; identical to SEQ ID NO: 28362
  CDS (1)..(1389): transl_table=11

SEQ ID NO: 51057 - protein, 462 aa, Salmonella enterica subsp. enterica serovar Typhi Ty2; identical to SEQ ID NO: 28363

SEQ ID NO: 51058 - DNA, 1392 bp, Streptomyces avermitilis MA-4680; identical to SEQ ID NO: 28364
  CDS (1)..(1392): transl_table=11

SEQ ID NO: 51059 - protein, 463 aa, Streptomyces avermitilis MA-4680; identical to SEQ ID NO: 28365

SEQ ID NO: 51060 - DNA, 1170 bp, Bacillus cereus ATCC 14579; identical to SEQ ID NO: 28366
  CDS (1)..(1170): transl_table=11

SEQ ID NO: 51061 - protein, 389 aa, Bacillus cereus ATCC 14579; identical to SEQ ID NO: 28367

SEQ ID NO: 51062 - DNA, 1389 bp, Shigella flexneri 2a str. 2457T; identical to SEQ ID NO: 28368
  CDS (1)..(1389): transl_table=11

SEQ ID NO: 51063 - protein, 462 aa, Shigella flexneri 2a str. 2457T; identical to SEQ ID NO: 28369

SEQ ID NO: 51064 - DNA, 1203 bp, Chromobacterium violaceum ATCC 12472; identical to SEQ ID NO: 28370
  CDS (1)..(1203): transl_table=11

SEQ ID NO: 51065 - protein, 400 aa, Chromobacterium violaceum ATCC 12472; identical to SEQ ID NO: 28371

SEQ ID NO: 51066 - DNA, 1380 bp, Chromobacterium violaceum ATCC 12472; identical to SEQ ID NO: 28372
  CDS (1)..(1380): transl_table=11

SEQ ID NO: 51067 - protein, 459 aa, Chromobacterium violaceum ATCC 12472; identical to SEQ ID NO: 28373

SEQ ID NO: 51068 - DNA, 1284 bp, Chromobacterium violaceum ATCC 12472; identical to SEQ ID NO: 28374
  CDS (1)..(1284): transl_table=11

SEQ ID NO: 51069 - protein, 427 aa, Chromobacterium violaceum ATCC 12472; identical to SEQ ID NO: 28375

SEQ ID NO: 51070 - DNA, 1380 bp, Chromobacterium violaceum ATCC 12472; identical to SEQ ID NO: 28376
  CDS (1)..(1380): transl_table=11

SEQ ID NO: 51071 - protein, 459 aa, Chromobacterium violaceum ATCC 12472; identical to SEQ ID NO: 28377

SEQ ID NO: 51072 - DNA, 1332 bp, Corynebacterium diphtheriae NCTC 13129; identical to SEQ ID NO: 28378
  CDS (1)..(1332): transl_table=11

SEQ ID NO: 51073 - protein, 443 aa, Corynebacterium diphtheriae NCTC 13129; identical to SEQ ID NO: 28379

SEQ ID NO: 51074 - DNA, 1299 bp, Corynebacterium diphtheriae NCTC 13129; identical to SEQ ID NO: 28380
  CDS (1)..(1299): transl_table=11

SEQ ID NO: 51075 - protein, 432 aa, Corynebacterium diphtheriae NCTC 13129; identical to SEQ ID NO: 28381

SEQ ID NO: 51076 - DNA, 1281 bp, Cupriavidus necator; identical to SEQ ID NO: 28382
  CDS (1)..(1281): transl_table=11

SEQ ID NO: 51077 - protein, 426 aa, Cupriavidus necator; identical to SEQ ID NO: 28383

SEQ ID NO: 51078 - DNA, 1395 bp, Cupriavidus necator; identical to SEQ ID NO: 28384
  CDS (1)..(1395): transl_table=11

SEQ ID NO: 51079 - protein, 464 aa, Cupriavidus necator; identical to SEQ ID NO: 28385

SEQ ID NO: 51080 - DNA, 1458 bp, Mycobacterium avium subsp. paratuberculosis K-10; identical to SEQ ID NO: 28386
  CDS (1)..(1458): transl_table=11

SEQ ID NO: 51081 - protein, 485 aa, Mycobacterium avium subsp. paratuberculosis K-10; identical to SEQ ID NO: 28387

SEQ ID NO: 51082 - DNA, 1392 bp, Mycobacterium avium subsp. paratuberculosis K-10; identical to SEQ ID NO: 28388
  CDS (1)..(1392): transl_table=11

SEQ ID NO: 51083 - protein, 463 aa, Mycobacterium avium subsp. paratuberculosis K-10; identical to SEQ ID NO: 28389

SEQ ID NO: 51084 - DNA, 1392 bp, Mycobacterium avium subsp. paratuberculosis K-10; identical to SEQ ID NO: 28390
  CDS (1)..(1392): transl_table=11

SEQ ID NO: 51085 - protein, 463 aa, Mycobacterium avium subsp. paratuberculosis K-10; identical to SEQ ID NO: 28391

SEQ ID NO: 51086 - DNA, 1170 bp, Bacillus anthracis str. Sterne; identical to SEQ ID NO: 28392
  CDS (1)..(1170): transl_table=11

SEQ ID NO: 51087 - protein, 389 aa, Bacillus anthracis str. Sterne; identical to SEQ ID NO: 28393

SEQ ID NO: 51088 - DNA, 1170 bp, Bacillus thuringiensis serovar konkukian str. 97-27; identical to SEQ ID NO: 28394
  CDS (1)..(1170): transl_table=11

SEQ ID NO: 51089 - protein, 389 aa, Bacillus thuringiensis serovar konkukian str. 97-27; identical to SEQ ID NO: 28395

SEQ ID NO: 51090 - DNA, 1170 bp, Staphylococcus aureus subsp. aureus MRSA252; identical to SEQ ID NO: 28396
  CDS (1)..(1170): transl_table=11

SEQ ID NO: 51091 - protein, 389 aa, Staphylococcus aureus subsp. aureus MRSA252; identical to SEQ ID NO: 28397

SEQ ID NO: 51092 - DNA, 1170 bp, Staphylococcus aureus subsp. aureus MSSA476; identical to SEQ ID NO: 28398
  CDS (1)..(1170): transl_table=11

SEQ ID NO: 51093 - protein, 389 aa, Staphylococcus aureus subsp. aureus MSSA476; identical to SEQ ID NO: 28399

SEQ ID NO: 51094 - DNA, 1389 bp, Erwinia carotovora subsp. atroseptica SCRI1043; identical to SEQ ID NO: 28400
  CDS (1)..(1389): transl_table=11

SEQ ID NO: 51095 - protein, 462 aa, Erwinia carotovora subsp. atroseptica SCRI1043; identical to SEQ ID NO: 28401

SEQ ID NO: 51096 - DNA, 1317 bp, Propionibacterium acnes KPA171202; identical to SEQ ID NO: 28402
  CDS (1)..(1317): transl_table=11

SEQ ID NO: 51097 - protein, 438 aa, Propionibacterium acnes KPA171202; identical to SEQ ID NO: 28403

SEQ ID NO: 51098 - DNA, 1206 bp, Bacillus licheniformis ATCC 14580; identical to SEQ ID NO: 28404
  CDS (1)..(1206): transl_table=11

SEQ ID NO: 51099 - protein, 401 aa, Bacillus licheniformis ATCC 14580; identical to SEQ ID NO: 28405

SEQ ID NO: 51100 - DNA, 1185 bp, Bacillus licheniformis ATCC 14580; identical to SEQ ID NO: 28406
  CDS (1)..(1185): transl_table=11

SEQ ID NO: 51101 - protein, 394 aa, Bacillus licheniformis ATCC 14580; identical to SEQ ID NO: 28407

SEQ ID NO: 51102 - DNA, 1230 bp, Burkholderia mallei ATCC 23344; identical to SEQ ID NO: 28408
  CDS (1)..(1230): transl_table=11

SEQ ID NO: 51103 - protein, 409 aa, Burkholderia mallei ATCC 23344; identical to SEQ ID NO: 28409

SEQ ID NO: 51104 - DNA, 1404 bp, Burkholderia mallei ATCC 23344; identical to SEQ ID NO: 28410
  CDS (1)..(1404): transl_table=11

SEQ ID NO: 51105 - protein, 467 aa, Burkholderia mallei ATCC 23344; identical to SEQ ID NO: 28411

SEQ ID NO: 51106 - DNA, 1281 bp, Burkholderia pseudomallei K96243; identical to SEQ ID NO: 28412
  CDS (1)..(1281): transl_table=11

SEQ ID NO: 51107 - protein, 426 aa, Burkholderia pseudomallei K96243; identical to SEQ ID NO: 28413

SEQ ID NO: 51108 - DNA, 1386 bp, Burkholderia pseudomallei K96243; identical to SEQ ID NO: 28414
  CDS (1)..(1386): transl_table=11

SEQ ID NO: 51109 - protein, 461 aa, Burkholderia pseudomallei K96243; identical to SEQ ID NO: 28415

SEQ ID NO: 51110 - DNA, 1458 bp, Burkholderia pseudomallei K96243; identical to SEQ ID NO: 28416
  CDS (1)..(1458): transl_table=11

SEQ ID NO: 51111 - protein, 485 aa, Burkholderia pseudomallei K96243; identical to SEQ ID NO: 28417

SEQ ID NO: 51112 - DNA, 1275 bp, Burkholderia pseudomallei K96243; identical to SEQ ID NO: 28418
  CDS (1)..(1275): transl_table=11

SEQ ID NO: 51113 - protein, 424 aa, Burkholderia pseudomallei K96243; identical to SEQ ID NO: 28419

SEQ ID NO: 51114 - DNA, 1275 bp, Methylococcus capsulatus str. Bath; identical to SEQ ID NO: 28420
  CDS (1)..(1275): transl_table=11

SEQ ID NO: 51115 - protein, 424 aa, Methylococcus capsulatus str. Bath; identical to SEQ ID NO: 28421

SEQ ID NO: 51116 - DNA, 1470 bp, Nocardia farcinica IFM 10152; identical to SEQ ID NO: 28422
  CDS (1)..(1470): transl_table=11

SEQ ID NO: 51117 - protein, 489 aa, Nocardia farcinica IFM 10152; identical to SEQ ID NO: 28423

SEQ ID NO: 51118 - DNA, 1485 bp, Nocardia farcinica IFM 10152; identical to SEQ ID NO: 28424
  CDS (1)..(1485): transl_table=11

SEQ ID NO: 51119 - protein, 494 aa, Nocardia farcinica IFM 10152; identical to SEQ ID NO: 28425

SEQ ID NO: 51120 - DNA, 1323 bp, Haloarcula marismortui ATCC 43049; identical to SEQ ID NO: 28426
  CDS (1)..(1323): transl_table=11

SEQ ID NO: 51121 - protein, 440 aa, Haloarcula marismortui ATCC 43049; identical to SEQ ID NO: 28427

SEQ ID NO: 51122 - DNA, 1200 bp, Geobacillus kaustophilus HTA426; identical to SEQ ID NO: 28428
  CDS (1)..(1200): transl_table=11

SEQ ID NO: 51123 - protein, 399 aa, Geobacillus kaustophilus HTA426; identical to SEQ ID NO: 28429

SEQ ID NO: 51124 - DNA, 1203 bp, Geobacillus kaustophilus HTA426; identical to SEQ ID NO: 28430
  CDS (1)..(1203): transl_table=11

SEQ ID NO: 51125 - protein, 400 aa, Geobacillus kaustophilus HTA426; identical to SEQ ID NO: 28431

SEQ ID NO: 51126 - DNA, 1389 bp, Salmonella enterica subsp. enterica serovar Paratyphi A str. ATCC; identical to SEQ ID NO: 28432
  CDS (1)..(1389): transl_table=11

SEQ ID NO: 51127 - protein, 462 aa, Salmonella enterica subsp. enterica serovar Paratyphi A str. ATCC; identical to SEQ ID NO: 28433

SEQ ID NO: 51128 - DNA, 1332 bp, Idiomarina loihiensis L2TR; identical to SEQ ID NO: 28434
  CDS (1)..(1332): transl_table=11

SEQ ID NO: 51129 - protein, 443 aa, Idiomarina loihiensis L2TR; identical to SEQ ID NO: 28435

SEQ ID NO: 51130 - DNA, 1692 bp, Azoarcus sp. EbN1; identical to SEQ ID NO: 28436
  CDS (1)..(1692): transl_table=11

SEQ ID NO: 51131 - protein, 563 aa, Azoarcus sp. EbN1; identical to SEQ ID NO: 28437

SEQ ID NO: 51132 - DNA, 1377 bp, Azoarcus sp. EbN1; identical to SEQ ID NO: 28438
  CDS (1)..(1377): transl_table=11

SEQ ID NO: 51133 - protein, 458 aa, Azoarcus sp. EbN1; identical to SEQ ID NO: 28439

SEQ ID NO: 51134 - DNA, 1509 bp, Bacillus clausii KSM-K16; identical to SEQ ID NO: 28440
  CDS (1)..(1509): transl_table=11

SEQ ID NO: 51135 - protein, 502 aa, Bacillus clausii KSM-K16; identical to SEQ ID NO: 28441

SEQ ID NO: 51136 - DNA, 1206 bp, Bacillus clausii KSM-K16; identical to SEQ ID NO: 28442
  CDS (1)..(1206): transl_table=11

SEQ ID NO: 51137 - protein, 401 aa, Bacillus clausii KSM-K16; identical to SEQ ID NO: 28443

SEQ ID NO: 51138 - DNA, 1164 bp, Staphylococcus epidermidis RP62A; identical to SEQ ID NO: 28444
  CDS (1)..(1164): transl_table=11

SEQ ID NO: 51139 - protein, 387 aa, Staphylococcus epidermidis RP62A; identical to SEQ ID NO: 28445

SEQ ID NO: 51140 - DNA, 1389 bp, Salmonella enterica subsp. enterica serovar Choleraesuis str; identical to SEQ ID NO: 28446
  CDS (1)..(1389): transl_table=11

SEQ ID NO: 51141 - protein, 462 aa, Salmonella enterica subsp. enterica serovar Choleraesuis str; identical to SEQ ID NO: 28447

SEQ ID NO: 51142 - DNA, 1212 bp, Pseudomonas syringae pv. syringae B728a; identical to SEQ ID NO: 28448
  CDS (1)..(1212): transl_table=11

SEQ ID NO: 51143 - protein, 403 aa, Pseudomonas syringae pv. syringae B728a; identical to SEQ ID NO: 28449

SEQ ID NO: 51144 - DNA, 1158 bp, Staphylococcus haemolyticus JCSC1435; identical to SEQ ID NO: 28450
  CDS (1)..(1158): transl_table=11

SEQ ID NO: 51145 - protein, 385 aa, Staphylococcus haemolyticus JCSC1435; identical to SEQ ID NO: 28451

SEQ ID NO: 51146 - DNA, 1380 bp, Psychrobacter arcticum 273-4; identical to SEQ ID NO: 28452
  CDS (1)..(1380): transl_table=11

SEQ ID NO: 51147 - protein, 459 aa, Psychrobacter arcticum 273-4; identical to SEQ ID NO: 28453

SEQ ID NO: 51148 - DNA, 1212 bp, Pseudomonas syringae pv. phaseolicola 1448A; identical to SEQ ID NO: 28454
  CDS (1)..(1212): transl_table=11

SEQ ID NO: 51149 - protein, 403 aa, Pseudomonas syringae pv. phaseolicola 1448A; identical to SEQ ID NO: 28455

SEQ ID NO: 51150 - DNA, 1215 bp, Dechloromonas aromatica RCB; identical to SEQ ID NO: 28456
  CDS (1)..(1215): transl_table=11

SEQ ID NO: 51151 - protein, 404 aa, Dechloromonas aromatica RCB; identical to SEQ ID NO: 28457

SEQ ID NO: 51152 - DNA, 1290 bp, Ralstonia eutropha JMP134; identical to SEQ ID NO: 28458
  CDS (1)..(1290): transl_table=11

SEQ ID NO: 51153 - protein, 429 aa, Ralstonia eutropha JMP134; identical to SEQ ID NO: 28459

SEQ ID NO: 51154 - DNA, 1386 bp, Ralstonia eutropha JMP134; identical to SEQ ID NO: 28460
  CDS (1)..(1386): transl_table=11

SEQ ID NO: 51155 - protein, 461 aa, Ralstonia eutropha JMP134; identical to SEQ ID NO: 28461

SEQ ID NO: 51156 - DNA, 1362 bp, Shigella sonnei Ss046; identical to SEQ ID NO: 28462
  CDS (1)..(1362): transl_table=11

SEQ ID NO: 51157 - protein, 453 aa, Shigella sonnei Ss046; identical to SEQ ID NO: 28463

SEQ ID NO: 51158 - DNA, 1269 bp, Thiobacillus denitrificans ATCC 25259; identical to SEQ ID NO: 28464
  CDS (1)..(1269): transl_table=11

SEQ ID NO: 51159 - protein, 422 aa, Thiobacillus denitrificans ATCC 25259; identical to SEQ ID NO: 28465

SEQ ID NO: 51160 - DNA, 1677 bp, Thiobacillus denitrificans ATCC 25259; identical to SEQ ID NO: 28466
  CDS (1)..(1677): transl_table=11

SEQ ID NO: 51161 - protein, 558 aa, Thiobacillus denitrificans ATCC 25259; identical to SEQ ID NO: 28467

SEQ ID NO: 51162 - DNA, 1263 bp, Magnetospirillum magnetotacticum MS-1; identical to SEQ ID NO: 28468
  CDS (1)..(1263)

SEQ ID NO: 51163 - protein, 420 aa, Magnetospirillum magnetotacticum MS-1; identical to SEQ ID NO: 28469

SEQ ID NO: 51164 - DNA, 1407 bp, Pseudomonas aeruginosa UCBPP-PA14; identical to SEQ ID NO: 28470
  CDS (1)..(1407)

SEQ ID NO: 51165 - protein, 468 aa, Pseudomonas aeruginosa UCBPP-PA14; identical to SEQ ID NO: 28471

SEQ ID NO: 51166 - DNA, 1326 bp, Burkholderia cepacia R18194; identical to SEQ ID NO: 28472
  CDS (1)..(1326)

SEQ ID NO: 51167 - protein, 441 aa, Burkholderia cepacia R18194; identical to SEQ ID NO: 28473

SEQ ID NO: 51168 - DNA, 1326 bp, Burkholderia cenocepacia AU 1054; identical to SEQ ID NO: 28474
  CDS (1)..(1326): transl_table=11

SEQ ID NO: 51169 - protein, 441 aa, Burkholderia cenocepacia AU 1054; identical to SEQ ID NO: 28475

SEQ ID NO: 51170 - DNA, 1407 bp, Burkholderia pseudomallei S13; identical to SEQ ID NO: 28476
  CDS (1)..(1407)

SEQ ID NO: 51171 - protein, 468 aa, Burkholderia pseudomallei S13; identical to SEQ ID NO: 28477

SEQ ID NO: 51172 - DNA, 1212 bp, Polaromonas sp. JS666; identical to SEQ ID NO: 28478
  CDS (1)..(1212): transl_table=11

SEQ ID NO: 51173 - protein, 403 aa, Polaromonas sp. JS666; identical to SEQ ID NO: 28479

SEQ ID NO: 51174 - DNA, 1320 bp, Geobacter metallireducens GS-15; identical to SEQ ID NO: 28480
  CDS (1)..(1320): transl_table=11

SEQ ID NO: 51175 - protein, 439 aa, Geobacter metallireducens GS-15; identical to SEQ ID NO: 28481

SEQ ID NO: 51176 - DNA, 1230 bp, Nitrobacter hamburgensis X14; identical to SEQ ID NO: 28482
  CDS (1)..(1230): transl_table=11

SEQ ID NO: 51177 - protein, 409 aa, Nitrobacter hamburgensis X14; identical to SEQ ID NO: 28483

SEQ ID NO: 51178 - DNA, 1209 bp, Paracoccus denitrificans PD1222; identical to SEQ ID NO: 28484
  CDS (1)..(1209): transl_table=11

SEQ ID NO: 51179 - protein, 402 aa, Paracoccus denitrificans PD1222; identical to SEQ ID NO: 28485

SEQ ID NO: 51180 - DNA, 1401 bp, Pseudomonas aeruginosa; identical to SEQ ID NO: 28486
  CDS (1)..(1401): transl_table=11

SEQ ID NO: 51181 - protein, 466 aa, Pseudomonas aeruginosa; identical to SEQ ID NO: 28487

SEQ ID NO: 51182 - DNA, 1416 bp, Mycobacterium fortuitum; identical to SEQ ID NO: 28488
  CDS (1)..(1416): transl_table=11

SEQ ID NO: 51183 - protein, 471 aa, Mycobacterium fortuitum; identical to SEQ ID NO: 28489

SEQ ID NO: 51184 - DNA, 1527 bp, Populus tremula x Populus tremuloides; identical to SEQ ID NO: 28490
  CDS (1)..(1527)

SEQ ID NO: 51185 - protein, 508 aa, Populus tremula x Populus tremuloides; identical to SEQ ID NO: 28491

SEQ ID NO: 51186 - DNA, 1602 bp, Pseudomonas sp; identical to SEQ ID NO: 28492
  CDS (1)..(1602): transl_table=11

SEQ ID NO: 51187 - protein, 533 aa, Pseudomonas sp; identical to SEQ ID NO: 28493

SEQ ID NO: 51188 - DNA, 1302 bp, Halomonas maura; identical to SEQ ID NO: 28494
  CDS (1)..(1302): transl_table=11

SEQ ID NO: 51189 - protein, 433 aa, Halomonas maura; identical to SEQ ID NO: 28495

SEQ ID NO: 51190 - DNA, 1254 bp, Rhizobium sp; identical to SEQ ID NO: 28496
  CDS (1)..(1254): transl_table=11

SEQ ID NO: 51191 - protein, 417 aa, Rhizobium sp; identical to SEQ ID NO: 28497

SEQ ID NO: 51192 - DNA, 1311 bp, Halobacterium mediterranei; identical to SEQ ID NO: 28498
  CDS (1)..(1311): transl_table=11

SEQ ID NO: 51193 - protein, 436 aa, Halobacterium mediterranei; identical to SEQ ID NO: 28499

SEQ ID NO: 51194 - DNA, 1650 bp, Physcomitrella patens; identical to SEQ ID NO: 28500
  CDS (1)..(1650)

SEQ ID NO: 51195 - protein, 549 aa, Physcomitrella patens; identical to SEQ ID NO: 28501

SEQ ID NO: 51196 - DNA, 1353 bp, Corynebacterium glutamicum; identical to SEQ ID NO: 28502
  CDS (1)..(1353): transl_table=11

SEQ ID NO: 51197 - protein, 450 aa, Corynebacterium glutamicum; identical to SEQ ID NO: 28503

SEQ ID NO: 51198 - DNA, 1284 bp, Paracoccus halodenitrificans; identical to SEQ ID NO: 28504
  CDS (1)..(1284): transl_table=11

SEQ ID NO: 51199 - protein, 427 aa, Paracoccus halodenitrificans; identical to SEQ ID NO: 28505

SEQ ID NO: 51200 - DNA, 1593 bp, Paracoccus halodenitrificans; identical to SEQ ID NO: 28506
  CDS (1)..(1593): transl_table=11

SEQ ID NO: 51201 - protein, 530 aa, Paracoccus halodenitrificans; identical to SEQ ID NO: 28507

SEQ ID NO: 51202 - DNA, 2718 bp, Paracoccus pantotrophus; identical to SEQ ID NO: 28508
  CDS (1)..(2718): transl_table=11

SEQ ID NO: 51203 - protein, 905 aa, Paracoccus pantotrophus; identical to SEQ ID NO: 28509

SEQ ID NO: 51204 - DNA, 1266 bp, Pseudomonas fluorescens; identical to SEQ ID NO: 28510
  CDS (1)..(1266): transl_table=11

SEQ ID NO: 51205 - protein, 421 aa, Pseudomonas fluorescens; identical to SEQ ID NO: 28511

SEQ ID NO: 51206 - DNA, 1332 bp, Thermus thermophilus; identical to SEQ ID NO: 28512
  CDS (1)..(1332): transl_table=11

SEQ ID NO: 51207 - protein, 443 aa, Thermus thermophilus; identical to SEQ ID NO: 28513

SEQ ID NO: 51208 - DNA, 1308 bp, Thermus thermophilus; identical to SEQ ID NO: 28514
  CDS (1)..(1308): transl_table=11

SEQ ID NO: 51209 - protein, 435 aa, Thermus thermophilus; identical to SEQ ID NO: 28515

SEQ ID NO: 51210 - DNA, 1449 bp, Cylindrotheca fusiformis; identical to SEQ ID NO: 28516
  CDS (1)..(1449)

SEQ ID NO: 51211 - protein, 482 aa, Cylindrotheca fusiformis; identical to SEQ ID NO: 28517

SEQ ID NO: 51212 - DNA, 1449 bp, Cylindrotheca fusiformis; identical to SEQ ID NO: 28518
  CDS (1)..(1449)

SEQ ID NO: 51213 - protein, 482 aa, Cylindrotheca fusiformis; identical to SEQ ID NO: 28519

SEQ ID NO: 51214 - DNA, 1449 bp, Cylindrotheca fusiformis; identical to SEQ ID NO: 28520
  CDS (1)..(1449)

SEQ ID NO: 51215 - protein, 482 aa, Cylindrotheca fusiformis; identical to SEQ ID NO: 28521

SEQ ID NO: 51216 - DNA, 1212 bp, Pseudomonas aeruginosa; identical to SEQ ID NO: 28522
  CDS (1)..(1212): transl_table=11

SEQ ID NO: 51217 - protein, 403 aa, Pseudomonas aeruginosa; identical to SEQ ID NO: 28523

SEQ ID NO: 51218 - DNA, 1389 bp, Escherichia coli; identical to SEQ ID NO: 28524
  CDS (1)..(1389): transl_table=11

SEQ ID NO: 51219 - protein, 462 aa, Escherichia coli; identical to SEQ ID NO: 28525

SEQ ID NO: 51220 - DNA, 1389 bp, Salmonella typhimurium; identical to SEQ ID NO: 28526
  CDS (1)..(1389): transl_table=11

SEQ ID NO: 51221 - protein, 462 aa, Salmonella typhimurium; identical to SEQ ID NO: 28527

SEQ ID NO: 51222 - DNA, 1266 bp, Bacillus subtilis; identical to SEQ ID NO: 28528
  CDS (1)..(1266): transl_table=11

SEQ ID NO: 51223 - protein, 421 aa, Bacillus subtilis; identical to SEQ ID NO: 28529

SEQ ID NO: 51224 - DNA, 21 bp, Artificial sequence
  (1)..(21): primer
atgagtcactcatccgccccc

SEQ ID NO: 51225 - DNA, 27 bp, Artificial sequence
  (1)..(27): primer
ttattttttagaatgccgaccatatac

SEQ ID NO: 51226 - protein, 512 aa, Artificial sequence; identical to SEQ ID NO: 28532
  Variant (2)..(9): xaa in position 2 to 9 is any amino acid
  Variant (11)..(11): xaa in position 11 is any amino acid
  Variant (13)..(13): xaa in position 13 is any amino acid
  Variant (16)..(16): xaa in position 16 is any amino acid
  Variant (18)..(22): xaa in position 18 to 22 is any amino acid
  Variant (23)..(24): xaa in position 23 to 24 is any or no amino acid
  Variant (26)..(38): xaa in position 26 to 38 is any amino acid
  Variant (39)..(49): xaa in position 39 to 49 is any or no amino acid
  Variant (51)..(51): xaa in position 51 is any amino acid
  Variant (53)..(54): xaa in position 53 to 54 is any amino acid
  Variant (55)..(55): xaa in position 55 is any or no amino acid
  Variant (57)..(57): xaa in position 57 is any amino acid
  Variant (60)..(60): xaa in position 60 is any amino acid
  Variant (64)..(72): xaa in position 64 to 72 is any amino acid
  Variant (74)..(74): xaa in position 74 is any amino acid
  Variant (76)..(86): xaa in position 76 to 86 is any amino acid
  Variant (88)..(101): xaa in position 88 to 101 is any amino acid
  Variant (102)..(110): xaa in position 102 to 110 is any or no amino acid
  Variant (112)..(112): xaa in position 112 is any amino acid
  Variant (113)..(113): xaa in position 113 is any or no amino acid
  Variant (115)..(117): xaa in position 115 to 117 is any amino acid
  Variant (119)..(119): xaa in position 119 is any amino acid
  Variant (123)..(123): xaa in position 123 is any amino acid
  Variant (126)..(127): xaa in position 126 to 127 is any amino acid
  Variant (129)..(133): xaa in position 129 to 133 is any amino acid
  Variant (137)..(140): xaa in position 137 to 140 is any amino acid
  Variant (142)..(142): xaa in position 142 is any amino acid
  Variant (144)..(144): xaa in position 144 is any amino acid
  Variant (147)..(147): xaa in position 147 is any amino acid
  Variant (150)..(150): xaa in position 150 is any amino acid
  Variant (151)..(151): xaa in position 151 is any or no amino acid
  Variant (153)..(153): xaa in position 153 is any amino acid
  Variant (155)..(156): xaa in position 155 to 156 is any amino acid
  Variant (158)..(162): xaa in position 158 to 162 is any amino acid
  Variant (164)..(164): xaa in position 164 is any or no amino acid
  Variant (166)..(181): xaa in position 166 to 181 is any amino acid
  Variant (182)..(210): xaa in position 182 to 210 is any or no amino acid
  Variant (212)..(212): xaa in position 212 is any amino acid
  Variant (214)..(215): xaa in position 214 to 215 is any amino acid
  Variant (217)..(243): xaa in position 217 to 243 is any amino acid
  Variant (244)..(314): xaa in position 244 to 314 is any or no amino acid
  Variant (316)..(320): xaa in position 316 to 320 is any amino acid
  Variant (322)..(324): xaa in position 322 to 324 is any amino acid
  Variant (327)..(327): xaa in position 327 is any amino acid
  Variant (331)..(342): xaa in position 331 to 342 is any amino acid
  Variant (344)..(357): xaa in position 344 to 357 is any amino acid
  Variant (358)..(377): xaa in position 358 to 377 is any or no amino acid
  Variant (379)..(381): xaa in position 379 to 381 is any amino acid
  Variant (383)..(384): xaa in position 383 to 384 is any amino acid
  Variant (387)..(387): xaa in position 387 is any amino acid
  Variant (392)..(392): xaa in position 392 is any amino acid
  Variant (395)..(432): xaa in position 395 to 432 is any amino acid
  Variant (433)..(455): xaa in position 433 to 455 is any or no amino acid
  Variant (457)..(457): xaa in position 457 is any amino acid
  Variant (459)..(459): xaa in position 459 is any amino acid
  Variant (462)..(462): xaa in position 462 is any amino acid
  Variant (464)..(465): xaa in position 464 to 465 is any amino acid
  Variant (467)..(469): xaa in position 467 to 469 is any amino acid
  Variant (471)..(474): xaa in position 471 to 474 is any amino acid
  Variant (475)..(497): xaa in position 475 to 497 is any or no amino acid
  Variant (499)..(501): xaa in position 499 to 501 is any amino acid
  Variant (503)..(507): xaa in position 503 to 507 is any amino acid
  Variant (510)..(510): xaa in position 510 is any amino acid

SEQ ID NO: 51227 - protein, 19 aa, Artificial sequence
  Variant (2)..(10): xaa in position 2 to 10 is any amino acid
  Variant (11)..(11): xaa in position 11 is any or no amino acid
  Variant (13)..(13): xaa in position 13 is any amino acid
  Variant (14)..(14): xaa in position 14 is Ala, Ile or Val
  Variant (16)..(16): xaa in position 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Gly or Ser
LXXXXXXXXXXFXXWXXXX

SEQ ID NO: 51228 - protein, 45 aa, Artificial sequence; identical to SEQ ID NO: 28534
  Variant (2)..(3): xaa in position 2 to 3 is any amino acid
  Variant (4)..(4): xaa in position 4 is any or no amino acid
  Variant (6)..(6): xaa in position 6 is Ala, Gly or Thr
  Variant (7)..(7): xaa in position 7 is any amino acid
  Variant (9)..(9): xaa in position 9 is Ala, Gly or Ser
  Variant (10)..(12): xaa in position 10 to 12 is any amino acid
  Variant (13)..(13): xaa in position 13 is Ala, Gly, Pro, Ser or Thr
  Variant (14)..(15): xaa in position 14 to 15 is any amino acid
  Variant (16)..(16): xaa in position 16 is Ala, Gly, Asn, Pro or Ser
  Variant (17)..(18): xaa in position 17 to 18 is any amino acid
  Variant (19)..(19): xaa in position 19 is Phe, His or Tyr
  Variant (20)..(24): xaa in position 20 to 24 is any amino acid
  Variant (26)..(26): xaa in position 26 is any amino acid
  Variant (27)..(27): xaa in position 27 is Ala, Ser or Val
  Variant (28)..(28): xaa in position 28 is any amino acid
  Variant (30)..(31): xaa in position 30 to 31 is any amino acid
  Variant (32)..(33): xaa in position 32 to 33 is any or no amino acid
  Variant (35)..(38): xaa in position 35 to 38 is any amino acid
  Variant (39)..(39): xaa in position 39 is Ala, Gly or Val
  Variant (40)..(44): xaa in position 40 to 44 is any amino acid
  Variant (45)..(45): xaa in position 45 is Phe, Ile, Leu or Val

SEQ ID NO: 51229 - protein, 24 aa, Artificial sequence
  Variant (2)..(3): xaa in position 2 to 3 is any amino acid
  Variant (4)..(4): xaa in position 4 is any or no amino acid
  Variant (6)..(6): xaa in position 6 is any or no amino acid
  Variant (8)..(8): xaa in position 8 is Ala, Gly or Ser
  Variant (9)..(9): xaa in position 9 is Phe or Tyr
  Variant (10)..(10): xaa in position 10 is Ala, Ile or Val
  Variant (11)..(11): xaa in position 11 is Ala or Gly
  Variant (12)..(12): xaa in position 12 is any amino acid
  Variant (13)..(13): xaa in position 13 is Ala, Gly, Ser or Thr
  Variant (14)..(15): xaa in position 14 to 15 is any amino acid
  Variant (16)..(16): xaa in position 16 is Phe, Leu, Met or Val
  Variant (17)..(17): xaa in position 17 is Ala, Gly, Pro, Ser or Thr
  Variant (18)..(23): xaa in position 18 to 23 is any amino acid
  Variant (24)..(24): xaa in position 24 is Phe or Tyr
YXXXFXGXXXXXXXXXXXXXXXXX

SEQ ID NO: 51230 - protein, 33 aa, Artificial sequence; identical to SEQ ID NO: 28536
  Variant (2)..(19): xaa in position 2 to 19 is any amino acid
  Variant (20)..(22): xaa in position 20 to 22 is any or no amino acid
  Variant (24)..(24): xaa in position 24 is Phe, Ile, Leu, Met or Val
  Variant (25)..(25): xaa in position 25 is any amino acid
  Variant (26)..(26): xaa in position 26 is Ala, Gly or Ser
  Variant (27)..(28): xaa in position 27 to 28 is any amino acid
  Variant (30)..(30): xaa in position 30 is Ala, Cys, Gly, Asn, Ser or Thr
  Variant (31)..(31): xaa in position 31 is any amino acid
  Variant (33)..(33): xaa in position 33 is Ala, Gly, Pro or Ser

SEQ ID NO: 51231 - DNA, 2376 bp, Saccharomyces cerevisiae; identical to SEQ ID NO: 35553
  CDS (1)..(2376)

SEQ ID NO: 51232 - protein, 791 aa, Saccharomyces cerevisiae; identical to SEQ ID NO: 35554

SEQ ID NO: 51233 - DNA, 717 bp, Danio rerio; identical to SEQ ID NO: 35555
  CDS (1)..(717)

SEQ ID NO: 51234 - protein, 238 aa, Danio rerio; identical to SEQ ID NO: 35556

SEQ ID NO: 51235 - DNA, 1506 bp, Caenorhabditis elegans; identical to SEQ ID NO: 35557
  CDS (1)..(1506)

SEQ ID NO: 51236 - protein, 501 aa, Caenorhabditis elegans; identical to SEQ ID NO: 35558

SEQ ID NO: 51237 - DNA, 684 bp, Caenorhabditis elegans; identical to SEQ ID NO: 35559
  CDS (1)..(684)

SEQ ID NO: 51238 - protein, 227 aa, Caenorhabditis elegans; identical to SEQ ID NO: 35560

SEQ ID NO: 51239 - DNA, 720 bp, Homo sapiens; identical to SEQ ID NO: 35561
  CDS (1)..(720)

SEQ ID NO: 51240 - protein, 239 aa, Homo sapiens; identical to SEQ ID NO: 35562

SEQ ID NO: 51241 - DNA, 1272 bp, Leptospira interrogans serovar Lai str. 56601; identical to SEQ ID NO: 35563
  CDS (1)..(1272): transl_table=11

SEQ ID NO: 51242 - protein, 423 aa, Leptospira interrogans serovar Lai str. 56601; identical to SEQ ID NO: 35564

SEQ ID NO: 51243 - DNA, 1497 bp, Leptospira interrogans serovar Lai str. 56601; identical to SEQ ID NO: 35565
  CDS (1)..(1497): transl_table=11

SEQ ID NO: 51244 - protein, 498 aa, Leptospira interrogans serovar Lai str. 56601; identical to SEQ ID NO: 35566

SEQ ID NO: 51245 - DNA, 1287 bp, Leptospira interrogans serovar Lai str. 56601; identical to SEQ ID NO: 35567
  CDS (1)..(1287): transl_table=11

SEQ ID NO: 51246 - protein, 428 aa, Leptospira interrogans serovar Lai str. 56601; identical to SEQ ID NO: 35568

SEQ ID NO: 51247 - DNA, 870 bp, Leptospira interrogans serovar Lai str. 56601; identical to SEQ ID NO: 35569
  CDS (1)..(870): transl_table=11

SEQ ID NO: 51248 - protein, 289 aa, Leptospira interrogans serovar Lai str. 56601; identical to SEQ ID NO: 35570

SEQ ID NO: 51249 - DNA, 1281 bp, Leptospira interrogans serovar Lai str. 56601; identical to SEQ ID NO: 35571
  CDS (1)..(1281): transl_table=11

SEQ ID NO: 51250 - protein, 426 aa, Leptospira interrogans serovar Lai str. 56601; identical to SEQ ID NO: 35572

SEQ ID NO: 51251 - DNA, 1227 bp, Leptospira interrogans serovar Lai str. 56601; identical to SEQ ID NO: 35573
  CDS (1)..(1227): transl_table=11

SEQ ID NO: 51252 - protein, 408 aa, Leptospira interrogans serovar Lai str. 56601; identical to SEQ ID NO: 35574

SEQ ID NO: 51253 - DNA, 1134 bp, Leptospira interrogans serovar Lai str. 56601; identical to SEQ ID NO: 35575
  CDS (1)..(1134): transl_table=11

SEQ ID NO: 51254 - protein, 377 aa, Leptospira interrogans serovar Lai str. 56601; identical to SEQ ID NO: 35576

SEQ ID NO: 51255 - DNA, 936 bp, Leptospira interrogans serovar Lai str. 56601; identical to SEQ ID NO: 35577
  CDS (1)..(936): transl_table=11

SEQ ID NO: 51256 - protein, 311 aa, Leptospira interrogans serovar Lai str. 56601; identical to SEQ ID NO: 35578

SEQ ID NO: 51257 - DNA, 990 bp, Leptospira interrogans serovar Lai str. 56601; identical to SEQ ID NO: 35579
  CDS (1)..(990): transl_table=11

SEQ ID NO: 51258 - protein, 329 aa, Leptospira interrogans serovar Lai str. 56601; identical to SEQ ID NO: 35580

SEQ ID NO: 51259 - DNA, 1458 bp, Caenorhabditis elegans; identical to SEQ ID NO: 35581
  CDS (1)..(1458)

SEQ ID NO: 51260 - protein, 485 aa, Caenorhabditis elegans; identical to SEQ ID NO: 35582

SEQ ID NO: 51261 - DNA, 2160 bp, Eremothecium gossypii; identical to SEQ ID NO: 35583
  CDS (1)..(2160)

SEQ ID NO: 51262 - protein, 719 aa, Eremothecium gossypii; identical to SEQ ID NO: 35584

SEQ ID NO: 51263 - DNA, 3123 bp, Magnaporthe grisea 70-15; identical to SEQ ID NO: 35585
  CDS (1)..(3123)

SEQ ID NO: 51264 - protein, 1040 aa, Magnaporthe grisea 70-15; identical to SEQ ID NO: 35586

SEQ ID NO: 51265 - DNA, 2940 bp, Gibberella zeae PH-1; identical to SEQ ID NO: 35587
  CDS (1)..(2940)

SEQ ID NO: 51266 - protein, 979 aa, Gibberella zeae PH-1; identical to SEQ ID NO: 35588

SEQ ID NO: 51267 - DNA, 2943 bp, Aspergillus nidulans FGSC A4; identical to SEQ ID NO: 35589
  CDS (1)..(2943)

SEQ ID NO: 51268 - protein, 980 aa, Aspergillus nidulans FGSC A4; identical to SEQ ID NO: 35590

SEQ ID NO: 51269 - DNA, 2607 bp, Candida glabrata CBS138; identical to SEQ ID NO: 35591
  CDS (1)..(2607)

SEQ ID NO: 51270 - protein, 868 aa, Candida glabrata CBS138; identical to SEQ ID NO: 35592

SEQ ID NO: 51271 - DNA, 2379 bp, Kluyveromyces lactis NRRL Y-1140; identical to SEQ ID NO: 35593
  CDS (1)..(2379)

SEQ ID NO: 51272 - protein, 792 aa, Kluyveromyces lactis NRRL Y-1140; identical to SEQ ID NO: 35594

SEQ ID NO: 51273 - DNA, 2301 bp, Yarrowia lipolytica CLIB99; identical to SEQ ID NO: 35595
  CDS (1)..(2301)

SEQ ID NO: 51274 - protein, 766 aa, Yarrowia lipolytica CLIB99; identical to SEQ ID NO: 35596

SEQ ID NO: 51275 - DNA, 2466 bp, Candida albicans SC5314; identical to SEQ ID NO: 35597
  CDS (1)..(2466): transl_table=12

SEQ ID NO: 51276 - protein, 821 aa, Candida albicans SC5314; identical to SEQ ID NO: 35598

SEQ ID NO: 51277 - DNA, 1137 bp, Leptospira interrogans serovar Copenhageni str. Fiocruz L1-130; identical to SEQ ID NO: 35599
  CDS (1)..(1137): transl_table=11

SEQ ID NO: 51278 - protein, 378 aa, Leptospira interrogans serovar Copenhageni str. Fiocruz L1-130; identical to SEQ ID NO: 35600

SEQ ID NO: 51279 - DNA, 1209 bp, Leptospira interrogans serovar Copenhageni str. Fiocruz L1-130; identical to SEQ ID NO: 35601
  CDS (1)..(1209): transl_table=11

SEQ ID NO: 51280 - protein, 402 aa, Leptospira interrogans serovar Copenhageni str. Fiocruz L1-130; identical to SEQ ID NO: 35602

SEQ ID NO: 51281 - DNA, 1566 bp, Leptospira interrogans serovar Copenhageni str. Fiocruz L1-130; identical to SEQ ID NO: 35603
  CDS (1)..(1566): transl_table=11

SEQ ID NO: 51282 - protein, 521 aa, Leptospira interrogans serovar Copenhageni str. Fiocruz L1-130; identical to SEQ ID NO: 35604

SEQ ID NO: 51283 - DNA, 1134 bp, Leptospira interrogans serovar Copenhageni str. Fiocruz L1-130; identical to SEQ ID NO: 35605
  CDS (1)..(1134): transl_table=11

SEQ ID NO: 51284 - protein, 377 aa, Leptospira interrogans serovar Copenhageni str. Fiocruz L1-130; identical to SEQ ID NO: 35606

SEQ ID NO: 51285 - DNA, 1281 bp, Leptospira interrogans serovar Copenhageni str. Fiocruz L1-130; identical to SEQ ID NO: 35607
  CDS (1)..(1281): transl_table=11

SEQ ID NO: 51286 - protein, 426 aa, Leptospira interrogans serovar Copenhageni str. Fiocruz L1-130; identical to SEQ ID NO: 35608

SEQ ID NO: 51287 - DNA, 1719 bp, Leptospira interrogans serovar Copenhageni str. Fiocruz L1-130; identical to SEQ ID NO: 35609
  CDS (1)..(1719): transl_table=11

SEQ ID NO: 51288 - protein, 572 aa, Leptospira interrogans serovar Copenhageni str. Fiocruz L1-130; identical to SEQ ID NO: 35610

SEQ ID NO: 51289 - DNA, 1272 bp, Leptospira interrogans serovar Copenhageni str. Fiocruz L1-130; identical to SEQ ID NO: 35611
  CDS (1)..(1272): transl_table=11

SEQ ID NO: 51290 - protein, 423 aa, Leptospira interrogans serovar Copenhageni str. Fiocruz L1-130; identical to SEQ ID NO: 35612

SEQ ID NO: 51291 - DNA, 819 bp, Leptospira interrogans serovar Copenhageni str. Fiocruz L1-130; identical to SEQ ID NO: 35613
  CDS (1)..(819): transl_table=11

SEQ ID NO: 51292 - protein, 272 aa, Leptospira interrogans serovar Copenhageni str. Fiocruz L1-130; identical to SEQ ID NO: 35614

SEQ ID NO: 51293 - DNA, 1320 bp, Caenorhabditis briggsae; identical to SEQ ID NO: 35615
  CDS (1)..(1320)

SEQ ID NO: 51294 - protein, 439 aa, Caenorhabditis briggsae; identical to SEQ ID NO: 35616

SEQ ID NO: 51295 - DNA, 720 bp, Homo sapiens; identical to SEQ ID NO: 35617
  CDS (1)..(720)

SEQ ID NO: 51296 - protein, 239 aa, Homo sapiens; identical to SEQ ID NO: 35618

SEQ ID NO: 51297 - DNA, 720 bp, Homo sapiens; identical to SEQ ID NO: 35619
  CDS (1)..(720)

SEQ ID NO: 51298 - protein, 239 aa, Homo sapiens; identical to SEQ ID NO: 35620

SEQ ID NO: 51299 - DNA, 24 bp, Artificial sequence
  (1)..(24): primer
atggtagcgacatcttcaaagagg

SEQ ID NO: 51300 - DNA, 23 bp, Artificial sequence
  (1)..(23): primer
ttactccggagagttggcgctta

SEQ ID NO: 51301 - protein, 380 aa, Artificial sequence; identical to SEQ ID NO: 35623
  Variant (2)..(9): xaa in position 2 to 9 is any amino acid
  Variant (10)..(11): xaa in position 10 to 11 is any or no amino acid
  Variant (13)..(13): xaa in position 13 is any amino acid
  Variant (15)..(18): xaa in position 15 to 18 is any amino acid
  Variant (20)..(21): xaa in position 20 to 21 is any amino acid
  Variant (24)..(24): xaa in position 24 is any amino acid
  Variant (27)..(28): xaa in position 27 to 28 is any amino acid
  Variant (30)..(31): xaa in position 30 to 31 is any amino acid
  Variant (32)..(33): xaa in position 32 to 33 is any or no amino acid
  Variant (35)..(36): xaa in position 35 to 36 is any amino acid
  Variant (38)..(38): xaa in position 38 is any amino acid
  Variant (40)..(41): xaa in position 40 to 41 is any amino acid
  Variant (43)..(45): xaa in position 43 to 45 is any or no amino acid
  Variant (47)..(52): xaa in position 47 to 52 is any amino acid
  Variant (53)..(53): xaa in position 53 is any or no amino acid
  Variant (55)..(59): xaa in position 55 to 59 is any amino acid
  Variant (61)..(62): xaa in position 61 to 62 is any amino acid
  Variant (64)..(64): xaa in position 64 is any amino acid
  Variant (66)..(67): xaa in position 66 to 67 is any amino acid
  Variant (69)..(75): xaa in position 69 to 75 is any amino acid
  Variant (76)..(90): xaa in position 76 to 90 is any or no amino acid
  Variant (93)..(94): xaa in position 93 to 94 is any amino acid
  Variant (96)..(97): xaa in position 96 to 97 is any amino acid
  Variant (99)..(105): xaa in position 99 to 105 is any amino acid
  Variant (106)..(128): xaa in position 106 to 128 is any or no amino acid
  Variant (130)..(137): xaa in position 130 to 137 is any amino acid
  Variant (139)..(143): xaa in position 139 to 143 is any amino acid
  Variant (145)..(151): xaa in position 145 to 151 is any amino acid
  Variant (153)..(166): xaa in position 153 to 166 is any amino acid
  Variant (167)..(214): xaa in position 167 to 214 is any or no amino acid
  Variant (216)..(217): xaa in position 216 to 217 is any amino acid
  Variant (219)..(219): xaa in position 219 is any amino acid
  Variant (221)..(221): xaa in position 221 is any amino acid
  Variant (222)..(222): xaa in position 222 is any or no amino acid
  Variant (224)..(228): xaa in position 224 to 228 is any amino acid
  Variant (229)..(265): xaa in position 229 to 265 is any or no amino acid
  Variant (267)..(268): xaa in position 267 to 268 is any amino acid
  Variant (270)..(271): xaa in position 270 to 271 is any amino acid
  Variant (273)..(274): xaa in position 273 to 274 is any amino acid
  Variant (276)..(296): xaa in position 276 to 296 is any amino acid
  Variant (297)..(311): xaa in position 297 to 311 is any or no amino acid
  Variant (313)..(314): xaa in position 313 to 314 is any amino acid
  Variant (316)..(337): xaa in position 316 to 337 is any amino acid
  Variant (338)..(364): xaa in position 338 to 364 is any or no amino acid
  Variant (366)..(378): xaa in position 366 to 378 is any amino acid
  Variant (379)..(379): xaa in position 379 is any or no amino acid

SEQ ID NO: 51302 - protein, 46 aa, Artificial sequence; identical to SEQ ID NO: 35624
  Variant (2)..(4): xaa in position 2 to 4 is any or no amino acid
  Variant (6)..(13): xaa in position 6 to 13 is any amino acid
  Variant (14)..(14): xaa in position 14 is any or no amino acid
  Variant (16)..(17): xaa in position 16 to 17 is any amino acid
  Variant (18)..(18): xaa in position 18 is Phe, Ile, Leu or Val
  Variant (19)..(19): xaa in position 19 is any amino acid
  Variant (20)..(20): xaa in position 20 is Ile, Leu or Val
  Variant (21)..(22): xaa in position 21 to 22 is any amino acid
  Variant (24)..(24): xaa in position 24 is any amino acid
  Variant (25)..(25): xaa in position 25 is Phe, Ile or Leu
  Variant (26)..(27): xaa in position 26 to 27 is any amino acid
  Variant (28)..(28): xaa in position 28 is Phe, Ile, Leu or Val
  Variant (29)..(29): xaa in position 29 is Pro or Ser
  Variant (30)..(31): xaa in position 30 to 31 is any amino acid
  Variant (32)..(32): xaa in position 32 is Ile, Leu or Val
  Variant (33)..(37): xaa in position 33 to 37 is any amino acid
  Variant (39)..(45): xaa in position 39 to 45 is any amino acid
  Variant (46)..(46): xaa in position 46 is Asn or Ser

SEQ ID NO: 51303 - DNA, 705 bp, Escherichia coli
  CDS (1)..(705)
atggaattttctccccctctacagcgcgcgacgctaattcagcgttacaaacgttttttagccgatgtgatcacacccgatggtcgcgaattaacgctacactgcccgaatacgggtgcgatgaccggttgtgcaacgcctggcgataccgtctggtattcgacttcagacaacaccaaacggaaatacccacacacctgggaattaactcaaagccagagcggcgcatttatttgcgtcaacacgctttgggctaacaggttgacgaaagaggctatccttaatgaatcaatttcagaactgtcaggctatagctcgctgaaaagcgaagtaaaatacggcgcagaacgcagccgtattgactttatgttgcaggcggattcgcgtccagactgctatattgaagtgaaatcggttacgttagcggagaacgaacagggatattttcccgatgcggtcactgaacgaggtcagaaacaccttcgggagttgatgagcgtagcggctgaaggccagcgtgcggttatctttttcgccgtgctgcattcagccattacacggttttcacccgcgcgccacatcgatgagaaatacgcgcaactattgtcagaagctcaacagaggggggtagaaattctggcttacaaagcggaaatttctgctgaaggcatggctcttaaaaaatcactgccggttacattgtag

SEQ ID NO: 51304 - protein, 234 aa, Escherichia coli
MEFSPPLQRATLIQRYKRFLADVITPDGRELTLHCPNTGAMTGCATPGDTVWYSTSDNTKRKYPHTWELTQSQSGAFICVNTLWANRLTKEAILNESISELSGYSSLKSEVKYGAERSRIDFMLQADSRPDCYIEVKSVTLAENEQGYFPDAVTERGQKHLRELMSVAAEGQRAVIFFAVLHSAITRFSPARHIDEKYAQLLSEAQQRGVEILAYKAEISAEGMALKKSLPVTL

SEQ ID NO: 51305 - DNA, 636 bp, Thermoplasma acidophilum DSM 1728
  CDS (1)..(636): transl_table=11
ttgaagaggatcaacaggttcgccgtacagatcgatgtggaaggcaggacggaactggcgcatctgcacgatcctggcaggcttctggagatcgtttatcccggaaatgaggtccttgtgaggaggacggatggcccaaagctgaaatggaggattgagttcgggaagatcaacggaagatacgtgttaatagattccgggctgcactcggatatagccagaaggttccttcccgagggcgcggttccagaggtcagggttggaaggaaacgaatagatttcaggtacggggacgattacatagaggtcaaggggtgcaccctcatggcgaacggaatcgccatgtttccagacgctcctacgaagaggggcctggaacacctgaagacgctcgaaacgctcgcctcatcaggatacagatcgcatgtaatgatgataataaccagggacgacgtgagatgcttctaccccaacttcgaaaccgatcccaagttcgcagaggcgttcctgaggctggtgccggcatacgtgaaggcacacttcctgaccttcggcttcgacggcctttacctgaggtatgccggcagcatcggcctctgcgctgatgtcggtcatggcaccaacggaagattgtga

SEQ ID NO: 51306 - protein, 211 aa, Thermoplasma acidophilum DSM 1728
MKRINRFAVQIDVEGRTELAHLHDPGRLLEIVYPGNEVLVRRTDGPKLKWRIEFGKINGRYVLIDSGLHSDIARRFLPEGAVPEVRVGRKRIDFRYGDDYIEVKGCTLMANGIAMFPDAPTKRGLEHLKTLETLASSGYRSHVMMIITRDDVRCFYPNFETDPKFAEAFLRLVPAYVKAHFLTFGFDGLYLRYAGSIGLCADVGHGTNGRL

SEQ ID NO: 51307 - DNA, 837 bp, Prochlorococcus marinus str. MIT 9313
  CDS (1)..(837): transl_table=11
ttgggcctcagaccatctgatcatttagcagcattctcaagccctgcaagcatccccatgaccaaggccatcccggaaggattgttagggagtccactgctcacattcccaccactcgatgaaggaatattggtgaagcgctacaagcgcttccttgccgatgtggagctagtcagcggcgaaatcgtgacagcccactgcgccaacacaggccccatgactggtgttcttcatcctggaggcagagtgagaatccgccatgcgccttctcccaagcgcaagttggcctggacatgggagcaagcggaggcacccagcgcccagggcggcctctgctgggtgggtatcaacacagccttggccaatagcctgatcagagcagcgattgaagccggacacctcaagcaagtcctcggtccgatcgcagcaatccgtgcggaagtgacttatggaagcaaccgacgcagccgcattgacctgtttttaacccctgatgccaattgctccgacaccagacccatttacttagaggtcaagaacaccacctggatcgaagactccttagccctctttcccgacacggtgacagaacgagggcaaaaacatctcaaagagctaatcggtgtgctgccagagtccagagcagtcttggtgccctgcctcagccgccacgatgtccaagcgttcgccccaggggatagcgcagaccctcgctatggcgaactctttcgtctggctcttacagctggcgtggaagtcattccctgttgcttcggatttcacctcgacaagatcacctgggaaggccttaggcctaccaagacgacacagagttga

SEQ ID NO: 51308 - protein, 278 aa, Prochlorococcus marinus str. MIT 9313
MGLRPSDHLAAFSSPASIPMTKAIPEGLLGSPLLTFPPLDEGILVKRYKRFLADVELVSGEIVTAHCANTGPMTGVLHPGGRVRIRHAPSPKRKLAWTWEQAEAPSAQGGLCWVGINTALANSLIRAAIEAGHLKQVLGPIAAIRAEVTYGSNRRSRIDLFLTPDANCSDTRPIYLEVKNTTWIEDSLALFPDTVTERGQKHLKELIGVLPESRAVLVPCLSRHDVQAFAPGDSADPRYGELFRLALTAGVEVIPCCFGFHLDKITWEGLRPTKTTQS

SEQ ID NO: 51309 - DNA, 780 bp, Desulfotalea psychrophila LSv54
  CDS (1)..(780): transl_table=11
gtgccaccctctttagcaccaaggcaattgatatgcaatataaattttacttatagaagagatacttatatggacttctcacaaggactcaccccggcaagactcatcagaagatataaacggtttttagcggatgtagagatcgaagatggtacgatcataacagtctactgccccaatacgggcaccatgcgtacctgctcaacacctaacagccccgttatgctctccatctccgacaaccccaagagaaaatacgcccacaccctggagatgatctttgaaaatcacacttggataggagttaacacagggcggacaaatagcatcgtcgcaaaggccattctcaatggcagtatagctgaattttctggagctaccaaggtgcagcgagagataaccgtctccaagggcagtcgattagacctccttgtagaccatgcggatcaaaaaagctatattgaaattaaaaattgttccatggcggaaaatcgaagggcaatgttccccgatgcagtcactgcccgcggcacaaagcacctacgagagcttatcaaattagtgaagcaaggagaaaatgcctacatattctttcttatccaacgagaggacgccgattccttctcgccggcaacccacatagatcccctctacgccaacacgctgaaagaagcactgcaacaaggagtgcaggcactggcctaccaggcaagcgtcattctccgagcgcttccaatcatcctcaacggcagtaactctcctcacctgccacaaaggtaa

SEQ ID NO: 51310 - protein, 259 aa, Desulfotalea psychrophila LSv54
MPPSLAPRQLICNINFTYRRDTYMDFSQGLTPARLIRRYKRFLADVEIEDGTIITVYCPNTGTMRTCSTPNSPVMLSISDNPKRKYAHTLEMIFENHTWIGVNTGRTNSIVAKAILNGSIAEFSGATKVQREITVSKGSRLDLLVDHADQKSYIEIKNCSMAENRRAMFPDAVTARGTKHLRELIKLVKQGENAYIFFLIQREDADSFSPATHIDPLYANTLKEALQQGVQALAYQASVILRALPIILNGSNSPHLPQR

SEQ ID NO: 51311 - DNA, 666 bp, Thermus thermophilus HB8
  CDS (1)..(666): transl_table=11
atggagcttccccttcctcccctccttccctgccggatcctccggcgggcgaaccggttcgtggtggaggcggacgtgggccccctccacctcgccaacacgggccgcctcaccgagcttctcctccccggaacccggggccactaccacccgaggcccacggccaagacccgggggcggctttacctggtggagcgggaaggcgtcctcgtgggggtggacgccaccctggcggggccccttctggaaaggctccttcgcgccgggcgctacggacccctggaggccttgcggcgggaggtggggctacaaggggaaaggctggacttctgggcccgggtggggggaagggaggccttctttgaggccaagaacgcgaaccggctggagggggccctcgccctcttccccgacgcccccacctcgaggggggcgcgccaccttcgcctcctcgccgccttggcccgggaggggtacggggccttcgccgtctggctcgtccagcaccccctggccgaggcctttgccctggaccccgcggaccgggccctcctcgaggccgcccaagcggcgcgggaggccggggtggtcctggaggcctatagggttcggccgagcctggaggccctccgcctcgaggcccccctcccctgggtctggctctaa

SEQ ID NO: 51312 - protein, 221 aa, Thermus thermophilus HB8
MELPLPPLLPCRILRRANRFVVEADVGPLHLANTGRLTELLLPGTRGHYHPRPTAKTRGRLYLVEREGVLVGVDATLAGPLLERLLRAGRYGPLEALRREVGLQGERLDFWARVGGREAFFEAKNANRLEGALALFPDAPTSRGARHLRLLAALAREGYGAFAVWLVQHPLAEAFALDPADRALLEAAQAAREAGVVLEAYRVRPSLEALRLEAPLPWVWL

SEQ ID NO: 51313 - DNA, 720 bp, Dehalococcoides ethenogenes 195
  CDS (1)..(720): transl_table=11
atgtaccaatttgatgagcctcttatcagaggcacaatgctaaaaagaaaaagtcagttcactgctgtcgttcagattgacggcgaggagctgatcgcacatataccgacaacaaaccggatcggagacgtggagaataagaatctaccttgtctgctttcttatcatccagatccgaagcgaaagctgcattatgacattgaggccgtgcttctgtcggatgatgacaactgggtgggcatcaatcagattctctccaacaggctggtggagcatttctttcgggagcatgagctggataaaattgtggcggagtatgacgatatacaaagagaggtcaagctcggtatctccaagctggactttaaggtcggtgacacataccttgaggtgaagacaccactcactaccatcaatgtgaaatacggcgagaccatcaagacgttgccgccgaagccgttctcatcgacagaccggatggtcaagcacgtgaacgagctggcaggctctctttcggagcacgagagagcgatcttcctgcaggtgtatcagtatcgcatcaccgaacgcaaggagcgactgcgctcgacgcattatgaggaggtctctgagacgatccacagggctgccgaacagggcgtggagttctgggaaatccagatggactttcgaccggagggtgtgagtctttataatgtggagagaagtacagatttatag

SEQ ID NO: 51314 - protein, 239 aa, Dehalococcoides ethenogenes 195
MYQFDEPLIRGTMLKRKSQFTAVVQIDGEELIAHIPTTNRIGDVENKNLPCLLSYHPDPKRKLHYDIEAVLLSDDDNWVGINQILSNRLVEHFFREHELDKIVAEYDDIQREVKLGISKLDFKVGDTYLEVKTPLTTINVKYGETIKTLPPKPFSSTDRMVKHVNELAGSLSEHERAIFLQVYQYRITERKERLRSTHYEEVSETIHRAAEQGVEFWEIQMDFRPEGVSLYNVERSTDL

SEQ ID NO: 51315 - DNA, 714 bp, Thermococcus kodakarensis KOD1
  CDS (1)..(714): transl_table=11
atggcgaagcccgtactgctcaccctaaacgtcgttccatgcacgttccttaagcgtctcaaccgcttcgttgctctagtcgaggtaaacggtgagaccaggaaagcattggtaacgaacactggaagattagaagagttcatgatccctggcagaaaagccttctgcgttccgaaggaaggggggaagactgactttgttttagtcgcattcgaagatgaagagggcaaaggagcagtgatcgacaccagaacgcaggcaagagcctttgagagggcccttgagctaggtctcgtcccctggctcagggactgttccataaagaagaaggagatcaaagtcggaagctcccgcctcgactacctctttgaatgtcccggcggtgatgtctacgccgagatgaagagtgccgtcctaaggggcggtgagaaaggggaatatgcaatgtaccctgactgtccatcaacgagggggcagagacacataagggagctcatcgagctgtcgaaagctggaaagagggccatgatattcttcatcggcgcaatgccaggtgttgaaaagttcaggccttacgagaaaggcgaccccgagatagcgaggctcctcaaaggggccagaaaagcgggcgttgaaatccacgccctcagcatctcactcctgcccgatggaaaaatcgtcctcgaaaggcccgagcttgaggttgaagtatga

SEQ ID NO: 51316 - protein, 237 aa, Thermococcus kodakarensis KOD1
MAKPVLLTLNVVPCTFLKRLNRFVALVEVNGETRKALVTNTGRLEEFMIPGRKAFCVPKEGGKTDFVLVAFEDEEGKGAVIDTRTQARAFERALELGLVPWLRDCSIKKKEIKVGSSRLDYLFECPGGDVYAEMKSAVLRGGEKGEYAMYPDCPSTRGQRHIRELIELSKAGKRAMIFFIGAMPGVEKFRPYEKGDPEIARLLKGARKAGVEIHALSISLLPDGKIVLERPELEVEV

SEQ ID NO: 51317 - DNA, 708 bp, Vibrio fischeri ES114
  CDS (1)..(708): transl_table=11
atgaaatttgaacctgaattagaatctgggaagctaataaaacgctataaacgctttttagctgatattaaacttgacgataatagtgagcgcacaattcattgcgctaacactggagcaatgactggctgtgcagagcctgacagtacggtgtttttttcaacatccagtaacctcaagcgcaaataccctaacagttgggagctcagcgtcacagaaaacaatcacacaatatgcgttaatacccttcgatctaatcaattagttgtcgaggcgattcaagatcagaacataaaagaactgactgaatatgacgagctaaaaaccgaagtaaaatacggctcagagaacagtcgaattgatattttacttactggtaaatcgttacctgactgctatattgaagtgaagagcgtcacattattaagtgaatcgggtcaaggtttctttccagatgccgttacaacccgtggccaaaaacacttaagggaattaagcgaaatggcacaacttggccataaagccatattatttttcgctgttttacattcgggtattgaaaaagtctcaatcgcacaccatatagaccagcaatatcattctttattaattgatgcgattgaaaatggggtcaatattctctgctaccaagcagagatgtcatcaaaagagatgaagatcgtacgcaagctaccttttagtatttag

SEQ ID NO: 51318 - protein, 235 aa, Vibrio fischeri ES114
MKFEPELESGKLIKRYKRFLADIKLDDNSERTIHCANTGAMTGCAEPDSTVFFSTSSNLKRKYPNSWELSVTENNHTICVNTLRSNQLVVEAIQDQNIKELTEYDELKTEVKYGSENSRIDILLTGKSLPDCYIEVKSVTLLSESGQGFFPDAVTTRGQKHLRELSEMAQLGHKAILFFAVLHSGIEKVSIAHHIDQQYHSLLIDAIENGVNILCYQAEMSSKEMKIVRKLPFSI

SEQ ID NO: 51319 - DNA, 714 bp, Pseudomonas syringae pv. syringae B728a
  CDS (1)..(714): transl_table=11
atgcgtttttctccgcagcttgaacagggtcgtctgctggtgcgttacaagcgctttctcgctgatatcgaaaccgatagcggtgaattgctgaccattcactgccctaacaccggttcgatgctcaactgcatgatgcccggcgggcgcgtgtggttcagtcgctcgaatgaccccaagcgcaaactgccgggcacttgggaaatcagcgaaaccccgcagggtcgcctggcctgtatcaataccggacgggccaatacgctggttgaagaggcgttgcgcgccggggtcatcagcgaactgacggggttcacggcgctcaagcgcgaggtggcctacggacaggaaaaaagtcgtgtggactttcgtctggagtacccggatggctatctgtatctggaagtgaaaagtgtcactctgggattcgatggttccagcgtggcggcattccccgatgcggtgacccagcgcggcgcgcggcacctgcgcgaactggcgacgctggcgcgcgaaggcgtgcgcgccgtgctgttgtattgcgtcaatctcaccggtatcgacgctgtgcggccggcgcaggagattgatcctgcctacgcagcggcattgcgtgaagccatcgatgccggtgtgcaaattctcgcctacggtgcgcaactgacgtcggaagagatttttatcgaccggcgcctgcaggtgcacgggctggattga

SEQ ID NO: 51320 - protein, 237 aa, Pseudomonas syringae pv. syringae B728a
MRFSPQLEQGRLLVRYKRFLADIETDSGELLTIHCPNTGSMLNCMMPGGRVWFSRSNDPKRKLPGTWEISETPQGRLACINTGRANTLVEEALRAGVISELTGFTALKREVAYGQEKSRVDFRLEYPDGYLYLEVKSVTLGFDGSSVAAFPDAVTQRGARHLRELATLAREGVRAVLLYCVNLTGIDAVRPAQEIDPAYAAALREAIDAGVQILAYGAQLTSEEIFIDRRLQVHGLD

SEQ ID NO: 51321 - DNA, 717 bp, Haemophilus influenzae 86-028NP
  CDS (1)..(717): transl_table=11
atgcaacttccagctttacaatcggcaaaattaattcgtcgttacaaacgctttcttgcggatattgaactaccaactggtgatgtgatgacaattcattgcgccaatacaggtgcgatgactggctgcggtgaaaaaggcgataccatttggtattcacattctgatagccaaacccgcaaatatccccattcttgggagctcacacaacttgcaaatggacaactttgttgtatcaatacgcatcgttctaatcagcttgtctttgaagcattgcaaaataaacaaatcaaagaattagcaatgtatgatgaaatttatcctgaagtgaaatacggcgaagaaaatagccgaattgatttcttactaaaaggcgagggtttgcctgattgttatgtagaagtgaaatcaatcacgcttgtaaaaggtaatttaggtatgttccccgatgcggttactacgcgtggacaaaaacacgttcgtgaattactcgcaatgaaaaaacaaggtcatagagcagtggtgctatttgctgggttacataatgggtttgatcgtttcaaaatcgcagaatatatcgatcctgaatatgatcgcttattaaaagaagcaatggaacaaggcgttgaagcctatgcttatgcgggacaatttgaaatttctaatgaaattcctaccgcactttctttgacagaatcggtgccttatataaaataa

SEQ ID NO: 51322 - protein, 238 aa, Haemophilus influenzae 86-028NP
MQLPALQSAKLIRRYKRFLADIELPTGDVMTIHCANTGAMTGCGEKGDTIWYSHSDSQTRKYPHSWELTQLANGQLCCINTHRSNQLVFEALQNKQIKELAMYDEIYPEVKYGEENSRIDFLLKGEGLPDCYVEVKSITLVKGNLGMFPDAVTTRGQKHVRELLAMKKQGHRAVVLFAGLHNGFDRFKIAEYIDPEYDRLLKEAMEQGVEAYAYAGQFEISNEIPTALSLTESVPYIK

SEQ ID NO: 51323 - DNA, 744 bp, Sulfolobus acidocaldarius DSM 639
  CDS (1)..(744): transl_table=11
ttgagatatttcttcctgaagttatatctcacattcagtccctacaccgctcctcatagatcagatatgaccacttcatcatttgttgtttatgatttcgacactccattatttgaagatattgttaaagaacggataaatagatttgttgttataacgcagtccggaaaattgtgccacttacacgacccaggaagactcaaggaattgatatacccaggcaataggattttgataagagagcataaaggaaggaaaactaactatatggttctagctgcccactctggtacaggatgggttgtaacagatagttccattcataataaaatagcgagaaattttcttccctctgacgtcaaatcagaggtcaaggtgaataactcaaggttagatttctattacgataacacatttgttgaggtgaagggctgtagtttagtggttgacggtaaagcactatttcctgatgcgcctactgagagaggtaaaaggcatttagaagaactgataaagctaaaaatgcaaggttatagatcgttgatcttgatcctggtcatgagagacgacgctatctgtttttctccgaattggaagactgacaagaaattttcaatggcattcaagaacgcagtcgaagaaggagttgaagttacaataaagttacttaaacttatagacaataagatatggtacattaaggatattcagctatgtcctgatgcgtttaattactctcactag

SEQ ID NO: 51324 - protein, 247 aa, Sulfolobus acidocaldarius DSM 639
MRYFFLKLYLTFSPYTAPHRSDMTTSSFVVYDFDTPLFEDIVKERINRFVVITQSGKLCHLHDPGRLKELIYPGNRILIREHKGRKTNYMVLAAHSGTGWVVTDSSIHNKIARNFLPSDVKSEVKVNNSRLDFYYDNTFVEVKGCSLVVDGKALFPDAPTERGKRHLEELIKLKMQGYRSLILILVMRDDAICFSPNWKTDKKFSMAFKNAVEEGVEVTIKLLKLIDNKIWYIKDIQLCPDAFNYSH

SEQ ID NO: 51325 - DNA, 714 bp, Pseudomonas fluorescens Pf-5
  CDS (1)..(714): transl_table=11
atgcgcttcgatcctcccctggaagaggggcgtctgctgcgtcgttacaagcgcttcctggcagacatcgaaaccaccaccggcgagctgttgaccatccattgccccaataccggctcgatgctcaattgcatggtcgagggcgggcaggtgtggttcagccgctccaatgaccccaagcgcaagttgccgggcacctgggaaatcagcgaaacccctcaaggccgcctggcctgcgtcaacaccgggcgggccaacgggctggtggaagaagccttgcgggcggggcttatcagcgagttgaacggcttcaccgggctcaagcgcgaggtgccttacgggcaagagaacagccgtatcgattttcgcctggattacccggacggtccggcgtacgtcgaggtcaaaagcgtcaccctgggcttcgatggcacgccggtggcagcgtttcccgatgccgtgacccagcgcggcgccaagcatctgcgggaactggcgagcctggcccgggagggcgtgcgggcggttcagctgtattgcgtcaacctttcgggtatcgacgcggtgcggccggcgcaggagatcgatccgggttacgccgctgccctgcgcgaagcccgcgcggcgggggttgaggtgctggcctatggagtgtgcctaacggccgagcaagtgttcatcgaccgacgtcttgaggtgttgctcggggattag

SEQ ID NO: 51326 - protein, 237 aa, Pseudomonas fluorescens Pf-5
MRFDPPLEEGRLLRRYKRFLADIETTTGELLTIHCPNTGSMLNCMVEGGQVWFSRSNDPKRKLPGTWEISETPQGRLACVNTGRANGLVEEALRAGLISELNGFTGLKREVPYGQENSRIDFRLDYPDGPAYVEVKSVTLGFDGTPVAAFPDAVTQRGAKHLRELASLAREGVRAVQLYCVNLSGIDAVRPAQEIDPGYAAALREARAAGVEVLAYGVCLTAEQVFIDRRLEVLLGD

SEQ ID NO: 51327 - DNA, 699 bp, Candidatus Pelagibacter ubique HTCC1062
  CDS (1)..(699): transl_table=11
atggaatttaccaaagctttaataaaaggcaaactgatcaaacgttataagaggttttttgcagacgttaaaattggcaaggaaattgttacggcacattgccctaatactggatctatgaagggcttattagatgaaggaaatatggtttatgtatctaaaaatgatgacccaaaaagaaagttaaaatatacccttgaaataattaaagttaaaaaaaatttagttggtgttaatactcattttgcaaataaaattgccttccatggtttagtaaataatctagttaaagaagttgcaaacaatgacagtatcaaggctgaggtattttttgataaagaaacacggtttgattttttagttgaaaaaaataaacaaaaaatatttgtagaagttaaaaatgttactttattcagagaagaaaaaactgcagaatttccagatgccgttaccactagagggtcaaagcatttaaaaacacttatagaggcggttaaaaagggctataaatcctatctattatttttagtccaaatagagggtgtggataattttaaaatagcaaaagacattgataaagaatattatgaaaattatttacttgcaaaaaaagctggagttaactttttggcttatcaatgtaaaataaattcaaaagaaattaaaatagataaaaaaattaaaattattaatgcctga

SEQ ID NO: 51328 - protein, 232 aa, Candidatus Pelagibacter ubique HTCC1062
MEFTKALIKGKLIKRYKRFFADVKIGKEIVTAHCPNTGSMKGLLDEGNMVYVSKNDDPKRKLKYTLEIIKVKKNLVGVNTHFANKIAFHGLVNNLVKEVANNDSIKAEVFFDKETRFDFLVEKNKQKIFVEVKNVTLFREEKTAEFPDAVTTRGSKHLKTLIEAVKKGYKSYLLFLVQIEGVDNFKIAKDIDKEYYENYLLAKKAGVNFLAYQCKINSKEIKIDKKIKIINA

SEQ ID NO: 51329 - DNA, 714 bp, Colwellia psychrerythraea 34H
  CDS (1)..(714): transl_table=11
atgatacttcaagtgcaacccgccaaattaattaagcgttataaacgctttctagctgatattgaacttaattgtggtgaggaaacaaccatacattgtgctaacacgggtgcgatgaaaggttgtgcagagcccgatgatactgtttggtacaccacctcaaccaatactaagcgaaaatatccatttagctgggagatcacccaaagccaagatgaccattttatttgcgtcaacaccttgcgcgctaatcagttggtggaagaggcgttacacttagatttaatcaaagaattatctggcttcaatgaattaaaacgagaagtaaaatacggcaatgaaaacagccgagttgattttttagcaacttataataatgcccctgacacatatattgaagttaaatcagtcacattattagagagtggtcatggctatttccctgatgcggttaccacacgtggacaaaaacacttacgtgaattaatggacatggtcgcacaaggacacaaggctgttttattatttgccgttttacatagtggcatcaatgatatttctgccgctagtcatgttgatccaatttatgcaaaattactcaaagaagctcgccttgccggtgttgaaataatcgcctataaagcaggtttttcactacaactcggagagctagatgttaagttagtagaaaaaattccctttattgaacgataa

SEQ ID NO: 51330 - protein, 237 aa, Colwellia psychrerythraea 34H
MILQVQPAKLIKRYKRFLADIELNCGEETTIHCANTGAMKGCAEPDDTVWYTTSTNTKRKYPFSWEITQSQDDHFICVNTLRANQLVEEALHLDLIKELSGFNELKREVKYGNENSRVDFLATYNNAPDTYIEVKSVTLLESGHGYFPDAVTTRGQKHLRELMDMVAQGHKAVLLFAVLHSGINDISAASHVDPIYAKLLKEARLAGVEIIAYKAGFSLQLGELDVKLVEKIPFIER

SEQ ID NO: 51331 - DNA, 714 bp, Pseudomonas syringae pv. phaseolicola 1448A
  CDS (1)..(714): transl_table=11
atgcgttttgctccgcagcttgaacagggacgcctgctgattcgttacaaacgctttctggctgatatcgaaaccgacagcggcgagctgttgaccattcactgccccaacaccggttcgatgctcaactgcatgatgcccggtgggcgtgtgtggttcagccgttcaagtgacccgaagcgcaagctgccgggcacttgggaaatcagcgagacgccgcagggcaggctggcctgtatcaacaccgggcgagccaatacgctggttgaagaggccttgcgcgccggggttatcagcgaactcgaggggtttacgacgctcaagcgcgaggtggcctacgggcaggaaaagagtcgtgtggactttcgccttgaataccctgatggctatctgtatctggaagtgaaaagtgtcacgttgggtttcgatgattccagtgtcgctgcgtttcccgacgcggttacccagcgtggtgcgcggcacttgcgtgaactggccacgctggcgcgcgagggcgtgcgggccgtgttgttgtattgcgtcaacctcaccggtatcgacgccgtgcgacccgcaaaggagatcgatccggtttacgcggctgcgttgcgcgaagccattgacgctggtgtgcaaattcttgcctacggtgtgcacctgacgccagacgaaattgttattgaccgacgactgcaggtgcactggctggattga

SEQ ID NO: 51332 - protein, 237 aa, Pseudomonas syringae pv. phaseolicola 1448A
MRFAPQLEQGRLLIRYKRFLADIETDSGELLTIHCPNTGSMLNCMMPGGRVWFSRSSDPKRKLPGTWEISETPQGRLACINTGRANTLVEEALRAGVISELEGFTTLKREVAYGQEKSRVDFRLEYPDGYLYLEVKSVTLGFDDSSVAAFPDAVTQRGARHLRELATLAREGVRAVLLYCVNLTGIDAVRPAKEIDPVYAAALREAIDAGVQILAYGVHLTPDEIVIDRRLQVHWLD

SEQ ID NO: 51333 - DNA, 777 bp, Prochlorococcus marinus str. NATL2A
  CDS (1)..(777): transl_table=11
gtgattgaaattggtgaaaccattattaagtttcctcctcttaaagagggaatattgattaagagatataagaggtttttggccgatattgagttggatgatggagaggttgttacagcgcattgtgcaaatacaggaccaatgaaaggggttttgtggcctgggcggagagtcagactcaagtattctccttcacctaaacgtaaattagattggtcttgggagcaagctgaggttcctagtcacaatgagaacaagaaatgctgggttggtattaatacatctttgcctaataagttgattaaacatttaattgaagcaaattgtttagagaggcaatttggtcaaatttcaagcattaagcctgaagttgtttatggtttagaaagaaaaagtagaattgatctattgctttatccaagcattcagaatgaagatagtagaaagatttttgtcgaggttaaaaatacaacttggtgtgaagattctttagcattgttcccagatacagtaacgactagaggtcaaaaacatttaaaagaattaatgagtgtttatccagattctcgagcagtgctaattccttgtattagtagaagcgatatagaactttttgcacctggtgaaatagcagatcctgagtatgggaggttgtttagagaggcattaactaagggtgttgaagtgattccatgcgcatttggtttctttatagatcacatcacttgggaaggtattagaccttttcagaagtcgagagaaaataaacaattttaa

SEQ ID NO: 51334 - protein, 258 aa, Prochlorococcus marinus str. NATL2A
MIEIGETIIKFPPLKEGILIKRYKRFLADIELDDGEVVTAHCANTGPMKGVLWPGRRVRLKYSPSPKRKLDWSWEQAEVPSHNENKKCWVGINTSLPNKLIKHLIEANCLERQFGQISSIKPEVVYGLERKSRIDLLLYPSIQNEDSRKIFVEVKNTTWCEDSLALFPDTVTTRGQKHLKELMSVYPDSRAVLIPCISRSDIELFAPGEIADPEYGRLFREALTKGVEVIPCAFGFFIDHITWEGIRPFQKSRENKQF

SEQ ID NO: 51335 - DNA, 723 bp, Nostoc punctiforme PCC 73102
  CDS (1)..(723)
atggattggctttaccgttacccacctttgtatccgggtattttactcaagcgttacaagcgattttttgctgacgttcaacttacttctggcgaaatagtgacagcacactgtcctaatacagggccaatgactggagtatcaactccccaaagtgctgtacagctttccaaaagtgataatcttaaccgcaaattggcttacactttagaactaattcaggtacatgacaatgagccgacttgggtaggcataaatacttttttgcccaatcgggtggtaaagctagctttggcaaaatatcttttcccagaattgggtgagtatagccaaatcaagggtgaggtggtttatggactagataaaaaaagtcgagtggattttttcttgacggggagtgatgaggaacgcccgatttatttagaagtgaaaaatacaactttgtctgaggggagactagctttatttcctgacacggagactacaagaggacaaaaacacttgcgagaactgatggcgttgctacctttaactcgtgcggtgatgctttactttatcaatcgtggtgattgtacagagttttcccctggcgatcgcacagatcctgtatatggtaaattattgcgggatgcgatcgctcttggtttagaagtcttaccttgccgttttgatatttcccccgaaggcatccgttatttgggtttggcaaaactaaaaatttaa

SEQ ID NO: 51336 - protein, 240 aa, Nostoc punctiforme PCC 73102
MDWLYRYPPLYPGILLKRYKRFFADVQLTSGEIVTAHCPNTGPMTGVSTPQSAVQLSKSDNLNRKLAYTLELIQVHDNEPTWVGINTFLPNRVVKLALAKYLFPELGEYSQIKGEVVYGLDKKSRVDFFLTGSDEERPIYLEVKNTTLSEGRLALFPDTETTRGQKHLRELMALLPLTRAVMLYFINRGDCTEFSPGDRTDPVYGKLLRDAIALGLEVLPCRFDISPEGIRYLGLAKLKI

SEQ ID NO: 51337 - DNA, 717 bp, Haemophilus somnus 129PT
  CDS (1)..(717)
atgcaattaccgaatttacaatcagcaacattacttcgccgttataaacgctttttggcagatgtagaattaaacaacggtgaaattttaacgcttcattgtgccaataccggtgcgatgacaggatgtggtgaaaaaggcgatactgtttggttttctacttctgacagcaaaacaagaaaatacccgcactcttgggaattaactcaacttaaaaatggtcaaacggtatgtatcaatactcaccgttccaatcaattaactttagaggctttgcaaaataaaatcatcacagaattagctgaatatgatgagattttgcctgaagtaaaatatggtgtagaaaatagtcgcattgattttttactcaaaggtaaaaacttaccggattgttatgtcgaagtaaaatccgttacgtttgtcaaaaatcatctcggtttgttccctgatgccgtcacaacaagaggacaaaaacacttgcgtgagcttatagcaatgaaaaagcggggacatagagcggtcgtttttttcgccggtcttcacgacggttttaatcgcttcaccgttgcaaaatctattgatcctgattatgccgaattactgcagcaagcagttaaagaaggtgttgaagtttatagctatgccgtgaaatttgatttttctcatcaaaaaccgaccgcactttatctaacaaatttagtgaattacctagaataa

SEQ ID NO: 51338 - protein, 238 aa, Haemophilus somnus 129PT
MQLPNLQSATLLRRYKRFLADVELNNGEILTLHCANTGAMTGCGEKGDTVWFSTSDSKTRKYPHSWELTQLKNGQTVCINTHRSNQLTLEALQNKIITELAEYDEILPEVKYGVENSRIDFLLKGKNLPDCYVEVKSVTFVKNHLGLFPDAVTTRGQKHLRELIAMKKRGHRAVVFFAGLHDGFNRFTVAKSIDPDYAELLQQAVKEGVEVYSYAVKFDFSHQKPTALYLTNLVNYLE

SEQ ID NO: 51339 - DNA, 729 bp, Desulfovibrio desulfuricans G20
  CDS (1)..(729)
ttgattgcctttccccgcggctgcataaccggcacattcatacggcgggtcaagcgcttcagtgtggagatggaaacggccggtgccggagcgcccgagcgggtgtggatacacagcaataactccggttccatgctggggttgctgcgcgccggtgcgcctgtgctggcatcgccggcggccaaccccgcccgcaagcttaaatggacgcaggaactggccggactggacggcatgtgggtgggcgttaatacgcagacccccaacagactgctggaagctgcttttcatgccggcagattgccgtgggcagcggggtacaccatgttccggcgtgaggcccgctgcggcgccagcaggcttgatgcccgcatggatgcgccgcaggacagcggtctgccgcctttgtgggtggagtgcaaaaacgtcaccatggtggaggacgacgtggccgcttttcccgatgcggccaccgagcgcgggcagaagcacctgcgggagatgatggagattgtgcggcaggggcagcgggccgccatgttttatctggtgcagcgtgcggacgggcattgcttcgggcctgctgattatgtggaccctgtatacgccggacttttttatgaagctgcagccgcgggcgtggaaatgtacccgcacagggcactggtgagcgaacacggcatcgatctggggccgctgttgcccgttgtgccgccgcccggcgtctga

SEQ ID NO: 51340 - protein, 242 aa, Desulfovibrio desulfuricans G20
MIAFPRGCITGTFIRRVKRFSVEMETAGAGAPERVWIHSNNSGSMLGLLRAGAPVLASPAANPARKLKWTQELAGLDGMWVGVNTQTPNRLLEAAFHAGRLPWAAGYTMFRREARCGASRLDARMDAPQDSGLPPLWVECKNVTMVEDDVAAFPDAATERGQKHLREMMEIVRQGQRAAMFYLVQRADGHCFGPADYVDPVYAGLFYEAAAAGVEMYPHRALVSEHGIDLGPLLPVVPPPGV

SEQ ID NO: 51341 - DNA, 717 bp, Haemophilus somnus 2336
  CDS (1)..(717)
atgcaattaccgaatttacaatcagcaacattacttcgccgttataaacgctttttggcagatgtagaattaaacaacggtgaaattttaacgcttcattgtgccaataccggtgcgatgacaggatgtggtgaaaaaggcgatactgtttggttttctacttctgacagcaaaacaagaaaatacccgcactcttgggaattaactcaacttaaaaatggtcaaacggtatgtatcaatactcaccgttccaatcaattaactttagaggctttgcaaaataaaatcatcacagaattagctgaatatgatgagattttgcctgaagtaaaatatggtgtagaaaatagtcgcattgattttttactcaaaggtaaaaacttaccggattgttatgtcgaagtaaaatccgttacgtttgtcaaaaatcatctcggtttgttccctgatgccgtcacaacaagaggacaaaaacacttgcgtgagcttatagcaatgaaaaaacggggtcatagagcggtcgtttttttcgcaggtcttcacgacggttttaatcgcttcaccgttgcaaaatctattgatcctgattatgccgaattactgcagcaagcagttaaagaaggtgttgaagtttatagctatgccgtgaaatttgatttttctcatcaaaaaccaaccgcactttatctaacaaatttagtgagttacctagaataa

SEQ ID NO: 51342 - protein, 238 aa, Haemophilus somnus 2336
MQLPNLQSATLLRRYKRFLADVELNNGEILTLHCANTGAMTGCGEKGDTVWFSTSDSKTRKYPHSWELTQLKNGQTVCINTHRSNQLTLEALQNKIITELAEYDEILPEVKYGVENSRIDFLLKGKNLPDCYVEVKSVTFVKNHLGLFPDAVTTRGQKHLRELIAMKKRGHRAVVFFAGLHDGFNRFTVAKSIDPDYAELLQQAVKEGVEVYSYAVKFDFSHQKPTALYLTNLVSYLE

SEQ ID NO: 51343 - DNA, 714 bp, Actinobacillus pleuropneumoniae serovar 1 str. 4074
  CDS (1)..(714)
atgcaatttccttctctttcttgcggcatattaatcaaacgttataaacgttttttagccgatattctgctgcccaacggcgagcaaattaccctacattgtccgaacaccggtgcaatgaccggctgtgctactaccggcgataccgtttggttttccacatcagataatcctaaacgcaaatatgctcacacttgggaactgactcaaactcaagcgggtgattttatttgtgtgaatacccaacgagccaaccagctggtgcaagaagcattagaaaagcgctggattgccgaactcgccgagtaccaaaccgtcttgcccgaacaaaaatacggctcggaaaacagccgcattgattttctgctcaaagcggacaatcagcccgactgttttgcagaagtgaaatccactaccttacttactgaaaacgatttggggatgttccccgatgccaaaacggaacgcgggcaaaaacacttgcgagaactggctgcgattgccgaatccgggcaacaagcggtcatactttttgcgattttacacactggcatccaacgttttgccgtggcaaaacaaattgatccgcaatatgctgccttatttgaacaagcgaaaaatgttggggtaaaagtattagcgtataaagcccaaatagaattagtactcggcaagccaatatcaatgaatttgcaattttcctgtgaaatctga

SEQ ID NO: 51344 - protein, 237 aa, Actinobacillus pleuropneumoniae serovar 1 str. 4074
MQFPSLSCGILIKRYKRFLADILLPNGEQITLHCPNTGAMTGCATTGDTVWFSTSDNPKRKYAHTWELTQTQAGDFICVNTQRANQLVQEALEKRWIAELAEYQTVLPEQKYGSENSRIDFLLKADNQPDCFAEVKSTTLLTENDLGMFPDAKTERGQKHLRELAAIAESGQQAVILFAILHTGIQRFAVAKQIDPQYAALFEQAKNVGVKVLAYKAQIELVLGKPISMNLQFSCEI

SEQ ID NO: 51345 - DNA, 717 bp, Haemophilus influenzae R2846
  CDS (1)..(717)
atgcaacttccagctttacaatcggcaaaattaattcgtcgttacaaacgctttcttgcggatattgaattgccaactggtgatgttatgacaattcattgtgcaaatactggggcgatgacaggatgtggagaaaaaggcgatacaatttggtattcacattccgatagtcaaactcgtaaatatccccattcttgggagcttactcaactcgcaaatggacagctttgctgtatcaatacgcatcgttctaatcagcttgtttttgaagcattgcaaaataagcaaatcaaagaattggcaatgtatgatgaaatttaccctgaagtgaaatacggcgaggaaaatagccgcattgatttcttactaaaaggcgagggtttgcctgattgttatgtagaagtgaaatcaatcacgcttgtaaaaggcaatttaggtatgtttcccgatgcggttactacgcgtggacaaaaacacgttcgagaattattggcaatgaaaaaacaaggtcatcgagcagtagtgctatttgctgggttacataatgggtttgatcgtttcaaaattgcggaatatatcgatcctgaatatgatcgcttattaaaagaagcaatggaacaaggtgttgaagcctatgcttatgtgggacaatttgaaatttctaatgaaattcctaccgcactttctttgatagaatcggtgccttatataaaataa

SEQ ID NO: 51346 - protein, 238 aa, Haemophilus influenzae R2846
MQLPALQSAKLIRRYKRFLADIELPTGDVMTIHCANTGAMTGCGEKGDTIWYSHSDSQTRKYPHSWELTQLANGQLCCINTHRSNQLVFEALQNKQIKELAMYDEIYPEVKYGEENSRIDFLLKGEGLPDCYVEVKSITLVKGNLGMFPDAVTTRGQKHVRELLAMKKQGHRAVVLFAGLHNGFDRFKIAEYIDPEYDRLLKEAMEQGVEAYAYVGQFEISNEIPTALSLIESVPYIK

SEQ ID NO: 51347 - DNA, 717 bp, Haemophilus influenzae R2866
  CDS (1)..(717)
atgcaacttccagctttacaatcggcaaaattaattcgtcgttacaaacgctttcttgcggatattgaactaccaactggtgatgtgatgacaattcattgtgccaatacaggtgcgatgactggctgcggtgaaaaaggcgataccatttggtattcacattctgatagccaaacccgcaaatatccccattcttgggagctcacacaacttgcaaatggacaactttgttgtatcaatacgcatcgttctaatcagcttgtctttgaagcattgcaaaataaacaaatcaaagaattagcaatgtatgatgaaatttatcctgaagtgaaatacggcgaagaaaatagccgaattgatttcttactaaaaggcgagggtttgcctgattgttatgtagaagtgaaatcaatcacgcttgtaaaaggtaatttaggtatgttccccgatgcggttactacgcgtggacaaaaacacgttcgtgaattactcgcaatgaaaaaacaaggtcatagagcagcggtgctatttgctgggttacataatgggtttgatcgtttcaaaatcgcagaatatatcgatcctgaatatgatcgcttattaaaagaagcaatggaacaaggtgttgaagcctatgcttatgcgggacaatttgaaatttctaatgaaattcctaccgcactttctttgacagaatcggtgccttatataaaataa

SEQ ID NO: 51348 - protein, 238 aa, Haemophilus influenzae R2866
MQLPALQSAKLIRRYKRFLADIELPTGDVMTIHCANTGAMTGCGEKGDTIWYSHSDSQTRKYPHSWELTQLANGQLCCINTHRSNQLVFEALQNKQIKELAMYDEIYPEVKYGEENSRIDFLLKGEGLPDCYVEVKSITLVKGNLGMFPDAVTTRGQKHVRELLAMKKQGHRAAVLFAGLHNGFDRFKIAEYIDPEYDRLLKEAMEQGVEAYAYAGQFEISNEIPTALSLTESVPYIK

SEQ ID NO: 51349 - DNA, 726 bp, Anabaena variabilis ATCC 29413
  CDS (1)..(726)
atgattgattggctctacagttacccacctttatatcctggcattttgctaaagcgctataagcgctttttcgctgatgtacaactagcttccggcgaagtcgtaacagcacattgtcccaatacaggccccatgaccggagtctcaactctagggagtgtggtacaactttctaaaagtgccaatcctaagcgtaaattggcttatactctagaactgattcaagtacacgataacgagccgacttgggtaggtgtaaatacagctttaccaaatcagatagtcaagttggctttggcaaaatacttgtttccagagttaggtagttataaccacatcaaaagtgaggtagtttacggggtagataaaaaaagtcgggtggacttctttttgacaggaagtgatacagaacgcccaatttatctagaggtaaaaaatacaacttgggcaaaagggactttagcattattccccgatacagaaaccacaaggggacaaaagcacttacgggaattaatgacgttattgccacaaacgcgatcagtaatgctgtattttattaatcgtggtgattgtacagagtttgcccctggtgatagtacagatcctatatatggtaagttgttacgagaagcgatcgccttaggtttagaagttttaccttgtcgtttcgatgttaccccagaaggcatccgttatttaggtttagcaaaactggtaatttaa

SEQ ID NO: 51350 - protein, 241 aa, Anabaena variabilis ATCC 29413
MIDWLYSYPPLYPGILLKRYKRFFADVQLASGEVVTAHCPNTGPMTGVSTLGSVVQLSKSANPKRKLAYTLELIQVHDNEPTWVGVNTALPNQIVKLALAKYLFPELGSYNHIKSEVVYGVDKKSRVDFFLTGSDTERPIYLEVKNTTWAKGTLALFPDTETTRGQKHLRELMTLLPQTRSVMLYFINRGDCTEFAPGDSTDPIYGKLLREAIALGLEVLPCRFDVTPEGIRYLGLAKLVI

SEQ ID NO: 51351 - DNA, 711 bp, Magnetospirillum magnetotacticum MS-1
  CDS (1)..(711)
atgcgttttcccgaccctctgatccgcgccacgctcatcaagcgctataagcgcttcctggccgatgtacggctggaggacggcaccgaggtcaccacccatctggccaattcgggagccatgctgggcaccgcggaacccggtatggaggtctggctgtcgcccgcctccaacccggagcgcaagttgaagtggaactgggaaatggtcaccgtggatggccatctggtgggcgtcaacaccgcgcaccccaatgccatcgtggccgaaagcgtggcggccggactcatcgccgagttgaccggctatgactccatccggcgcgaggtgaaatatggcgtcaattcccgcatcgacctgttgctggaagccgcggcgcgccccaaatgctgggtggaggtcaagaacgtccatctcaagcgcggcggctgggccgagtttcccgacgcggtcaccacgcggggcaccaagcatctggccgaactcaccgatcgggtcaaagcgggcgagcgcgccgtgatgctctatctggtccagcgcgaagactgtggcggctttcgccccgccgccgatatcgacccggtttatgcccgcgccctggcccaggcgacacgggacggcgtcgaggctatctgttatacctgccgtctgacgcccggcggcatcgacctgggcgcacccttactcatggatttgactgagcggatttga

SEQ ID NO: 51352 - protein, 236 aa, Magnetospirillum magnetotacticum MS-1
MRFPDPLIRATLIKRYKRFLADVRLEDGTEVTTHLANSGAMLGTAEPGMEVWLSPASNPERKLKWNWEMVTVDGHLVGVNTAHPNAIVAESVAAGLIAELTGYDSIRREVKYGVNSRIDLLLEAAARPKCWVEVKNVHLKRGGWAEFPDAVTTRGTKHLAELTDRVKAGERAVMLYLVQREDCGGFRPAADIDPVYARALAQATRDGVEAICYTCRLTPGGIDLGAPLLMDLTERI

SEQ ID NO: 51353 - DNA, 714 bp, Pseudomonas fluorescens PfO-1
  CDS (1)..(714)
atgcgctttcatcctcctcttgaagaaggccggttgatccggcgttacaagcgttttctcgccgatatcgaaaccgttggcggcgagttgctgaccattcattgccccaataccggctcgatgctcaattgccaggtcgagggcgggcaggtctggttcagccgctccaatgatccgaagcgcaagctgcccggtacctgggaagtcggcgaaaccccgcagggccggctgttttgcgtgaataccggacgcgccaacgcactggtcgaagaagccttgcaggcgggtgtcatcaatgagttgaacggtttcaccgggctcaagcgcgaagtggcgtatggacaggaaaagagtcggatcgattttcgcctcgactatccgacgggcccggcctacgtggaagtgaagagtgtcacgctgggtttcgacggaacggcagtggcggcgtttcccgatgcggtgacagagcgcggcgccaagcatttgcgtgagctggcgcatctggcgcgggacgggattcgtgcggtgcagttgtactgcgtcaatctcacgggagtcgaggcggtgcgtccagccgaggaaatcgacttcgcctacgccgctgcgctgcgtgaggcggtggcgtgcggggtcgaagtcctggcgtacggcgtgcggttgagccatgaagagatggtgatcgaccggcggctggacgtgctgctcaacggttag

SEQ ID NO: 51354 - protein, 237 aa, Pseudomonas fluorescens PfO-1
MRFHPPLEEGRLIRRYKRFLADIETVGGELLTIHCPNTGSMLNCQVEGGQVWFSRSNDPKRKLPGTWEVGETPQGRLFCVNTGRANALVEEALQAGVINELNGFTGLKREVAYGQEKSRIDFRLDYPTGPAYVEVKSVTLGFDGTAVAAFPDAVTERGAKHLRELAHLARDGIRAVQLYCVNLTGVEAVRPAEEIDFAYAAALREAVACGVEVLAYGVRLSHEEMVIDRRLDVLLNG

SEQ ID NO: 51355 - DNA, 738 bp, Rhodospirillum rubrum
  CDS (1)..(738)
atgctgtttcccacgccgctggtcgaaggccggctggtcaagcgctacatgcggttcctggccgatgtgatcttggacgatggcaccgccgtgaccgcccattgcgccaattcgggatcgatggcctcggtcaaggagccgggatcgccggtctggctttccgaaagccccaatcccgaccgcaagctgaaatacacctgggagatcatccgcgttggcgacgcctattccggcgtcaacaccggcacgcccaatgccgtggtcgccgaggccatcgccgagggcaagatcccgccgcttgccggctatgcccgcctgcgccgcgaggtcaaatacggcaagacctcgcgcatcgacatcctgctcgaggatgatgccgccgccgacgacgcccccgcccgcccgcgctgctatgtcgaggtcaagaacgtcaccctcaagcgcgatccggcctgggatggccccatcgattttcccgacgcggtgacgacgcgcggcgccaagcaccttctcgaactggccgatatggtcgaccagggccaccgcgccgccatggtctatctggtccagcgcaccgatggcggcgccgtcgccatggccgccgacatcgatcccgcctatgccgccggcctgaagaccgccatcgccaagggcgtcgaggtctattgcctgggctgcgaggtcgaccccttgcgcggcatctgggtcaaccgcgccctgccgctgatcgccccttaa

SEQ ID NO: 51356 - protein, 245 aa, Rhodospirillum rubrum
MLFPTPLVEGRLVKRYMRFLADVILDDGTAVTAHCANSGSMASVKEPGSPVWLSESPNPDRKLKYTWEIIRVGDAYSGVNTGTPNAVVAEAIAEGKIPPLAGYARLRREVKYGKTSRIDILLEDDAAADDAPARPRCYVEVKNVTLKRDPAWDGPIDFPDAVTTRGAKHLLELADMVDQGHRAAMVYLVQRTDGGAVAMAADIDPAYAAGLKTAIAKGVEVYCLGCEVDPLRGIWVNRALPLIAP

SEQ ID NO: 51357 - DNA, 783 bp, Microbulbifer degradans 2-40
  CDS (1)..(783)
ttggcggaaaaacaaagcgtgcaagctaccagaagaattgccgctgcgctagcctttttggccgttttggaggccccgttaatgaagtttgagtaccccttgatacctgcaacactgttgcgacgttacaaacgctttctcgcggatgttgagttaagcgacggaagcacaataacagtgcactgcccaaacaccggtagcatgcgtaattgtattgtggaaaacagcccctgttggctgctggattccgcaaaccctaagcgtaagtatagatacagtttggagcgagtgaccactccaacaggcgcagtggcaggaataaacagcgcgagcgcaaatgggttggtgatcgcggcaatcgagaatggtgttattagcgagctgcagggctacgacgaattagctagagagcagcgttacggcgacgaaaaatcccgtatagatatattgctaagtaagcccgaagaacagtgctatatcgaagtaaaaagtgtgactttggaggaggggaagggtgagggcttcttccccgatgccgtaagtacgcgcggccaaaaacacttgcgcgaattaatggcaatgcggtcgcagggccatcgcgccgtactgtttttttgtgtgcagcactcgggtataacaaaagtggctgcagccgaacatatcgaccccgcctacgctgctctgtttaagcaggccgttaatgaaggggtggaagtgattgcttacggtgttgatttgggtatagagggcagtgttatcactaaaaagctcaaagtagtgtag

SEQ ID NO: 51358 - protein, 260 aa, Microbulbifer degradans 2-40
MAEKQSVQATRRIAAALAFLAVLEAPLMKFEYPLIPATLLRRYKRFLADVELSDGSTITVHCPNTGSMRNCIVENSPCWLLDSANPKRKYRYSLERVTTPTGAVAGINSASANGLVIAAIENGVISELQGYDELAREQRYGDEKSRIDILLSKPEEQCYIEVKSVTLEEGKGEGFFPDAVSTRGQKHLRELMAMRSQGHRAVLFFCVQHSGITKVAAAEHIDPAYAALFKQAVNEGVEVIAYGVDLGIEGSVITKKLKVV

SEQ ID NO: 51359 - DNA, 708 bp, Pseudomonas aeruginosa UCBPP-PA14
  CDS (1)..(708)
atgcgtttcgagcagccactggaagaaggccgcctgctgcgtcgctacaagcgtttcctcgccgatatcgagagcgccggcggcgagcgcctgaccatccactgtccgaataccggttcgatgctcaattgcatgagcgaaggttgccgggtctggttcagccgctccaacgaccccaagcgcaagctgccggggacctgggagctgagcgagactccgcagggccgcctggcctgcgtcaacacggcgcgggccaaccgcctggtagaggaggcgctgctggccggggacatcgcggagcttgccggtttcaccgctctgcgccgggaagtggcctacggcgtggagaacagtcgcgccgactttcgcctggaataccccacgggcgcactgttcatcgaggtgaagagcgtcaccctgggcttcgacgaaaccgccgtggcggcctttcccgacgcggtgacgctgcgcggcgccaagcacctgcgcgaactggcggcgctggcgcgggaggggatccgcgcggtgcagttgtactgcgtgaacctttccggggccgaggcggtgcgccccgccgacgagatcgatccagcctatggcaaggcgttgcgcgaggcggcgcaagcgggcgtcgaggtgctggcctatggcgccgaggtgacgacggaaggattgcacctggcgcggcgcctcccggtgcgactctga

SEQ ID NO: 51360 - protein, 235 aa, Pseudomonas aeruginosa UCBPP-PA14
MRFEQPLEEGRLLRRYKRFLADIESAGGERLTIHCPNTGSMLNCMSEGCRVWFSRSNDPKRKLPGTWELSETPQGRLACVNTARANRLVEEALLAGDIAELAGFTALRREVAYGVENSRADFRLEYPTGALFIEVKSVTLGFDETAVAAFPDAVTLRGAKHLRELAALAREGIRAVQLYCVNLSGAEAVRPADEIDPAYGKALREAAQAGVEVLAYGAEVTTEGLHLARRLPVRL

SEQ ID NO: 51361 - DNA, 780 bp, Chloroflexus aurantiacus
  CDS (1)..(780)
atggtgacagggcacggaacaggacatcacggacaatcgccagtacgggttccgctttccagtggagcgccactggttgaggcgacgtttgccagtcgtccgagccagtttctggtcgaagcccagatgggtgggcgaatggtgcgtgcgcatctcgccgaccgggggcgattaaccgatttgctaacaccaggagcgcgcctgttgctcgcctcacgcgaggaaattgggcggaagacggcatttcaggtggtagcagtctatcaggatggcgacctggtctcgcttgacacccaattacccaatcgcctggtggcggcagcattgtcgctcggtgcgcttccccaattcgcgcgttattcgcgggtacagcgagaagtacagcttggcccgcatcgcatcgattttcgcttaagtgaaggactggatacctgtctgctggaggtcaagtcggtgacccggctggttgatgggattgccgtctttcccgacgcaccgactgagcgtggggggcgccatctggagctactgatcaatgctgcccggaatggtcagcgggcggctgtagtgttcatcattcaacgctcgcgtggttgcgcatttgcccccgatgtgaccgttgatccggcgttcagccggtcgttacgagaagcacgctcggttggtgttgagatatacgcctaccgttgcccggtcgatccgtctggtatcacgctgggccaggaggtgccggtcttcgcctcgtttgcagccgtaccgttcgagctgcggcaacactga

SEQ ID NO: 51362 - protein, 259 aa, Chloroflexus aurantiacus
MVTGHGTGHHGQSPVRVPLSSGAPLVEATFASRPSQFLVEAQMGGRMVRAHLADRGRLTDLLTPGARLLLASREEIGRKTAFQVVAVYQDGDLVSLDTQLPNRLVAAALSLGALPQFARYSRVQREVQLGPHRIDFRLSEGLDTCLLEVKSVTRLVDGIAVFPDAPTERGGRHLELLINAARNGQRAAVVFIIQRSRGCAFAPDVTVDPAFSRSLREARSVGVEIYAYRCPVDPSGITLGQEVPVFASFAAVPFELRQH

SEQ ID NO: 51363 - DNA, 732 bp, Lactobacillus casei ATCC 334
  CDS (1)..(732)
atgtactaccaaaatgtcagcgttgggcagctcatcaaacgggtgagtcgctttaccgttgaaattgacctgaatggcaccgtcgaacctgtccacatgaataataccggacgcaataaagaaattttgattccgggatcattagccagtgtccgctatgttgataacccaaatcgcaaaacgcactatgacttgctggctgttcaacggcaaggtcgctggatcaacatcgacagtctggcacccaatcatgttgccaaagaatgtttagaagctggcaccttaaaattgccgggactcgccttgccatacgccgttcatccagaatcgacttggcgcgattcgcgactggactttgctgggaaagccgctgatggccagtcgtggtttgttgaaacgaagggcgtcacgttggctaatggcaccctagcagctttcccagatgcgccaacaactcgcgccgtcaagcatgttcatacgctgacgatggcgcaggcagaagggtatcaggcatttttattgttcatcgtgcaattaccggatattcgccaaatgaccatttatcgggaccgttttcctgaactagtgactgccatcacgactgctaaacaaaatggcgttcgcgtgctggcttatgacaccatgactggcccagatcaaatcacattaggcaacgaaataccattcgacgaacacttgcctttttcagagattaatcttaacagcttgtga

SEQ ID NO: 51364 - protein, 243 aa, Lactobacillus casei ATCC 334
MYYQNVSVGQLIKRVSRFTVEIDLNGTVEPVHMNNTGRNKEILIPGSLASVRYVDNPNRKTHYDLLAVQRQGRWINIDSLAPNHVAKECLEAGTLKLPGLALPYAVHPESTWRDSRLDFAGKAADGQSWFVETKGVTLANGTLAAFPDAPTTRAVKHVHTLTMAQAEGYQAFLLFIVQLPDIRQMTIYRDRFPELVTAITTAKQNGVRVLAYDTMTGPDQITLGNEIPFDEHLPFSEINLNSL

SEQ ID NO: 51365 - DNA, 708 bp, Azotobacter vinelandii AvOP
  CDS (1)..(708): transl_table=11
atgcgctttgatccgccgctggaagaagggcacctgctgcgccgctacaagcgctttttcgccgacatcgagacgccggacggcgaggcgctgtgcatccactgcccgaacaccggctccatgttcaactgcatggccgagggtgggcgcgtctggttcagccgctcgaacgaccccaggcgcaagctgccgggcacctgggagctgagcgagaccccgcagggacggctggcctgcgtgaataccgcgcgggccaatccgttggtggaggaggcattgcgcgccggctcgatcgccgagctgacggggtttaccggactgcggcgagaggtccgctacgggctggagaacagccgggtggacttctgcctggactatccggacgggacggccttcgtcgaggtgaagagcgtcaccctgggcttcgccgacagcccggtcgccgccttcccggatgcccgcaccgagcgcggcgccaagcacctgcgcgagctggcggtcctggcgcggcagggcgtgcgcacggtgcaattgtattgcgtgaatctgtccggcatcgcggcggtgcgcccggcggcggaaatcgacccgggctatgcgcaggcgctgcgcgaagccgtggcggcgggcgtcgaagtgctcgcctacggcgccgagctgtcgcctgcggcgatccggctggtacgccggctcgaggtgtgcctgtag

SEQ ID NO: 51366 - protein, 235 aa, Azotobacter vinelandii AvOP
MRFDPPLEEGHLLRRYKRFFADIETPDGEALCIHCPNTGSMFNCMAEGGRVWFSRSNDPRRKLPGTWELSETPQGRLACVNTARANPLVEEALRAGSIAELTGFTGLRREVRYGLENSRVDFCLDYPDGTAFVEVKSVTLGFADSPVAAFPDARTERGAKHLRELAVLARQGVRTVQLYCVNLSGIAAVRPAAEIDPGYAQALREAVAAGVEVLAYGAELSPAAIRLVRRLEVCL

SEQ ID NO: 51367 - DNA, 762 bp, Chromohalobacter salexigens DSM 3043
  CDS (1)..(762): transl_table=11
atgcaatacacggagctggtgcccgggaccttgatccgccgttacaagcgttttctggccgatgtggcgttggcgtcgggcgatgtggtggtggcgcattgcccgaacaccggctcgatgcgagcggtcgacgtgcccgggtgccgggtctggctgtcaccgagtcgcaacccggcgcgcaagctggcctggacctgggagctgatcgagctgcccatgccggatgccccgcccgcgctggtttccgtgcataccgggcgtgccaatgcgctggtggcccaggcattgcaggaggcacgcattcccgagttggcgggttacgacacgcacaagcgcgaggttcgcgtcgccgacgcccgcctggactttcggctctcgaccgcgcacgcagccgcctatgtcgaggtcaagcaggtcaccctgcgcgagcatgacggccatggctactttccggactcggtgagcgagcgcggccgccgccatctggaggccctggcggcccgcgtggcggagggcgatcgcgcggtgctgctgttttgcgtggcacacaccggaatcgacgccgtggccccggccgcgcatctcgacccggcctatgccgagacgctgcggcgcgtcgcggcgcaaggggtcgaggtactggcctatggcatgagcgcgacctggacccatgacggcgtgcccggcgacattgcgctgacgcgcgcgttgccggtgtcgctcgagcgccgactggcgagcgcgacaccgctcagcgattga

SEQ ID NO: 51368 - protein, 253 aa, Chromohalobacter salexigens DSM 3043
MQYTELVPGTLIRRYKRFLADVALASGDVVVAHCPNTGSMRAVDVPGCRVWLSPSRNPARKLAWTWELIELPMPDAPPALVSVHTGRANALVAQALQEARIPELAGYDTHKREVRVADARLDFRLSTAHAAAYVEVKQVTLREHDGHGYFPDSVSERGRRHLEALAARVAEGDRAVLLFCVAHTGIDAVAPAAHLDPAYAETLRRVAAQGVEVLAYGMSATWTHDGVPGDIALTRALPVSLERRLASATPLSD

SEQ ID NO: 51369 - DNA, 702 bp, Clostridium thermocellum ATCC 27405
  CDS (1)..(702): transl_table=11
atgagaattgaaggagaacttgttaaagcaaagtttgtcaaaagattaaaccggtttgtagctcttgtggaagttgacggggtacaggaatttgcccatgttccgaatacgggaagattgaaagaactcctggtggacggggcggctgtgatggtcagaaagtatgacaaaactgaccgcaagacccgttttgggctcatattggtaagaaaaaacgggatatgggtatccattgattctgcgaatgcgcccaacagaataatgtatgaagcactggtgcaggggaaatttgataaatttcgggactatagcgaaatacgcagggaagtaaccgtgttaaacagccgctttgactttggactgttttctgaaggtaaagaatattatattgaagttaaaggggtaacacttgtggaaaacaggcaaggttttttccccgatgctcccacccaaaggggtacccggcatcttgaagaattgacaaaaataaggcaaaatggcaaagaggcaggagttgcctttattgtgcagagagaggacgcggatgttgtaaggcccaatgacaggacggacaagaactttgccaatgcgctgagaatagccgcggaagccggcgttgacctcatggcctacgtatgcaaagttgatgcggaacaaagaagaatggacattgtccgcgaaataccggtaataataaaatag

SEQ ID NO: 51370 - protein, 233 aa, Clostridium thermocellum ATCC 27405
MRIEGELVKAKFVKRLNRFVALVEVDGVQEFAHVPNTGRLKELLVDGAAVMVRKYDKTDRKTRFGLILVRKNGIWVSIDSANAPNRIMYEALVQGKFDKFRDYSEIRREVTVLNSRFDFGLFSEGKEYYIEVKGVTLVENRQGFFPDAPTQRGTRHLEELTKIRQNGKEAGVAFIVQREDADVVRPNDRTDKNFANALRIAAEAGVDLMAYVCKVDAEQRRMDIVREIPVIIK

SEQ ID NO: 51371 - DNA, 723 bp, Crocosphaera watsonii WH 8501
  CDS (1)..(723): transl_table=11
atggatactgattttatttacacctatcctgctctcattcctggcattcttaagaaacgctataaacgttttttagcggatattgaattagaatcgggggaaacaatcacagcccattgtgccaacacaggtcccatgatcggggtgtgtgatgttgatagtcgggtttatctttctaaaagtaataatcccaaacgaaagctggcttatagttgggaattgattgaggtagacaatacatgggtggggattaatacagctttacctaatcgggttattaaacaagttttagaacaggaaaaatttcctcccctacaaggaaaatacaatcaggttcgtccagaagttccctacggaaaaaacaagaaaagtcgcattgattttctcttaagcaacgaatctgagaaaaaccctatttatgtggaagtaaaaaatactaccttagccacagaaaagatggcattatttcccgatacagttaccactcggggacaaaagcacttacaggagttaatggatttattgccagacgctcaaccgattatgttatattttattaatcggggagactgcgatcgcttttcccctggggacaattatgatccagagtatggcaaattgtttcgggaagccgttgaaaaaggggtgaaaattctaccctgtcgctttgatattacaccccaaggaattcgttatttaggactcgcagaattagttttataa

SEQ ID NO: 51372 - protein, 240 aa, Crocosphaera watsonii WH 8501
MDTDFIYTYPALIPGILKKRYKRFLADIELESGETITAHCANTGPMIGVCDVDSRVYLSKSNNPKRKLAYSWELIEVDNTWVGINTALPNRVIKQVLEQEKFPPLQGKYNQVRPEVPYGKNKKSRIDFLLSNESEKNPIYVEVKNTTLATEKMALFPDTVTTRGQKHLQELMDLLPDAQPIMLYFINRGDCDRFSPGDNYDPEYGKLFREAVEKGVKILPCRFDITPQGIRYLGLAELVL

SEQ ID NO: 51373 - DNA, 699 bp, Geobacter metallireducens GS-15
  CDS (1)..(699): transl_table=11
atgcgactccccacccccctctaccccggcaccctcgtccgccgctaccaacgcttcctggccgacgtgcaactggccgacggcaccattgtcaccgcccactgccccaactcgggaagcatgaaagggtgcaaccttcccggcagcctggtctggctctcgaaaagcacaaatccggcccgcaagctggcctacacctgggaactggtcatggccgacggcttctgggccgggatcaacacggggctgccgaaccggctcgtgcgagaggccatcgaggacggcaccgtgacggagcttcagggatacgggagcatccgccccgaggtgcgctacggggaagaaaggagccggatcgatctgctgctggaaggtgagccggggcgctgctgggtggaggtgaagaacgtgacgctggtggaaggagaacgggccctcttccccgacgccgtgacggaacgggggcagaagcacctgcgggagctgatggagatggtgcggcggggagatcgcggggtgattttctacgtggtgcagcggggggacggcgaggctgtttcaccggccgacgccattgacccgaaatatggacagctcctccggctggccgtggcgaacggcgtcgaggccctcgcctaccgggcactggtgacgccggaggagatccggcttacggagcggctaccggtgattctgtag

SEQ ID NO: 51374 - protein, 232 aa, Geobacter metallireducens GS-15
MRLPTPLYPGTLVRRYQRFLADVQLADGTIVTAHCPNSGSMKGCNLPGSLVWLSKSTNPARKLAYTWELVMADGFWAGINTGLPNRLVREAIEDGTVTELQGYGSIRPEVRYGEERSRIDLLLEGEPGRCWVEVKNVTLVEGERALFPDAVTERGQKHLRELMEMVRRGDRGVIFYVVQRGDGEAVSPADAIDPKYGQLLRLAVANGVEALAYRALVTPEEIRLTERLPVIL

SEQ ID NO: 51375 - DNA, 690 bp, Desulfuromonas acetoxidans DSM 684
  CDS (1)..(690): transl_table=11
atgaatctgcccgaactcaagcgtgccacgctgttaaggcgctataaacgctttttggccgatatcgaatggccggacggcaccacaaccacggtacatacacccaacaccggtagtatgcgccagtgcgccacacccggtgccacggtcctggtctcacacagtgacaacgccaagcgtaaatatccctggacgctggagatgattgaggtcaatggtcactgggtcgatacgaatactcagcgcagcaataaggtggtggccgaagctctgaaattgggtaccatcgagggggtgcagggctatcaggtgtacccggagaaacagctcggtgacagtcggatcgattttctgctggaaaaacccggtcagcgcatgtggctggaagtaaagaacgccaccttgttgattactcgcgcctgtgccggatttcccgatgccgtcaccgagcgggggaggcgccatctccaggagctgatgaaggcggtagatcagggtgatcgtgccggagtgctgtttctggtccagcgcgctgaagcccagttgtttgccgctgccgctgagattgatcccgcctatgccgagcaattggccgtggctctggagcatggggtggaagcctttgcttgccagacccaatccgatgaaaaacagacccgcattgcccggcgtattccggtgcaagtatga

SEQ ID NO: 51376 - protein, 229 aa, Desulfuromonas acetoxidans DSM 684
MNLPELKRATLLRRYKRFLADIEWPDGTTTTVHTPNTGSMRQCATPGATVLVSHSDNAKRKYPWTLEMIEVNGHWVDTNTQRSNKVVAEALKLGTIEGVQGYQVYPEKQLGDSRIDFLLEKPGQRMWLEVKNATLLITRACAGFPDAVTERGRRHLQELMKAVDQGDRAGVLFLVQRAEAQLFAAAAEIDPAYAEQLAVALEHGVEAFACQTQSDEKQTRIARRIPVQV

SEQ ID NO: 51377 - DNA, 726 bp, Jannaschia sp. CCS1
  CDS (1)..(726): transl_table=11
atgcgctttccaaccccgcttgtccccgcccgccttctgcgtcgttacaaacgcttcctgtccgatgccgtgctggaggacgggacggagatcaccgcccattgtcccaacccgggcgcgatgctgggcctgaaagatgacggcgcgcggatctggctgttgcccaatgacgatccgaagaaaaagctgaaatacggttggcggttggtggaactgccagatggccatttcgcgggcatcgatgcgggcctgccgaacgctttggtgaaggaggcgttggccgaggggcagatcgaggcgctgcgcggttattccagtatccggcccgaacagaaatacggcgacgagaacagtcgcattgatttcctgttgtctgagccgggacggcccgatgcctttgttgaagtcaagaattgccaccttcggcgcgagagcgattgggccgaattccccgattgcgtgacggaccgtggcgcgaagcatctgcgtgagctgacaaagattgcccgaagcggggggcgcgcggtcatgctgtatgtcgtgcagcgtaccgattgcgcgcgcttccgcctcgcgccggatctggacccggcctatgcccgcgccttcgatgcggcccgtgatgcgggcgtggaagtgctttgccacggcaccgatattacgcctgaggggatcacccttacgggaccattgcctgtcgacccatcgccgcaggcgcgggactga

SEQ ID NO: 51378 - protein, 241 aa, Jannaschia sp. CCS1
MRFPTPLVPARLLRRYKRFLSDAVLEDGTEITAHCPNPGAMLGLKDDGARIWLLPNDDPKKKLKYGWRLVELPDGHFAGIDAGLPNALVKEALAEGQIEALRGYSSIRPEQKYGDENSRIDFLLSEPGRPDAFVEVKNCHLRRESDWAEFPDCVTDRGAKHLRELTKIARSGGRAVMLYVVQRTDCARFRLAPDLDPAYARAFDAARDAGVEVLCHGTDITPEGITLTGPLPVDPSPQARD

SEQ ID NO: 51379 - DNA, 687 bp, Desulfitobacterium hafniense DCB-2
  CDS (1)..(687): transl_table=11
atgaagtacaccaatatcagagaaggacaatttctttctcgtcccaatcggttcattgctaaggtggaaatcgacggtaaagaggaaatctgtcatgttaaaaatacaggccgctgcagggaattattaataccgggagtgacggttttccttcaagaagcggattttgagcatcggaaaacaaaatacgacctgatcggagttcgcaaagggaataggctgattaacatggacagtcaggtgccgaacaaggtgtttcgtgaatggttggagaaagggtattttcaggagcttcagcatattaagcaggagcagacctttcgaaattcgcgctttgatttttatctggaggcaggacagagaaaaatctttgttgaagtgaaaggggtaaccttagaggaagagggagttgcgctctttcccgatgcccccacagaacggggggttaagcacctgcgcgagttgagccaggctgtggctgcagggtatgaagcctatgtggtgttcatcattcaaatgaaagatattcactatttcacccccaacatcaagacccaccaagcctttggggattcattgattcaggctgaaaagcagggagtaaaaattctcgctctggactgcgaggtcacggaagattctatagaggctggggattttgtgacggtcaaattagttgagggttaa

SEQ ID NO: 51380 - protein, 228 aa, Desulfitobacterium hafniense DCB-2
MKYTNIREGQFLSRPNRFIAKVEIDGKEEICHVKNTGRCRELLIPGVTVFLQEADFEHRKTKYDLIGVRKGNRLINMDSQVPNKVFREWLEKGYFQELQHIKQEQTFRNSRFDFYLEAGQRKIFVEVKGVTLEEEGVALFPDAPTERGVKHLRELSQAVAAGYEAYVVFIIQMKDIHYFTPNIKTHQAFGDSLIQAEKQGVKILALDCEVTEDSIEAGDFVTVKLVEG

SEQ ID NO: 51381 - DNA, 744 bp, Methanococcoides burtonii DSM 6242
  CDS (1)..(744): transl_table=11
atggttcgcaatgatctggtaatggagatcccatgggatattgaagctacacttctgtcaagacctaacaggtttcttggcatcgtggaaatggatgaatctacatcttctggaccctttcaggagaaagttcatattcatgatcctggcagacttgaggatctactttatcccgggaacaggcttcttttgagaaaagctaccaaccccaaacgtaaaacagggtgggatgtaattgctgcaaaggctgatgatgggtggatattgataaattccatatttcatcgcagaatcgccgaatgggcaatagcaaataaggtgtgttcttgttttgagaatgtacttgaggtcatacctgaacagaagtttggagatagtcgtctggattttttgttgaagaaaagtgatactgaactatgggtggaagtaaaagggtgtacacttatctatggtaatactgccacttttcctgatgctcccactacaagagggaaaaggcatgtgggggagttgaagaaggcattggaaagtggatctgaggcacttatactgatcatcattctccgaaaagatgctttatgttttaaagcgaatgcgagtattgatcctgattttgcagaagtgttcaaggatgctgtaaatgcaggggtgcaagtatgtcctttagtatttggttatgagggaagggaactattctataagggaatggttcctttatgcactgaagaatacaattccatttaa

SEQ ID NO: 51382 - protein, 247 aa, Methanococcoides burtonii DSM 6242
MVRNDLVMEIPWDIEATLLSRPNRFLGIVEMDESTSSGPFQEKVHIHDPGRLEDLLYPGNRLLLRKATNPKRKTGWDVIAAKADDGWILINSIFHRRIAEWAIANKVCSCFENVLEVIPEQKFGDSRLDFLLKKSDTELWVEVKGCTLIYGNTATFPDAPTTRGKRHVGELKKALESGSEALILIIILRKDALCFKANASIDPDFAEVFKDAVNAGVQVCPLVFGYEGRELFYKGMVPLCTEEYNSI

SEQ ID NO: 51383 - DNA, 699 bp, Moorella thermoacetica ATCC 39073
  CDS (1)..(699): transl_table=11
atggtcgaactacccgccaatttgattaaagctacctttctttcccggccgaaccgttttacagtggtggctgccagggaaggggagaagctggttgccttcctggccgacccggggcgcttgacggaactgttgctgcccggggctgaggtctacttggccccggcgtcacggcagggggataggaaaacggcctacgacgtggtcctgctccgccagaacggtacctttatttccctggacagccgcctgcccaaccgcctctttgccgccgccttacaggccgggagccttgaacccttcaaaggttaccggctgcgggcgaccgaggtccgggccggttccagccgcctggactttttactccagggtgatggacaccccccctgctacgttgaggtaaaatcggtaaccctggtaagaggtgggctggcccttttccccgatgccccgactgctcgcggcagccgtcacctgcgggagttgatggccctgcactcccggggctaccgggcggcagccgtttttatcatccagcgggaagatgctatcagcctggcccccaacgaggttaccgacccttgcttttccagcaccatcagagaagcggctgccgccggggtggaaatctatgcctaccgctgccatatcgacccggtgacagtcagcctgatcgctcccgtaatggtaaaactttag

SEQ ID NO: 51384 - protein, 232 aa, Moorella thermoacetica ATCC 39073
MVELPANLIKATFLSRPNRFTVVAAREGEKLVAFLADPGRLTELLLPGAEVYLAPASRQGDRKTAYDVVLLRQNGTFISLDSRLPNRLFAAALQAGSLEPFKGYRLRATEVRAGSSRLDFLLQGDGHPPCYVEVKSVTLVRGGLALFPDAPTARGSRHLRELMALHSRGYRAAAVFIIQREDAISLAPNEVTDPCFSSTIREAAAAGVEIYAYRCHIDPVTVSLIAPVMVKL

SEQ ID NO: 51385 - DNA, 705 bp, Shewanella baltica OS155
  CDS (1)..(705): transl_table=11
atggaatttactccgcgactacaacagggtattttactgcgccgctataaacgttttctggccgatgtgcagttaagcgacggcagtgagatcactctgcattgccccaatacgggttctatgcgtaattgcctgtatcccggtgaaaccgtctggttttctacctctgataaccctaaacgtaagtacgcccatacatgggaactgatgactacgcctgattctggcttgatcggtatccactcgggtcaggccaacaccttagccgaagaagccatcaataaaggcatcatcaaggagctcacgggttatgacagcctaagccgtgaagttaaatatggtgatgaaaatagccgcatcgacatcctgctacagggtgctcaaaaacccgcctgttatatagaagtcaaaagttgtactttgctcgaggatggccaaggttattttcctgatgctgtgagcctacgaggtcaaaaacatttacgtgaattgatgcacatggtcagccaaggccacagagccgtattgctgtttgtggtgcagcacagtgacatctttagtgttgcccccgcagcacatatcgaccctgaatatgctaagttactgaaaaaagcagtgttagctggagttgaagtccttgcctatcgctgtgaaatgtccccgactgagattcacctagcccaagcctgtgttgtccgagtatga

SEQ ID NO: 51386 - protein, 234 aa, Shewanella baltica OS155
MEFTPRLQQGILLRRYKRFLADVQLSDGSEITLHCPNTGSMRNCLYPGETVWFSTSDNPKRKYAHTWELMTTPDSGLIGIHSGQANTLAEEAINKGIIKELTGYDSLSREVKYGDENSRIDILLQGAQKPACYIEVKSCTLLEDGQGYFPDAVSLRGQKHLRELMHMVSQGHRAVLLFVVQHSDIFSVAPAAHIDPEYAKLLKKAVLAGVEVLAYRCEMSPTEIHLAQACVVRV

SEQ ID NO: 51387 - DNA, 714 bp, Shewanella amazonensis SB2B
  CDS (1)..(714): transl_table=11
atggaatacccagcccccctgtccagcgctgtgctcattacccgctataaacgatttttagccgatgtcaccctggaggacggcagtcagacaaccctgcactgccccaataccggctcgatgaaaaactgcctgtatcccggtaaacgggtgtggttttcgacctcggacaaccccaagcgcaagtacgcccacacctgggagctggccgaggatgaccggggcaacctgattggcattaacacggcgcgggccaatcaacttgccgaagaagccattgggctggggcagatatccgagcttcagggctacaaccaaatccgccgcgaagtgaagtatggcaatgagaacagccgcatcgatttactgctgagtgaggggcaagccccagactgctatatagaagtcaaaagttgcactctgttggaccatgactggggactgtttcccgacgcagtatccacccgtggacaaaagcacctgcgggagctgatggagatgaaacgccagggctaccgggcggtgctgctgtttgtggtgcaacatcaggggatccacagagtagcgcctgccgaggctatagatcccaaatatgcggcgctgctgagggaggccattgcggccggtgttgaagtgctggcctatggatgtatgatgaataacaaaggcttgcagttaaacatcccgatacctttccaccctgatgcggggtaa

SEQ ID NO: 51388 - protein, 237 aa, Shewanella amazonensis SB2B
MEYPAPLSSAVLITRYKRFLADVTLEDGSQTTLHCPNTGSMKNCLYPGKRVWFSTSDNPKRKYAHTWELAEDDRGNLIGINTARANQLAEEAIGLGQISELQGYNQIRREVKYGNENSRIDLLLSEGQAPDCYIEVKSCTLLDHDWGLFPDAVSTRGQKHLRELMEMKRQGYRAVLLFVVQHQGIHRVAPAEAIDPKYAALLREAIAAGVEVLAYGCMMNNKGLQLNIPIPFHPDAG

SEQ ID NO: 51389 - DNA, 729 bp, Enterococcus faecium DO
  CDS (1)..(729): transl_table=11
ttgaagtatcagcaagtggaaatagctttttttattgaccgcccgaatcggtttatagcacattgtatgaaaaaagacggagaaataattattgcgcatgtcaaaaatacaggtagaggaaaagaggtcctgataccaggcgctgaagtggctattgtatttgctcctggacctaaacggaaaaccgcctatgatctgattgctgtaaaaaagaagggtgactggtttaatatcgatagtcaattgcctaatcggctggcaattgatggtattttagacggcacgatccttttaccaggattaactggtccatttacggtatacaagcgtgaagtaacttatcttcactccaaatttgatatttatttagagacggtggtcggacaaaaagcatttgttgaagtcaaaggtatgacacttgaaaataaagcgattggtgcttttcctgatgcgcccacactcagaggattgaaacatataggagaattaacgtatgccgcacaagatggttatgccgcttatgtcttgtttattgctcagttcgaacatcttcatctggcaacgatccatgaagaaatgcaaccagcactagctgatatggttcgacatgcgcagcaaagcggagttcaaatcctcgcctataattgtcaagtatcggcagatgaggtaactgtcaagcaggccattccatttgatgtagatatcccttttgaagatcctatacaatag

SEQ ID NO: 51390 - protein, 242 aa, Enterococcus faecium DO
MKYQQVEIAFFIDRPNRFIAHCMKKDGEIIIAHVKNTGRGKEVLIPGAEVAIVFAPGPKRKTAYDLIAVKKKGDWFNIDSQLPNRLAIDGILDGTILLPGLTGPFTVYKREVTYLHSKFDIYLETVVGQKAFVEVKGMTLENKAIGAFPDAPTLRGLKHIGELTYAAQDGYAAYVLFIAQFEHLHLATIHEEMQPALADMVRHAQQSGVQILAYNCQVSADEVTVKQAIPFDVDIPFEDPIQ

SEQ ID NO: 51391 - DNA, 699 bp, Magnetococcus sp. MC-1
  CDS (1)..(699): transl_table=11
gtggagtatccaacgccactaacgcccgcccgcatggtgcaacgctataaacgttttttaagcgatgtcaccctggccgatggcactcaagtaaccgcccactgtgccaactccggctccatgcgcgggttggtgcatgtgggtgagcctgtctacctctcccactcggacaaccccaagcgcaaactggcctggaccctggagttggtgtgcgatggtggcgcgctggttggggtcaatacgggcttggccaatgcactggtggccgaggcgctacagcaagaccgcatcccccctttacaggggtttgcccactttaggcgagaggtcccctatcaggactctcgcctggatttttgcctaaccgcccccgctggtgcgttaacctatgttgaggtgaagagcgttaccctgcgcttgaccgacgaagccgcttttcccgacgcggtaaccaagcgcggcgcaaaacatctggcggctttgcgccatgcggttaaagctggacatcggggggtgatcctgtttattgtccagcgttcggatctcgaccattttcgccctgctcatgagattgatccaggctatgcccagacgctacaatgggcgatctccgagggggttgaaatactggtttatgcctgcgcgctcaccacggcatccatctacgttgaacgccctttaagctatacgctcggttga

SEQ ID NO: 51392 - protein, 232 aa, Magnetococcus sp. MC-1
MEYPTPLTPARMVQRYKRFLSDVTLADGTQVTAHCANSGSMRGLVHVGEPVYLSHSDNPKRKLAWTLELVCDGGALVGVNTGLANALVAEALQQDRIPPLQGFAHFRREVPYQDSRLDFCLTAPAGALTYVEVKSVTLRLTDEAAFPDAVTKRGAKHLAALRHAVKAGHRGVILFIVQRSDLDHFRPAHEIDPGYAQTLQWAISEGVEILVYACALTTASIYVERPLSYTLG

SEQ ID NO: 51393 - DNA, 681 bp, Ferroplasma acidarmanus Fer1
  CDS (1)..(681): transl_table=11
atgtatccatttatagagagggaaccgggatatgttgttgcaaaatttccgaaccttattgaagcaaaagttgtctcccgtccaaatagattcatggtaaaagcaatggtagatgataaggaagtggatgttcatatacacgatccaggaaggcttgaagaacttatatttcccgggaattcaatactgataagggaaactaatggtacaaaaacacattattctgtaactttttgcaaaaatgatgatatctggacatttaacgattctagataccattccggtatagcctctatgtttatccaggaagggtggcagagggaggttaaagtgggaaacagcagattggatttcaggcttaacaatgcatacatagaagtaaagtctgcaacacttgtagaaaatgggattgccagatttcccgatgcacccaccctgaggggaaaaaagcatcttgaaacccttatggatcttatagcctcgggttatgaatcatttgttttatttctcattttcaatgagaatgccaaatgttttcttccaaatactgccagggaccctgaattttcacatgcatattattcaactctggaacacggggtaaaattccagtacctggtattttcatccagtggtggtgaaattgttttaaaagattcaatatccatgtgcaatccctga

SEQ ID NO: 51394 - protein, 226 aa, Ferroplasma acidarmanus Fer1
MYPFIEREPGYVVAKFPNLIEAKVVSRPNRFMVKAMVDDKEVDVHIHDPGRLEELIFPGNSILIRETNGTKTHYSVTFCKNDDIWTFNDSRYHSGIASMFIQEGWQREVKVGNSRLDFRLNNAYIEVKSATLVENGIARFPDAPTLRGKKHLETLMDLIASGYESFVLFLIFNENAKCFLPNTARDPEFSHAYYSTLEHGVKFQYLVFSSSGGEIVLKDSISMCNP

SEQ ID NO: 51395 - DNA, 702 bp, Mesorhizobium sp. BNC1
  CDS (1)..(702): transl_table=11
atgatatttccctccccgctcaccgaagcccggctcatccgccgctataagcgctttctggccgatgtagtgcttgcggacggaacggaacttacggtttcagtgcccaataccggatcgatgctcgggctcaccgcgccgggatcgcgcgtgctcttgtcgaaatgggacgatccgaaacgcaaatatccctatcggctggaaatcgtggaagcggacggaacgctggtgggtatcaatacaggcctgccgaaccggcttgcggcggaggctatccgcgcccgtctggtgggcgacctcggcacatatccggtgatacggcccgaacagcgctatggcgagcgctcgcgcatcgactttcttctggagcacccggagcgcccgccagcctatgtggaggtgaaaaacgtgcatttcatgcgcgaggccgggcttgccgaatttccggatacgaggacggaccgcggcgcccggcacctcgacgagcttgcagccatgcgcagggcaggcaaccgcgccgtcatgatctatgtggtccagcgggccgattgctcccgattccgcctttgcgcggatcttgacgcctcttatgccgcggctttcgggcgcgcgagggatgcgggggttgaagctttcgtgatagggtgccaaatctctgccgacgcgatcgctcccgatcgcctgatcgatttggatttttag

SEQ ID NO: 51396 - protein, 233 aa, Mesorhizobium sp. BNC1
MIFPSPLTEARLIRRYKRFLADVVLADGTELTVSVPNTGSMLGLTAPGSRVLLSKWDDPKRKYPYRLEIVEADGTLVGINTGLPNRLAAEAIRARLVGDLGTYPVIRPEQRYGERSRIDFLLEHPERPPAYVEVKNVHFMREAGLAEFPDTRTDRGARHLDELAAMRRAGNRAVMIYVVQRADCSRFRLCADLDASYAAAFGRARDAGVEAFVIGCQISADAIAPDRLIDLDF

SEQ ID NO: 51397 - DNA, 717 bp, Silicibacter sp. TM1040
  CDS (1)..(717): transl_table=11
atggcccatcaccacggcatgagatttccgacccccttgatccccgcgaccttgatcaaacgctacaaacgctttttggcggattgccggcttgaggacggccgcgagatcacggcccattgcgccaatccaggctcgatgatgggcttggccgagccgggcatgcgggtctggctggaacccaacgacgacccgaagaaaaagctcaaatacggctggcggctggtggagcatacgaatggccatttcaccggtgtcgatacatctgttccaaatcgtgcgctcaaagccgcgctggaggcgcacgaaattgcagaattcgccgcctactccgaggttcaggccgaggtgaagtacgggcagaacagccggatcgactttttgctgacggatgcgaagctgccgcggtgctatgtcgaggtcaaaagcgtgacactgtcacgccagccgggccttgcggagtttcccgatagcgtcaccgcgcgggggaccaaacaccttcgcgaactagcagctatggcggaagccggccacagggccgtgatgctctatctcgttcagcgtacggattgcgaccgctttgctctcgccgctgatatagacccagcctacgctgccgagttcgaaaccgcccacgccaaaggcgttgagcggctggtgatcggcaccaccatcacgccagagggcgtaaaaataggcgatatcctcccgagctaa

SEQ ID NO: 51398 - protein, 238 aa, Silicibacter sp. TM1040
MAHHHGMRFPTPLIPATLIKRYKRFLADCRLEDGREITAHCANPGSMMGLAEPGMRVWLEPNDDPKKKLKYGWRLVEHTNGHFTGVDTSVPNRALKAALEAHEIAEFAAYSEVQAEVKYGQNSRIDFLLTDAKLPRCYVEVKSVTLSRQPGLAEFPDSVTARGTKHLRELAAMAEAGHRAVMLYLVQRTDCDRFALAADIDPAYAAEFETAHAKGVERLVIGTTITPEGVKIGDILPS

SEQ ID NO: 51399 - DNA, 810 bp, Shewanella denitrificans OS-217
  CDS (1)..(810): transl_table=11
atggcatcagtgtactggatccctaagcttaggataatccctaggacaaaatttgttaccatatgccccattaccctcacactgagtttaagcatgcaatactcccctaatttggctcacggtactttgttaagacgttacaagcgcttcctggccgatgtactgctggacgatggcacagaaatcacgctgcattgccccaatacgggttcgatgaaaaactgcctgtttcccggtgaaactgtgtggttttcaacatcaaacaaccctaagcgtaaatatgcccacacctgggagcaaagcagcacccctgacaagcagttaatcggcatcaataccggccgcgctaacgccttagcagaagaggccatcaatcttggggtgatcaaagaattgactggctatgacaggctacagcgtgaagtcaaatatggtgaagaaaatagccgcatcgatatcctgcttagcagtgacactcgagcaagctgttatattgaagttaaaagttgtaccttattagaagagggttcaacgtcaggcagaggatattttccagactctgtgactgtccgaggccaaaaacacttacgtgaacttattcacatggtaaaacaaggacatagggcggtattactttttgtagttcagcactcaggtattaacagcgtaagccctgcaaggcatatagatgtagcctatagcgaattattcactcaagcgctcgacgcgggagtcgaagtattagcctatcagacacaaatgtcgcctcaggaaagtcaaatactgacttcttgccctgtgataacttaa

SEQ ID NO: 51400 - protein, 269 aa, Shewanella denitrificans OS-217
MASVYWIPKLRIIPRTKFVTICPITLTLSLSMQYSPNLAHGTLLRRYKRFLADVLLDDGTEITLHCPNTGSMKNCLFPGETVWFSTSNNPKRKYAHTWEQSSTPDKQLIGINTGRANALAEEAINLGVIKELTGYDRLQREVKYGEENSRIDILLSSDTRASCYIEVKSCTLLEEGSTSGRGYFPDSVTVRGQKHLRELIHMVKQGHRAVLLFVVQHSGINSVSPARHIDVAYSELFTQALDAGVEVLAYQTQMSPQESQILTSCPVIT

SEQ ID NO: 51401 - DNA, 705 bp, Shewanella frigidimarina NCIMB 400
  CDS (1)..(705): transl_table=11
atgaaatttactcccgaattagagtccggtgtattaattaaacgatacaaacgctttcttgccgatatcatgctacctaacgggcaagaaatcactattcattgcccaaatactggttcaatgaaaaattgcttattccctggtgaaaaggtgtggttttccacctccgacaatccaaaacgaaaatatgcccacacatgggaactaatgcagacagatcagcagcattatatcgggattaataccggacgagccaatgctcttgcagaagaagcgattaatcggcaagtgattaccgaactgttaggttacgagcatttaaaacgtgaagtgaagtacggcagtgaaaatagccgcatcgatatcttgctcactagccaaaaccgacctgagtgctatattgaagtgaagagctgtactttgctagaagatcaaatgggttacttcccagatgctgtaaccacgcgtggacagaagcatctgcgagaattaatccacatggtggaattaggccatcgtgcggttttattatttgtggtgcagcacagtgccatcacgagtgttaaacccgcgcgacacatagatccacattacgcagacttacttgaacaagccgtagcaaatggcgttgaagtgctagcttacaaaacagcgctttcgccacagggaagcctgatcacttcagcttgtaaagtcatgctgtag

SEQ ID NO: 51402 - protein, 234 aa, Shewanella frigidimarina NCIMB 400
MKFTPELESGVLIKRYKRFLADIMLPNGQEITIHCPNTGSMKNCLFPGEKVWFSTSDNPKRKYAHTWELMQTDQQHYIGINTGRANALAEEAINRQVITELLGYEHLKREVKYGSENSRIDILLTSQNRPECYIEVKSCTLLEDQMGYFPDAVTTRGQKHLRELIHMVELGHRAVLLFVVQHSAITSVKPARHIDPHYADLLEQAVANGVEVLAYKTALSPQGSLITSACKVML

SEQ ID NO: 51403 - DNA, 786 bp, Syntrophobacter fumaroxidans MPOB
  CDS (1)..(786): transl_table=11
atgaccgattccgcgaagccgcagaaccccgatcccgggcatgagagccgccgcgtggccccgctcgcgggttcgccgagatccccgttcctgatcgaattcccggaggacagtttcaccgccgttttcctggggcgggaaaaacgtttccttgtcgaggccgaacgaaacggacacctgtttcaggcacactgcaacaattccgggagcatgctcggcctgctgcggccgggaagcgacatcctgctttccgtatcccccaacccctcgcgtcgactgccctacacgctcgaatccatcaagctcggaagccactgggtgggagtgaacacgctcgtacccaaccggatcctcaggctcgcctgggacaggggaatactgccggagttgataggttacgatcgatttcagaacgaaaaaacctccggcgagagccgtctggacgcctttgcggaaggacccgcggggcaggtctggatcgaggcgaaaaacgtgacgctggtggaggacgacgtcgcctgtttcccggatgcggtgaccgtacgcgggcaaaaacacatgagggaactgacggcgctggcgcgcgcgggccggagggccgcctgcttcttcctggtccagcgaccggatgcttcgtgcttcgctcccgccgatttcatcgacccggtttatgccgagctttttcacgcagcagtgcatgcgggcgtggagatctggccgtacgaggcggttgtcacccggcaggggattgctctgggccgcaggctgaaagtggtggggcactga

SEQ ID NO: 51404 - protein, 261 aa, Syntrophobacter fumaroxidans MPOB
MTDSAKPQNPDPGHESRRVAPLAGSPRSPFLIEFPEDSFTAVFLGREKRFLVEAERNGHLFQAHCNNSGSMLGLLRPGSDILLSVSPNPSRRLPYTLESIKLGSHWVGVNTLVPNRILRLAWDRGILPELIGYDRFQNEKTSGESRLDAFAEGPAGQVWIEAKNVTLVEDDVACFPDAVTVRGQKHMRELTALARAGRRAACFFLVQRPDASCFAPADFIDPVYAELFHAAVHAGVEIWPYEAVVTRQGIALGRRLKVVGH

SEQ ID NO: 51405 - DNA, 753 bp, Trichodesmium erythraeum IMS101
  CDS (1)..(753): transl_table=11
atgatttgttatccaataattatgaataatcaactaaaattctcttacaaatatccttctcttgaaccaggtattttaattaaacgttataaaaggtttctggcagatatagagttaaagtctggaggaattattactgctcactgcccaaatacgggtccaatgactggagtttctactccgggaagtaatgttatggtttcttatagtaataatccaaaacgaaaattagcttacacttgggaattaattgaagtaactgataatgaaccgacttgggtgggaattaatacggctttaccaaatcgagttattaagttggcgttggccgaaaatttatttcctgaattgggagattattatgaagttaaaacggaagttgtttatggaaaagataggaaaagtagggttgattttaagttaattagtgagactaaaaatatttatcttgaggttaagaatactacttgggcagatggaagagttgctttatttccagatacggttacaaaaagagggcaaaaacatttacgtgaattaataggggtagttgaacaaggggaaagagctgtatgtttgtttttgataaatcgtggtgattgttatcagtttgctcctggagatgttgctgatcatgattatggtaaacttttgagagaagctatgattaaaggggtggaaattttgccttgtagatttatagttactcctcaagaaattaattatttggggatagcagaatttatcaattag

SEQ ID NO: 51406 - protein, 250 aa, Trichodesmium erythraeum IMS101
MICYPIIMNNQLKFSYKYPSLEPGILIKRYKRFLADIELKSGGIITAHCPNTGPMTGVSTPGSNVMVSYSNNPKRKLAYTWELIEVTDNEPTWVGINTALPNRVIKLALAENLFPELGDYYEVKTEVVYGKDRKSRVDFKLISETKNIYLEVKNTTWADGRVALFPDTVTKRGQKHLRELIGVVEQGERAVCLFLINRGDCYQFAPGDVADHDYGKLLREAMIKGVEILPCRFIVTPQEINYLGIAEFIN

SEQ ID NO: 51407 - DNA, 693 bp, Pelobacter propionicus DSM 2379
  CDS (1)..(693): transl_table=11
gtgagactccctccgctgatagccggaacactggtcaggcgctacaagcgtttcctggccgatgtgatcctggaggacggcagccccgtcacggtccactgccccaattcgggaagcatgaagggatgcgcgtcccccggcagccgggtgctgctctcccgcagcgccaatccgggccgcgcctatcccctcacctgggagctggtggagtcggacggatgctgggccggcatcaacacctccctgcccaaccgcctggtgcgggaggccatcgagaacggcaccgtggtggaactccgggggtatgacagcatccggcccgaggtagcctacggccagcggagccgcatcgatctcctcctggaggggccggccgggcgctgttatgtggaagtcaagaacgtcaccctggtggagggggaaagggcactcttccccgatgccgtgacggtccgcggccagaaacacctgaacgagctgatgcgggtggtcagggagggggaccggggagtgatcttcttcaccgtccagcggggcgatgccgagagcgtttctccggcggacgccatcgacccggagtacggcaggctgctgcgactggcgctggacagcggcgtggaagcgctggcctaccgggccgttgtctcacctgaggagatccgcctgaaggaacggcttccggtgatcctgtag

SEQ ID NO: 51408 - protein, 230 aa, Pelobacter propionicus DSM 2379
MRLPPLIAGTLVRRYKRFLADVILEDGSPVTVHCPNSGSMKGCASPGSRVLLSRSANPGRAYPLTWELVESDGCWAGINTSLPNRLVREAIENGTVVELRGYDSIRPEVAYGQRSRIDLLLEGPAGRCYVEVKNVTLVEGERALFPDAVTVRGQKHLNELMRVVREGDRGVIFFTVQRGDAESVSPADAIDPEYGRLLRLALDSGVEALAYRAVVSPEEIRLKERLPVIL

SEQ ID NO: 51409 - DNA, 717 bp, Pseudoalteromonas haloplanktis TAC125
  CDS (1)..(717): transl_table=11
atgaagtaccaacctgccctgcaatcagccaccttattaaaacgctataaacgttttttagctgatttacagctcagtgatggctcagagtttaccgcccattgtgccaatacaggtaaaatgactggctgcgctgaacccggttttaatgctttttactccaccagtactaatagcaaacgcaaatacccgcaatcgttagagctcacccaaaatagcttatcgcaacttatttgcgttaataccgcagtggcaaataaagttgttgctgaagctataaatgccaatcttattagtgagcttagcaattatgagcaattacaaagcgaagttaaatatggcaacgaaaacagccgtatcgactttttactaaccagcgatgagcgtcctaattgctacgttgaagttaaatcggtaacgctcttaagccaagataacccccacagtggccaaggctactttcctgatgcaccaactctgcgcgggcaaaaacatattcgcgaattaatagagatggtagagcaaggtcatcgtgcagtattgctttttgctgtactgcaccagggaataaaccaggtaagcgctgctgctcatatagacaataaatatgcacagttactaaatgaggcaattaaccaaggcgttgaggtattagcatataaagcagatatttctaccaacgaaatcatcttaaaagagaagctcccttttatataa

SEQ ID NO: 51410 - protein, 238 aa, Pseudoalteromonas haloplanktis TAC125
MKYQPALQSATLLKRYKRFLADLQLSDGSEFTAHCANTGKMTGCAEPGFNAFYSTSTNSKRKYPQSLELTQNSLSQLICVNTAVANKVVAEAINANLISELSNYEQLQSEVKYGNENSRIDFLLTSDERPNCYVEVKSVTLLSQDNPHSGQGYFPDAPTLRGQKHIRELIEMVEQGHRAVLLFAVLHQGINQVSAAAHIDNKYAQLLNEAINQGVEVLAYKADISTNEIILKEKLPFI

SEQ ID NO: 51411 - DNA, 708 bp, Nitrosococcus oceani ATCC 19707
  CDS (1)..(708): transl_table=11
atgagttttgatcaaattctgctccccggcatattacggcgccgctaccagcggttttttgctgacgtagcgcttgaaaccggtgaatctatcgtggcccactgtcccaatacgggatcgatgcggggattagccgaacctgggctaggagtttacgtttcccgcgctaacaacccccgccgtaaacttgcttacacactagagctagtggacgctcacaccagcctggtgggtgtgcacacgggccgcgctaacattttgacgaaagaagccatcgcagcagggagaatatcccaactcttaggctatggagaaatccgccaggaagtccgctacagcaaaaattcccgaattgatcttctcctggaagacccttctacccagcaatgctgttacgtggaagtcaaaagcgtcaccctcaggcaaggtgacggggcggcctgcttccctgatgccgtcaccacccgtggcgccaagcatctggatgacttggctgccaccgtatgttccccccgccagcgggcggtcatgttctatcttgtgcagcgggaggattgccgctactttacccccgctgatgatatcgatccccgctatggcgctaagctccgctccgctatcgagcaaggagtcgaaatattggcctacgcctgccaagtctcctcccagggtattcaagtcacccagtcgctgcccatccatttatag

SEQ ID NO: 51412 - protein, 235 aa, Nitrosococcus oceani ATCC 19707
MSFDQILLPGILRRRYQRFFADVALETGESIVAHCPNTGSMRGLAEPGLGVYVSRANNPRRKLAYTLELVDAHTSLVGVHTGRANILTKEAIAAGRISQLLGYGEIRQEVRYSKNSRIDLLLEDPSTQQCCYVEVKSVTLRQGDGAACFPDAVTTRGAKHLDDLAATVCSPRQRAVMFYLVQREDCRYFTPADDIDPRYGAKLRSAIEQGVEILAYACQVSSQGIQVTQSLPIHL

SEQ ID NO: 51413 - DNA, 678 bp, uncultured euryarchaeote Alv
  CDS (1)..(678)
atgtggaaagtgatggacataccggtaagtaagcaaacggtatttttagagcgaaagaatcgttttctgggggtggttgagggcggaataaaagtgcatgtccacgaccccggccggctggaagaactgctttatccgggcaatgaggtgcttattcttcatactcccggtaaacacagaaagacggagtgggaccttattgccgcccgcgcacctgaggacggctcgtgggtgctggtgcattcagggtaccacaggcgcatatcggagcgcatactggaaaaaatgttttccgaagcggatataaacccggaggtaaggctgggtgagagccgcatagattttatgatacgtggtaatggagacattgcggtggaggtgaagggctgcactcttgcaagaaacgagattgcgcttttccccgacgcgcccaccacccgtggcacccgccatgttcacgagttaatacaatttaaaaaagcgggtaatgaagcaatgctcctgattctaattttccgcaacgcacggtgctttgcacccaactccgacaccgacccgaaatttgcagatgcgttcagagctgcggtgaatgtgggagtgagagtcgcgccagtgcgccttgtttattctccgccgggagtttattttgtggaggagctgccgctctgcgagcgctga

SEQ ID NO: 51414 - protein, 225 aa, uncultured euryarchaeote Alv
MWKVMDIPVSKQTVFLERKNRFLGVVEGGIKVHVHDPGRLEELLYPGNEVLILHTPGKHRKTEWDLIAARAPEDGSWVLVHSGYHRRISERILEKMFSEADINPEVRLGESRIDFMIRGNGDIAVEVKGCTLARNEIALFPDAPTTRGTRHVHELIQFKKAGNEAMLLILIFRNARCFAPNSDTDPKFADAFRAAVNVGVRVAPVRLVYSPPGVYFVEELPLCER

SEQ ID NO: 51415 - DNA, 723 bp, Aeropyrum pernix
  CDS (1)..(723): transl_table=11
gtggctgtggagctgcggtatgacgaggaggcagtgttcctaaggagggtgaacaggttcgttgtggaggtcaagagtagccgcggggtggttaggtgccacctgatggacactggcaggatagaccatctagcaagccctgggaggcggggagtgctgatagcctggctcaataggctcggaggcaagaccgtgtgccgtgcacaggctttcaagactgctggtggcgtagtggctgttgtcgactcgcgggtgcccaacaggctgttcgccgaggcggccccgatggtggttgggggtgacgcctcgatcgaggctgagagggaggtcttcggctcgaggctggacttcctcatatccactgggagggggctctgggctgttgaggttaagggcgtaaacctctcgctcgacggcgtcggcctgttccccaacgcccccagcgcaagggctgttaagcacctggaggtcctcgccaggctcgcgagggagggtgtgaagcctctcatggcgttcgtggccctcaggcctgacatcagggtattcgcccccaactacagggtcgacaggaggttcgccagcctggcctgcaccctcctgagaagagggctcgtgggcatggtgggcatcagggtctccatcgacctggagcctggggtggtgaggataaggcctgtagccacagcccccgtccaatgccccccactccagcctgggcgataa

SEQ ID NO: 51416 - protein, 240 aa, Aeropyrum pernix
MAVELRYDEEAVFLRRVNRFVVEVKSSRGVVRCHLMDTGRIDHLASPGRRGVLIAWLNRLGGKTVCRAQAFKTAGGVVAVVDSRVPNRLFAEAAPMVVGGDASIEAEREVFGSRLDFLISTGRGLWAVEVKGVNLSLDGVGLFPNAPSARAVKHLEVLARLAREGVKPLMAFVALRPDIRVFAPNYRVDRRFASLACTLLRRGLVGMVGIRVSIDLEPGVVRIRPVATAPVQCPPLQPGR

SEQ ID NO: 51417 - DNA, 720 bp, Agrobacterium tumefaciens
  CDS (1)..(720): transl_table=11
atgctcttcacgcctccgctcattcccgccacactgatttcccgctacaagcgtttcctgttcgatgccgttctggaggacggcaccgcgattaccggctcctgccccaataccggctccatgcgtgggctgacgacaccgggctcccgtatctggctctccgagcatgacagcccgacccgcaagtaccggcacatgtttgaaatggtcgaggccgatggcaccgtggtcggtatcaataccggcatgccgaaccggctggcggaagaagcgatcctgaatggccgcatcccggaactggccggctattcgacaatccgccgcgaacagaaatacggccgcaattcccgcatcgatttcctgctgtcggaacctggtcggccggatgcctatgtggaagtgaagaacgtgcatttcatgcgcgagaagggtcttgccgaatttcctgatacagccaccaaacgtggcgccaaacatctggaggaactgggtgacgcagcggaagctggttaccgctcagtgatgctctatctcatccagcgcgacgattgcgagcggatgcgcatctgcgccgatctcgaccccatctatgcactggcctttcagcgggcgatggcacgcggggtggaggcctatgcggtgaaatgcgcggtctcgccgacacaaatttcggtcagcggaacggttaagatggacgaatggcgtccggctgttttatga

SEQ ID NO: 51418 - protein, 239 aa, Agrobacterium tumefaciens
MLFTPPLIPATLISRYKRFLFDAVLEDGTAITGSCPNTGSMRGLTTPGSRIWLSEHDSPTRKYRHMFEMVEADGTVVGINTGMPNRLAEEAILNGRIPELAGYSTIRREQKYGRNSRIDFLLSEPGRPDAYVEVKNVHFMREKGLAEFPDTATKRGAKHLEELGDAAEAGYRSVMLYLIQRDDCERMRICADLDPIYALAFQRAMARGVEAYAVKCAVSPTQISVSGTVKMDEWRPAVL

SEQ ID NO: 51419 - DNA, 726 bp, Anabaena sp
  CDS (1)..(726): transl_table=11
atgactgattggctctaccgttacccacccctatatactggtattctgctaaagcgctacaagcgcttttttgctgacgtacaactaacgtctggcgaagtcgtaacagcacattgtcccaatacaggccccatgactggagtatcgactctagggagtgcggtacaactttctaaaagtgccaatcctaagcgtaaattggcttatactctagaactgattcaagtacatgataacgagccgacttgggtaggcgtaaatacagctttaccaaaccagatagtcaagttggctttggcaaaatacttgtttccagagttgggtaactatagctacatcaaaagtgaggtagtttacggggtagataaaaaaagtcgggtagatttctttttgacaggaagtgatacagaacgaccaatttatctagaggtaaaaaataccacttggacaaaagggactttagcattattccccgacacagaaaccacaaggggacaaaagcacttgcgggaattaacggcgttattgccacaaatgcgatcggtaatgctgtattttattaatcgtggtgattgtacagagtttgcccctggtgatagtacagatcctatatatggtaagttgttacgagaagcgatcgccttaggtttagaagttttaccttgtcgttttgatgttaccccagaaggcatccgttatctaggtttagcaaaactggtaatttaa

SEQ ID NO: 51420 - protein, 241 aa, Anabaena sp
MTDWLYRYPPLYTGILLKRYKRFFADVQLTSGEVVTAHCPNTGPMTGVSTLGSAVQLSKSANPKRKLAYTLELIQVHDNEPTWVGVNTALPNQIVKLALAKYLFPELGNYSYIKSEVVYGVDKKSRVDFFLTGSDTERPIYLEVKNTTWTKGTLALFPDTETTRGQKHLRELTALLPQMRSVMLYFINRGDCTEFAPGDSTDPIYGKLLREAIALGLEVLPCRFDVTPEGIRYLGLAKLVI

SEQ ID NO: 51421 - DNA, 645 bp, Aquifex aeolicus
  CDS (1)..(645): transl_table=11
atgaagcttcctcctctgatgcccgccattttcgtaaaaagactaaatagatttgtgggaaaggtttttttaaatgggaaaatagaaagagctctaatcaggaacacgggaagactttctgagctcttaaaattcggaaacactgtttttgttagggaaaaagagggtggaaagtacaggtacgaaatcatactcgcaagggcggagaagagtctcgtatgcgttgagtcccactacgccaacaagatttttgaggaatacattcgcagaaattggaaatttaaggagctaaagagagaagtaaagctggagaatgaacggtttgatttccttatagacaacacactggtagaggtaaagtccgttaacctggtaaaaaatggtgttgccatgttcccggacgctcctacaaaaaggggaacgggacacataaggactttgataaagctttccgataagttcaaacctctacttgttttcgtggttcaaagaagtgattttttaagttttgagcccaactgcgaaactgaccccgagttctgtaaagcttactacgaatacgtatctaaggggtttgaagttttagtactgaagtgtagagtttctttggaagagataaatgtagtagaagtatttttcacttaa

SEQ ID NO: 51422 - protein, 214 aa, Aquifex aeolicus
MKLPPLMPAIFVKRLNRFVGKVFLNGKIERALIRNTGRLSELLKFGNTVFVREKEGGKYRYEIILARAEKSLVCVESHYANKIFEEYIRRNWKFKELKREVKLENERFDFLIDNTLVEVKSVNLVKNGVAMFPDAPTKRGTGHIRTLIKLSDKFKPLLVFVVQRSDFLSFEPNCETDPEFCKAYYEYVSKGFEVLVLKCRVSLEEINVVEVFFT

SEQ ID NO: 51423 - DNA, 660 bp, Archaeoglobus fulgidus
  CDS (1)..(660): transl_table=11
atgaagctttttgagattgagaacgccgtggattgcaggataattggcagagtgaacaggtttgtggtggatgttgaggtggatgggaggagggaaagggcttacataaacaacacgggaaggctgaaggagctcatttttgagggtaatgtggggaaatgtttgaccaaaagaggtggaaagctctcgtacaggctttttgctgtcagttgcgaaggcggttacgctctgatagatacacagcttcagatgagagcctttgaggtagccattccgaaaataagctggcttgatggagaggttaggagaaacgttaaagttggaaactccataatcgattaccgcattggagagagctacgtggagcttaaaagtgctgccctcaagaagggaatctatgcgatgtaccccgactgccccaccgcaaggggtagaaagcacctcaggctgcttgaggagatagggaagaggtcaagagctttggttgtgttcgttgcggcattgccatcagtgagggccttcatgcccaacagagaaggggatgaggagctttacaggctgataaagcggtctaaaaacgtcgagttcaggtcgattcaggttgaataccttaacgggaaggtttttctgaggaatccagacctgaaggttgtgatttag

SEQ ID NO: 51424 - protein, 219 aa, Archaeoglobus fulgidus
MKLFEIENAVDCRIIGRVNRFVVDVEVDGRRERAYINNTGRLKELIFEGNVGKCLTKRGGKLSYRLFAVSCEGGYALIDTQLQMRAFEVAIPKISWLDGEVRRNVKVGNSIIDYRIGESYVELKSAALKKGIYAMYPDCPTARGRKHLRLLEEIGKRSRALVVFVAALPSVRAFMPNREGDEELYRLIKRSKNVEFRSIQVEYLNGKVFLRNPDLKVVI

SEQ ID NO: 51425 - DNA, 732 bp, Bacillus halodurans
  CDS (1)..(732): transl_table=11
atgtttttaccgtttaatacaaggttacaccacgcaacgtttttaaggcgaccgaatcgttttatcgtagaagcccgcctcgatacaggcgaggaggtggtggcacatctgcccgatccagggagattaaaggagctattactaccggaagcatccatatggcttcggcatgtagataacccgagccggaaaacgcagtggtccgtcgtttgcagccaagctccagaaggagatgttctcgtttccctcgatacgacattgccgaatcaacttgtgacgaaagcgttgcaacagcaagaattcctccctttgtgtcagtgggcttatgtaagacaagagtttacgtatggaggatcacgctgggatgtgttgcttagggaaggagaaaaacagttgcttctcgaaataaaaagcgtcacgctatccgaagcgggggtcgcctattttcctgacgccgttacggcgcgtgggacgaaacatgtaaaggagctgacagcgattcagcaatcaggtgactatgaaaccgccattcttctgttagcacagcgtgaggatgtaacggaaatcaggcctgcctatcatattgatcctcatttctcggccgcgttgcaggaagcagagaaatgtggtgtgcgtcttttaggccacacgagtaaagtgacgcttgaagggattgaattaggaaaaccggtaaaggtggatacgagtgagcgaaaggagacaagcgattga

SEQ ID NO: 51426 - protein, 243 aa, Bacillus halodurans
MFLPFNTRLHHATFLRRPNRFIVEARLDTGEEVVAHLPDPGRLKELLLPEASIWLRHVDNPSRKTQWSVVCSQAPEGDVLVSLDTTLPNQLVTKALQQQEFLPLCQWAYVRQEFTYGGSRWDVLLREGEKQLLLEIKSVTLSEAGVAYFPDAVTARGTKHVKELTAIQQSGDYETAILLLAQREDVTEIRPAYHIDPHFSAALQEAEKCGVRLLGHTSKVTLEGIELGKPVKVDTSERKETSD

SEQ ID NO: 51427 - DNA, 699 bp, Bacillus clausii
  CDS (1)..(699): transl_table=11
atgcgcttgccgccattaacgaaaatgcagttcgttcatcgccccaatcgttttgttgtcgagttaaagcggactgatacagaggagaacgtcctggcccatttgcctgatccaggacgtttgcgtgaattgttagtagaaggcgccatcatttgggcggagcctgctgttgacccgttgcgaaaaacggcgtggacagctgttctatgtgagacgcctggcggtgaccttgtttcattaaaaacgacttttgccaaccaactagtagaagaagcgctagcctcccaatcgcttgaagcatttagtggctggcagttagaaaaacgagaagcaacaataggccaatcgcgctttgattttttgctctcgaaaaacggacgcacgctggtgcttgaagtaaagagtgtaacgcttgctcggggcagcaaagggttttttccagatgcggtcacaaaaaggggcgcaaaacatgtccgggaattgactgctttgaatttgttgcccgagtatgagagtgcggttctgtttgtctctcaacatagcaacattagcacagtggaaatggaaagcagcatagacgctgattttgccaaagcgattaaggaggcaaacgataaaggtgtgttcattagcgctgtaagcactgaactatccaaacagaacatttgtttaaaaaatcggattccggttgtcgtctga

SEQ ID NO: 51428 - protein, 232 aa, Bacillus clausii
MRLPPLTKMQFVHRPNRFVVELKRTDTEENVLAHLPDPGRLRELLVEGAIIWAEPAVDPLRKTAWTAVLCETPGGDLVSLKTTFANQLVEEALASQSLEAFSGWQLEKREATIGQSRFDFLLSKNGRTLVLEVKSVTLARGSKGFFPDAVTKRGAKHVRELTALNLLPEYESAVLFVSQHSNISTVEMESSIDADFAKAIKEANDKGVFISAVSTELSKQNICLKNRIPVVV

SEQ ID NO: 51429 - DNA, 708 bp, Bartonella henselae
  CDS (1)..(708): transl_table=11
atgttctttattcataaactttttcccgcaaagcttattcgtcgttataaacgttttcttgctgatgttaaacgtgaagatcaacacatcttcaccgtatcggttcccaatacaggatcgatgcttggattaacaactccaaattctaatatttggctttcatatcacaataatcccaaacgaagatacgcatatcaattagagattgtcgaagcaaataataccttagttggaatcaatacaactttacccaacaaacttgcattagaagcaattcaaaataatttactaccagaattaaacggatacaaaacaatcttgaaagaacaacgttatggtattcaatcacgaattgactttcttttacgtgatgacatcctacctgactgttatctagaaattaaaaatgttcattttattcgccaaaaaggactagcagaatttcctgatactgagacaaaacgtggcacacgtcatcttgaagagcttataaaaatcgtgcaacaaggaaaacgagctgttatgctttatataattcaacgggaagattgttcagcttttacaatctgccgtgatcttgatccaacctatggacgtaaatttgatttagcattagaatcaggggtagaattttatgctataaaatgtcaagtaagtgtagaaggtattttcccaattcagcaagtgaaaatagaaaacagaaaatga

SEQ ID NO: 51430 - protein, 235 aa, Bartonella henselae
MFFIHKLFPAKLIRRYKRFLADVKREDQHIFTVSVPNTGSMLGLTTPNSNIWLSYHNNPKRRYAYQLEIVEANNTLVGINTTLPNKLALEAIQNNLLPELNGYKTILKEQRYGIQSRIDFLLRDDILPDCYLEIKNVHFIRQKGLAEFPDTETKRGTRHLEELIKIVQQGKRAVMLYIIQREDCSAFTICRDLDPTYGRKFDLALESGVEFYAIKCQVSVEGIFPIQQVKIENRK

SEQ ID NO: 51431 - DNA, 705 bp, Bartonella quintana
  CDS (1)..(705): transl_table=11
atgctctttattcccaaactatttcctgcaaaacttatccgtcgttataaacgttttcttgctgatgttaaacgagacgatcaggatatcttcaccgtgtctgttcctaatacaggttcaatgcttggcttaataactcccaattccaatatttggctttcatatcacaacaattctaagcgaaaatacgtgtatcaattagaaattgtcgaagcaaataatagtttggttggcatcaatacaactttacctaacaaacttgcattagaagcaattcaaaatggcttattaccagaattaaacgggtacaaaacaatcttgaaggaacaacgttatggtacgcaatcacggattgactttcttttgcgtgatgatatcctccctgactgttatctagaagttaaaaatgtccattttattcgtcaaaaagaattagcagaatttcctgatactgagacaaaacgtggcacacgtcatcttgaagagctcataaaaattgtgcaacaaggaaaacgagctgctatgctttatatgattcaacgggaagactgctcagcttttacaatctgccgtgatcttgatccaacctatggacgtaaatttgatttagcattaaaatcaggagtagaattttatgctgtaaaatgtcacgtaagtgtagaaggcatttttccgattcatcgagtgaaaatagaaaatgattga

SEQ ID NO: 51432 - protein, 234 aa, Bartonella quintana
MLFIPKLFPAKLIRRYKRFLADVKRDDQDIFTVSVPNTGSMLGLITPNSNIWLSYHNNSKRKYVYQLEIVEANNSLVGINTTLPNKLALEAIQNGLLPELNGYKTILKEQRYGTQSRIDFLLRDDILPDCYLEVKNVHFIRQKELAEFPDTETKRGTRHLEELIKIVQQGKRAAMLYMIQREDCSAFTICRDLDPTYGRKFDLALKSGVEFYAVKCHVSVEGIFPIHRVKIEND

SEQ ID NO: 51433 - DNA, 732 bp, Bdellovibrio bacteriovorus
  CDS (1)..(732): transl_table=11
atgaagtttcacagcaagctgcaagagggtatttttttaaagcgctataagcgcttctttgcggatattgaatttcaggggcagcaggtgacggcccatgttcccaacaccggcagtctaaaaagtgtgaacaatccgggacagcactgtctgttttctgaaagcaccaatccggagcgtaagctgaagtacactctggaaatgatcaagtccccgacgggatcctgggttggggttaatacggcgactccaaacacagtggtgcgtgaaacccttcatcatgtggtcggtcacaaaaaagaggtgattggcggctttgcccactgggcggcctttgatgaagtgaagccggaatacaaaatcagcgcggaaacccgcctggattttgccctgaagaaaaacaacagcgataaaatgcattttatcgaagtgaaaaacgtgaccctggctgaagaagggaccgccaagttcccggacgctgtgaccgagcgcgggcaaaagcatctgcgtgagcttatggcattgatggagcaggggcacacggcggaaatcgtcttcacaatccagcgtcacgactgcggttcgttctctccggcggatgacattgatccggaatatggccgtctgctgcgtgaggcctatcaaaaagggctgcgtgtttcgccttttgtgctggatctgactccggagtccgtcgagttgtctgagacagttctgccgctaaaaatgtag

SEQ ID NO: 51434 - protein, 243 aa, Bdellovibrio bacteriovorus
MKFHSKLQEGIFLKRYKRFFADIEFQGQQVTAHVPNTGSLKSVNNPGQHCLFSESTNPERKLKYTLEMIKSPTGSWVGVNTATPNTVVRETLHHVVGHKKEVIGGFAHWAAFDEVKPEYKISAETRLDFALKKNNSDKMHFIEVKNVTLAEEGTAKFPDAVTERGQKHLRELMALMEQGHTAEIVFTIQRHDCGSFSPADDIDPEYGRLLREAYQKGLRVSPFVLDLTPESVELSETVLPLKM

SEQ ID NO: 51435 - DNA, 717 bp, Brucella melitensis
  CDS (1)..(717): transl_table=11
atgctgtttcctacccccctcatttccggcaggctggagcgccgctacaagcggtttcttgccgatgtcactcttgatgatggccggttcatcaccgcctccgttcccaataccggctccatgctgggcctgacggcgcccggttcacgggtctggctcagcttttcggacgccccgcaccgcaaatatgcgcacacactccagattgtcgaggccgacaatacgctggttggcgtcaataccggattgccgaaccgcatcgcggaggaagcgatcctgaaaggcctcatacccgaccttgacggctatgcgaccctcaagcgagagcaaaaatacgggcgcaattcccgcatcgaccttctgctcgatgatggcccccgcccgcgcgcctatgtcgaagtaaagaatgtgcatttcattcgcacgcccggccttgcagaattccccgatacggtgacggcgcgcggcgcaaaacatctggacgaacttgttgatgttgttgccgctggtcatcggggcataatgctgtttattacccagcgcgccgattgcagcagatttggtatttccggcgatcttgatcccttttacgcacgggcttttgaacgtgcgattgcatccggggttgaggcttgggccgttcggtgccacataacggaaaatggcatcgacgccacagagctggtgccaatcgaggacatgagacggatcgagtga

SEQ ID NO: 51436 - protein, 238 aa, Brucella melitensis
MLFPTPLISGRLERRYKRFLADVTLDDGRFITASVPNTGSMLGLTAPGSRVWLSFSDAPHRKYAHTLQIVEADNTLVGVNTGLPNRIAEEAILKGLIPDLDGYATLKREQKYGRNSRIDLLLDDGPRPRAYVEVKNVHFIRTPGLAEFPDTVTARGAKHLDELVDVVAAGHRGIMLFITQRADCSRFGISGDLDPFYARAFERAIASGVEAWAVRCHITENGIDATELVPIEDMRRIE

SEQ ID NO: 51437 - DNA, 717 bp, Brucella suis
  CDS (1)..(717): transl_table=11
atgctgtttcctacccccctcatttccggcaggctggagcgccgctacaagcggtttcttgccgatgtcactcttgatgatggccggttcatcaccgcctccgttcccaataccggctccatgctgggcctgacggcgcccggttcacgggtctggctcagcttttcggacgccccgcaccgcaaatatgcgcacacactccagattgtcgaggccgacaatacgctggttggcgtcaataccggattgccgaaccgcatcgcggaggaagcgatcctgaaaggcctcatacccgaccttgacggctatgcgaccctcaagcgagagcaaaaatacgggcgcaattcccgcatcgaccttctgctcgatgatggcccccgcccgcgcgcctatgtcgaagtaaagaatgtgcatttcattcgcacgcccggccttgcagaattccccgatacggtgacggcgcgcggcgcaaaacatctggacgaacttgttgatgttgttgccgctggtcatcggggcataatgctgtttattatccagcgcgccgattgcagcagatttggtatttccggcgatcttgatcccttttacgcacgggcttttgaacgtgcgattgcatccggggttgaggcgtgggccgttcggtgccacataacggaaaatggcatcgacgccacagagctggtgccaatcgaggacatgagacggatcgagtga

SEQ ID NO: 51438 - protein, 238 aa, Brucella suis
MLFPTPLISGRLERRYKRFLADVTLDDGRFITASVPNTGSMLGLTAPGSRVWLSFSDAPHRKYAHTLQIVEADNTLVGVNTGLPNRIAEEAILKGLIPDLDGYATLKREQKYGRNSRIDLLLDDGPRPRAYVEVKNVHFIRTPGLAEFPDTVTARGAKHLDELVDVVAAGHRGIMLFIIQRADCSRFGISGDLDPFYARAFERAIASGVEAWAVRCHITENGIDATELVPIEDMRRIE

SEQ ID NO: 51439 - DNA, 720 bp, Caulobacter crescentus
  CDS (1)..(720): transl_table=11
atgctgctgccgcaaccgctgatccatggtcgtctggtgagccgctacaagcggttcttcgccgacctcgtactggacgacggccaggagatcaccgcccactgccccaatccgggggccatgctgggggtgaaggacgcaggccaaggcgcctgggtgtcgtggtcagacgatcccaagcgcaagctggcctacaccctgcagatggtcgagcagggaaacgcgctggtcgggatcaacaccctgctgcccaacaagctggtggccgaggccctggcggcggacgccctccccgagctttccggctacgcgaccatcaagcccgaggtgaaatacgccgaagccagccgcgtcgacttcctgctgacccaccccgatcgcccgccctgctggctggaggtcaagaactgccacttctcgcgcaccccgggcctggcggagtttcccgactgcaaggcgcagcgctcgacccggcacctggaggacctttccgcccaggtccgcgagggccatcgggccgtggtgctgttcgtcgtccagcgcgaggactgcgagaccttcagcgcctgcgcggagctcgacccggcgttcgcggcggggctggaggcggcggccaaggccggggtggaggtgctggtctatgcgtgtgaaatggggacgcaggcggtgcggatcgcgcggcgcattttgtggagccacgcccacctaacagcgatttaa

SEQ ID NO: 51440 - protein, 239 aa, Caulobacter crescentus
MLLPQPLIHGRLVSRYKRFFADLVLDDGQEITAHCPNPGAMLGVKDAGQGAWVSWSDDPKRKLAYTLQMVEQGNALVGINTLLPNKLVAEALAADALPELSGYATIKPEVKYAEASRVDFLLTHPDRPPCWLEVKNCHFSRTPGLAEFPDCKAQRSTRHLEDLSAQVREGHRAVVLFVVQREDCETFSACAELDPAFAAGLEAAAKAGVEVLVYACEMGTQAVRIARRILWSHAHLTAI

SEQ ID NO: 51441 - DNA, 693 bp, Clostridium acetobutylicum
  CDS (1)..(693): transl_table=11
ttgaagatagataatatgacgaaacttgccaaatttgtaaaaaggccaaatagatttcaagcatatatagaattagaaggcgaagaaatgatggttcatgtacccaataccggaagatgcagggaaatattacttccaaattgtactgtggtactgcgagaggaaaataatccaaatagaaaaactaaatatgatttaattggagcatataagggagaaaaatttataaatatagattctcaaattcctaataaagttgtttatgaggcgctttacaataagaaagtggagagcttagctaaatataatattataatgaaagaaaagacctttaaaaacagcagatttgattttagattggaaaatgatgagggagaggtttatttcctggaggttaagggagtaacacttgaggataaaggagttgctagatttccagatgcaccaactgaaagaggagcaaagcatttaaaagaacttgttgaggccaaaaaaagcggatatggggcaggtgtattatttcttatgcaaatggataatataagtgagttcagaccacatgatgagatggacaaaatgtttggagaagcacttagatatgcagcaataaatggtgtagatgtgatggcttacgagtgttctgttgatgaaaaaagtataactcttacaaagagtgttaagatagttctttaa

SEQ ID NO: 51442 - protein, 230 aa, Clostridium acetobutylicum
MKIDNMTKLAKFVKRPNRFQAYIELEGEEMMVHVPNTGRCREILLPNCTVVLREENNPNRKTKYDLIGAYKGEKFINIDSQIPNKVVYEALYNKKVESLAKYNIIMKEKTFKNSRFDFRLENDEGEVYFLEVKGVTLEDKGVARFPDAPTERGAKHLKELVEAKKSGYGAGVLFLMQMDNISEFRPHDEMDKMFGEALRYAAINGVDVMAYECSVDEKSITLTKSVKIVL

SEQ ID NO: 51443 - DNA, 693 bp, Clostridium perfringens
  CDS (1)..(693): transl_table=11
atgaagtacaatagtgttatcagaaaagctatttttttaagaagaccaaatagatttcaagcttatgtagttttagatgatgaggagttattagttcatgtccctaacactggaaggtgtagagagattttaaaagaaggatgtacagttcttttaagaaaaggaactactccaaatagaaaaactccgtatgatttaattgcagcttataagggtgaggttttaataaatatagattctcagattcctaataaagttgtagaagaggcattaagaaataaaaagatagaaaagctagtaaattttaataatataagtagagaaaaaacttttggaaattctagatttgattttaaattacaagatgataatgaaaatacatactttttagaagtaaaaggggtaactttagaggaaaatggagagactaggtttccagatgctccaactgaaagaggaaagaaacacatattagaactgattgaaattaaaaaattaggaatgggtgcaggaataatttttttaatacagatagataatgtaaataagttttctcctaatgatgaaacagatcctaagtttggggaagcattgagattagctaaaaaagaaggagtagatatctttgcatataattgcaaagttactgaagaggaaattgagttgcttaattctgtagaaatagtgttataa

SEQ ID NO: 51444 - protein, 230 aa, Clostridium perfringens
MKYNSVIRKAIFLRRPNRFQAYVVLDDEELLVHVPNTGRCREILKEGCTVLLRKGTTPNRKTPYDLIAAYKGEVLINIDSQIPNKVVEEALRNKKIEKLVNFNNISREKTFGNSRFDFKLQDDNENTYFLEVKGVTLEENGETRFPDAPTERGKKHILELIEIKKLGMGAGIIFLIQIDNVNKFSPNDETDPKFGEALRLAKKEGVDIFAYNCKVTEEEIELLNSVEIVL

SEQ ID NO: 51445 - DNA, 693 bp, Clostridium tetani
  CDS (1)..(693): transl_table=11
atgattataaaaaagaatattaaacgagctgaatttattaaaagacctaatagatttcaagcatatgtaaaagtagataatgaagaaatcatggttcatgttccgaatactggaagatgtaaagaaatattaataccaggaacaacagtagttttaagagaagagagtaatcctacaagaaagactaagtatgacttaattggtggatataaaaatggtaaatttataaatatagattctcaaataccaaataaagtagttgaggaagcacttaaattgggaaatataaaaaaactaaaaaaatataatataataaaaagagaaaaaacctatggtaatagtagatttgattttaaactaggtaatgattctggagaggaatattatttagaagtaaaaggagttactttagaagatgggggagtaacaaagtttccagatgctccaacagaaagaggaactaaacatattttagagctaatagatgttaaaaataaaggcataggtgcaggagtgttatttttaatacagatgaaggatgtaaagtattttactcctaatatagaaatggataaaaacttttcagaagctttagtgtcagcacacaaagcgggagttgatatttttgcatatgaatgtgatgtggatgaagattttataactttaaaaaaagaagttaaagttatactatag

SEQ ID NO: 51446 - protein, 230 aa, Clostridium tetani
MIIKKNIKRAEFIKRPNRFQAYVKVDNEEIMVHVPNTGRCKEILIPGTTVVLREESNPTRKTKYDLIGGYKNGKFINIDSQIPNKVVEEALKLGNIKKLKKYNIIKREKTYGNSRFDFKLGNDSGEEYYLEVKGVTLEDGGVTKFPDAPTERGTKHILELIDVKNKGIGAGVLFLIQMKDVKYFTPNIEMDKNFSEALVSAHKAGVDIFAYECDVDEDFITLKKEVKVIL

SEQ ID NO: 51447 - DNA, 711 bp, Desulfotalea psychrophila
  CDS (1)..(711)
atggacttctcacaaggactcaccccggcaagactcatcagaagatataaacggtttttagcggatgtagagatcgaagatggtacgatcataacagtctactgccccaatacgggcaccatgcgtacctgctcaacacctaacagccccgttatgctctccatctccgacaaccccaagagaaaatacgcccacaccctggagatgatctttgaaaatcacacttggataggagttaacacagggcggacaaatagcatcgtcgcaaaggccattctcaatggcagtatagctgaattttctggagctaccaaggtgcagcgagagataaccgtctccaagggcagtcgattagacctccttgtagaccatgcggatcaaaaaagctatattgaaattaaaaattgttccatggcggaaaatcgaagggcaatgttccccgatgcagtcactgcccgcggcacaaagcacctacgagagcttatcaaattagtgaagcaaggagaaaatgcctacatattctttcttatccaacgagaggacgccgattccttctcgccggcaacccacatagatcccctctacgccaacacgctgaaagaagcactgcaacaaggagtgcaggcactggcctaccaggcaagcgtcattctccgagcgcttccaatcatcctcaacggcagtaactctcctcacctgccacaaaggtaa

SEQ ID NO: 51448 - protein, 236 aa, Desulfotalea psychrophila
MDFSQGLTPARLIRRYKRFLADVEIEDGTIITVYCPNTGTMRTCSTPNSPVMLSISDNPKRKYAHTLEMIFENHTWIGVNTGRTNSIVAKAILNGSIAEFSGATKVQREITVSKGSRLDLLVDHADQKSYIEIKNCSMAENRRAMFPDAVTARGTKHLRELIKLVKQGENAYIFFLIQREDADSFSPATHIDPLYANTLKEALQQGVQALAYQASVILRALPIILNGSNSPHLPQR

SEQ ID NO: 51449 - DNA, 729 bp, Desulfovibrio vulgaris
  CDS (1)..(729): transl_table=11
atgcgaaagatactgctcccctatccggcaggatgcgcgaccgggacgttcgtgcgccgcgtcaaacgcttcagtgtggagatgacgcgcgacggcgaaagcgtgtgggtacacagcaacaattcaggcagcatgctgggattgctgcgccccggcgccaccatgctggcatcccctgccgccaaccccgaccgcaagctggcgtggacgcatgaggccatgcgctgtcatggcgacgggccgcaaggcttctgggtgggggtcaacacttcggtgcccaaccgcatggtcgaagcggcgttccatgccggacgcctgccatgggcgcagggctacgataccttccggcgtgaacgcaagcggggcgacagccgcctcgacgcccgtctcgacggccccggactgccgacgctgtgggtggagtgcaagaacgtgacgatggtggaggatgatgtggcgtgcttccccgacgcggtgaccgaacgtggcagcaagcacctgcgcgagatgatggacatcgtgtcgcgcggcgaacgcgccgccatgttctacctcgtgcaacgccccgacggactgtgcttcggccccgccgatgtcatcgacccgcagtacgcagccctcttctgggaggcggtggatgcgggggtcgagatgtacccgcaccgtggcatcgtctccccggtaggtatcgaccttagtggggtgctgccgcttacgcgatgcaggtga

SEQ ID NO: 51450 - protein, 242 aa, Desulfovibrio vulgaris
MRKILLPYPAGCATGTFVRRVKRFSVEMTRDGESVWVHSNNSGSMLGLLRPGATMLASPAANPDRKLAWTHEAMRCHGDGPQGFWVGVNTSVPNRMVEAAFHAGRLPWAQGYDTFRRERKRGDSRLDARLDGPGLPTLWVECKNVTMVEDDVACFPDAVTERGSKHLREMMDIVSRGERAAMFYLVQRPDGLCFGPADVIDPQYAALFWEAVDAGVEMYPHRGIVSPVGIDLSGVLPLTRCR

SEQ ID NO: 51451 - DNA, 729 bp, Enterococcus mundtii
  CDS (1)..(729): transl_table=11
ttggactaccaagatgttgaaattgcttacttcattgaacgaccaaatcgctttattgctttttgtttgaacaaaaaaggagaagtagtcaaaactcatgttaagaatacaggtagaggcaaagagttgttgcttcctggtgcagaggtggcgttagtacacattcctggaacaaaacgtaaaactgcctatgatctgattgctgtaaaaaaagagcagcagtggttcaatatcgatagtcagttaccaaaccgattagcgattgatggaattttagatgggacgatccacttaccaaatttaaatagtgatattgagttctacaaacgtgaagtgacctttggaaagtctaaatttgatatttatttagaaacaagttgcggtcaaaaagcatttgtagaagtcaaagggatgaccctggaaaacaaagcaataggtgcttttcccgatgcaccgaccattcgtgggcttaaacacgtcaatgaattgatcggcgcgcatcaagaaggctatgagacctatattctttttattgcacaatttgaacacttgcatcaagcaacgatccatgagcagatgcaaccagaattagccactgcttttcgttttgctcagcaagcaggtgttcaagtaatcgtatataattgtcaagtaacagaaaaacaagtggtattgaaacaagcaatcccatttgacctaaatacagtttttgaagatcctaatttatag

SEQ ID NO: 51452 - protein, 242 aa, Enterococcus mundtii
MDYQDVEIAYFIERPNRFIAFCLNKKGEVVKTHVKNTGRGKELLLPGAEVALVHIPGTKRKTAYDLIAVKKEQQWFNIDSQLPNRLAIDGILDGTIHLPNLNSDIEFYKREVTFGKSKFDIYLETSCGQKAFVEVKGMTLENKAIGAFPDAPTIRGLKHVNELIGAHQEGYETYILFIAQFEHLHQATIHEQMQPELATAFRFAQQAGVQVIVYNCQVTEKQVVLKQAIPFDLNTVFEDPNL

SEQ ID NO: 51453 - DNA, 705 bp, Erwinia carotovora subsp
  CDS (1)..(705): transl_table=11
atggactataccccacgtttacagcccgcccggttgattaaacgttacaaacgctttttggccgatgtcgtaacgccggaaggcgagacgctcacgctgcactgtgccaatacgggtgcaatgacgggctgtgctacgcccggtgataccgtctggtattcaacgtccgataaccctaaacgcaagtatccacaaagttgggaactgactgaaacgcaacaaaatcactggatttgtgtcaatactctgcgtgccaacacattattgtacgaagccttattggaaaatcgcatagaagagctggcgggctattcggacataaaaacagaagtgaaatacggtacggaaaacagccgaatagacctgcttttacaggcgccggacaggattgactgctatattgaggtgaaatccgtcacattattgcaacatgaatgtggttactttcccgatgcggttacactcagagggcaaaagcatctgcgtgagctgcaacaaatggtttccaatggaaaacgcgcggttctttttttcgccgttctccattcagggatccagcaggtttctcccgctcggcatattgactcacgctatgcggaattatttatcgaagcgcaacaggcaggggttgaaattttatgttacggctccacattatgccctgacggtattaaattgacgaataagctaccgttgttgggatga

SEQ ID NO: 51454 - protein, 234 aa, Erwinia carotovora subsp
MDYTPRLQPARLIKRYKRFLADVVTPEGETLTLHCANTGAMTGCATPGDTVWYSTSDNPKRKYPQSWELTETQQNHWICVNTLRANTLLYEALLENRIEELAGYSDIKTEVKYGTENSRIDLLLQAPDRIDCYIEVKSVTLLQHECGYFPDAVTLRGQKHLRELQQMVSNGKRAVLFFAVLHSGIQQVSPARHIDSRYAELFIEAQQAGVEILCYGSTLCPDGIKLTNKLPLLG

SEQ ID NO: 51455 - DNA, 699 bp, Geobacter sulfurreducens
  CDS (1)..(699): transl_table=11
atgattctgccacgacctctttactccggcaccctgatccggcgctaccagcgcttcctggccgacgtacgcctcgacgacgggacggtggtcaccgcccactgcccgaactcggggagcatgaaaggatgctgccagccgggaagcgccgtgttcctttctctcagcgacaatccgaagcggcgcctcgcctacacctgggaactggtcatggctgacggctactgggcggggataaacacgggcctccccaaccggctcgtccgggaggggattgaaaacggcaccgtcgcggaactcctggggtatgagcgcatccggcccgaagtccgctacgggacgaacagccgggtggatctgctgctggaagggcctggccgctgctgggtcgaagtgaaaaatgtgaccctcgtggaagggggaacggccctcttccccgacgccgtgacggaacgggggcaaaaacacctgcgggagttgatggaggtggtgcggcagggggaccggggagtgatcttcttcgtggtccagcgtggcgacgggtctgccgtggccccggcggacgccattgacccggtgtacggccggcttctgcggcaggccgtgactgccggggtagaagccctggcctaccgggcgctcgtaacgccggaggaaatccggctcacggagcggctgccggtgcttgccggggaatga

SEQ ID NO: 51456 - protein, 232 aa, Geobacter sulfurreducens
MILPRPLYSGTLIRRYQRFLADVRLDDGTVVTAHCPNSGSMKGCCQPGSAVFLSLSDNPKRRLAYTWELVMADGYWAGINTGLPNRLVREGIENGTVAELLGYERIRPEVRYGTNSRVDLLLEGPGRCWVEVKNVTLVEGGTALFPDAVTERGQKHLRELMEVVRQGDRGVIFFVVQRGDGSAVAPADAIDPVYGRLLRQAVTAGVEALAYRALVTPEEIRLTERLPVLAGE

SEQ ID NO: 51457 - DNA, 711 bp, Gloeobacter violaceus
  CDS (1)..(711): transl_table=11
atgagtgtgctttttgagtacccgcccctggtacgggggatcctgcgccgtcgctacaagcgattttttgccgaggttgaactggaggacgggcaactggtcaccgcccactgcccgaacaccggtccgatgcgggccatcagcaccctcggaagtccggtatatctgtcgcgctcaccggatccggcccgcaagctcgcctacacctgggagatgatcgacctagacggcacctgggtcggggtgaatacggcccttcccaaccgcatcgtctaccgggctctggtggagcgggtgattgccgaggtgggcacttaccggaccattcgccgcgaagtgccttacggtagtgaaaacagccgcatcgattttttgctcaccggcgagggggagccgctgtacctggaggtcaagagcactaccctcaaccagggcaccctcgccctgtttccggatacggtcaccacccgcggccagaaacacctgcgcgaactgatccgcctttgtgagcacggcacgcgggcagcgatgctgtacttcatcaaccgcggtgactgcacggccttcagcccgggcgattccctcgatccgctttatggacaactgctgcgtgccggtatcgagcgcggtctgctggtcttgccctgccgcttcgagatcaccccccaatcggtgcgctacctgggtacggcctcgattctgcttgcctga

SEQ ID NO: 51458 - protein, 236 aa, Gloeobacter violaceus
MSVLFEYPPLVRGILRRRYKRFFAEVELEDGQLVTAHCPNTGPMRAISTLGSPVYLSRSPDPARKLAYTWEMIDLDGTWVGVNTALPNRIVYRALVERVIAEVGTYRTIRREVPYGSENSRIDFLLTGEGEPLYLEVKSTTLNQGTLALFPDTVTTRGQKHLRELIRLCEHGTRAAMLYFINRGDCTAFSPGDSLDPLYGQLLRAGIERGLLVLPCRFEITPQSVRYLGTASILLA

SEQ ID NO: 51459 - DNA, 717 bp, Haemophilus influenzae
  CDS (1)..(717): transl_table=11
atgcaacttccagctttacaatcggcgacattaattcgtcgttacaaacgatttcttgcggatattgaattgccaactggtgatgttatgacaattcattgtgccaatacaggtgcgatgactggatgcggtgaaaaaggcgataaaatttggtattcacattctgatagtcaaactcgtaaatatccccattcttgggaactcactcaactcgcaaatggacagctttgctgtatcaatacgcatcgttctaatcagcttgtctttgaagcattgcaaaataagcaaatcaaagaattggcaatgtatgatgaaatttaccctgaagtgaaatacggcgaggaaaatagccgaattgatttcttactaaaaggcgaaggcttgcttgattgttatgtagaagtgaaatcaatcacgcttgtaaaaggcaatttaggtatgtcccccgatgcggttactacaagggggcaaaaacatgttcgagagttattggcaatgaaaaaacaaggtcatcgagcagtggtactatttgctgggttacataatgggtttgatcgtttcaaaattgcggaatatatcgatcctgaatatgatcgcttattaaaagaagcaatggaacaaggtgttgaagcctatgcttatgcgggacaatttgaaatttctaatgaaattcctaccgcactttctttgacagaatcggtgtcttatataaaataa

SEQ ID NO: 51460 - protein, 238 aa, Haemophilus influenzae
MQLPALQSATLIRRYKRFLADIELPTGDVMTIHCANTGAMTGCGEKGDKIWYSHSDSQTRKYPHSWELTQLANGQLCCINTHRSNQLVFEALQNKQIKELAMYDEIYPEVKYGEENSRIDFLLKGEGLLDCYVEVKSITLVKGNLGMSPDAVTTRGQKHVRELLAMKKQGHRAVVLFAGLHNGFDRFKIAEYIDPEYDRLLKEAMEQGVEAYAYAGQFEISNEIPTALSLTESVSYIK

SEQ ID NO: 51461 - DNA, 705 bp, Idiomarina loihiensis
  CDS (1)..(705): transl_table=11
atgcaatttaacaagcccctgcgccagggagttttgcaaaaaagatacaaacgttttctcgccgacattgattttggtgacaacgaaacgacgacaacccactgccctaataccggagccatgaccgggtgtgcagagcctggctttacagcctggtgcagtgtttccgataatcccaaacgtaaatactcactgacctgggagctcgctcagaataacaacggtgaaatgattgtagtcaatacacagcacgctaaccgcatggccggagaattactacaaaccaaccttgtacctgaattaagccagtggcaagagctgaaaccagagcaacgctacggtaaggaaaaaagccgcatcgactggtggggcgtagaccagcataaccgtgaatgctttattgaagtaaaaagcgtcactttagcggacgcaagtcaaggttactttcccgacgcagtcagccaacgcgctcacaaacaccttaatgaactgatgcaggttgtggccgatggtcatcgcgcagtgcagctttacatggtaatgcacgacggtatcgaacgagtttctcccgccgcacatattgacagccagtatgctgagctgtgtagaaaagcagcgtcagtcggagtcgagttttatgcagtaaagtgccgcgcgtcggcgaaagaaataaaactggagagaccagttcccgtaagcctttaa

SEQ ID NO: 51462 - protein, 234 aa, Idiomarina loihiensis
MQFNKPLRQGVLQKRYKRFLADIDFGDNETTTTHCPNTGAMTGCAEPGFTAWCSVSDNPKRKYSLTWELAQNNNGEMIVVNTQHANRMAGELLQTNLVPELSQWQELKPEQRYGKEKSRIDWWGVDQHNRECFIEVKSVTLADASQGYFPDAVSQRAHKHLNELMQVVADGHRAVQLYMVMHDGIERVSPAAHIDSQYAELCRKAASVGVEFYAVKCRASAKEIKLERPVPVSL

SEQ ID NO: 51463 - DNA, 720 bp, Mannheimia succiniciproducens
  CDS (1)..(720): transl_table=11
atgcgactccctccccttcaggcggcaaaatttatccgccgttataaacgttttatggcagatgtggaattagccaacggcaatattctgaccattcactgcgccaacaccggtgcgatgacaggctgcgcggaaaaaggcgatacggtttggtattccgactcgaaaagtactacaagaaaatacccatgctcttgggaactcaccgaactgtcaaacggtaatctggtttgcattaatacgcaccgttcgaatcaattagtgcaggaagccttacaaaacaaagtaattaaagaacttgccgggtattcggaaatttaccccgaggttaaatacggcgaagaaaacagccgcattgattttctgctcaaaggcgaaggtttgcccgattgttacgtggaagtaaaatccattaccttggtaaaaaacaatatcggcatgttccccgatgcggtcactacccgcgggcagaaacacgttcgcgaattactagccatgaaaaaacagggttatcgtgctgttgtgttatttgccggcttgcacaacggctttgactgttttaaaaccgccgaatatattgatcccgattatgacaagcttttgcgccaggcaatgaaagaaggcgttgaagtttacgcttatgcgggcaaattcgataaaattcaagaaattccgaccgcactttctttagcggaagtcgtaccgctttgctttaattga

SEQ ID NO: 51464 - protein, 239 aa, Mannheimia succiniciproducens
MRLPPLQAAKFIRRYKRFMADVELANGNILTIHCANTGAMTGCAEKGDTVWYSDSKSTTRKYPCSWELTELSNGNLVCINTHRSNQLVQEALQNKVIKELAGYSEIYPEVKYGEENSRIDFLLKGEGLPDCYVEVKSITLVKNNIGMFPDAVTTRGQKHVRELLAMKKQGYRAVVLFAGLHNGFDCFKTAEYIDPDYDKLLRQAMKEGVEVYAYAGKFDKIQEIPTALSLAEVVPLCFN

SEQ ID NO: 51465 - DNA, 723 bp, Methanobacterium thermoautotrophicum
  CDS (1)..(723): transl_table=11
atgatggttgccatgatcatagagaaccccttaaggggaagctacattgaaaggcccaacaggttcacagtggctgtttatgttgatggtgagaggcggctagcccacctgagggaccctggaaggctcagagaacttctgatacctggaaacgatgttatactgaggaaagcctcctcaggaaaccggaaaacagagtttgatgttatagccctcaggagggatgatgagtgggtgcttgtaaactcgggcttccacagtgacctggctgccagtataatagaatcctcagcagtggatgagtttcgtggcttcagaatagaaaagagggaatgcagcttcggcagaagcaggattgattttctgctggcatctgaaaatgaaaggatgctcgttgaggtcaagggctgcacccttgtcagggaaaaccttgcgcttttccctgacgcacccacagagaggggcaggagacacgttgaggaactggaacgcgccctctctgagggttaccatagcagtgtactcttccttgtatttggcagaagtgcacgcttcttttctccaaatcatgaaatggatcctgagttttcatctgcacttagaagggcccatgaagcaggcgtgaatgtaataccctacaccctggccactgatatcaatgagaaagtccttgtgtatcccctaaggagaatagctgtgcgttggccgggtgaatccccctga

SEQ ID NO: 51466 - protein, 240 aa, Methanobacterium thermoautotrophicum
MMVAMIIENPLRGSYIERPNRFTVAVYVDGERRLAHLRDPGRLRELLIPGNDVILRKASSGNRKTEFDVIALRRDDEWVLVNSGFHSDLAASIIESSAVDEFRGFRIEKRECSFGRSRIDFLLASENERMLVEVKGCTLVRENLALFPDAPTERGRRHVEELERALSEGYHSSVLFLVFGRSARFFSPNHEMDPEFSSALRRAHEAGVNVIPYTLATDINEKVLVYPLRRIAVRWPGESP

SEQ ID NO: 51467 - DNA, 723 bp, Pasteurella multocida
  CDS (1)..(723): transl_table=11
atgcaacttcctccccttcaatccgcgacactgattcgtcgctacaaacgttttctcgcagatgtacaacttgataatggtgaggtgctaaccattcattgtgcaaataccggtgccatgacaggttgtggtgaagcaggagatattgtttggtattcacattccgatagtcaaacacgtaaatacccacattcttgggaattaaccgagctaaaaaatggcaatatggtctgtattaatactcatcgttctaatcaactcactttagaagcactgcaaaataaacaaattaaagcattggcgatgtatgaacagatcctaccagaagtgaaatatggtgaggaaaatagccgaattgattttttactcaaaggcgatggattacccgattgttatgtagaagtgaaatctgtcaccttagtaaaaaacacgattggcatgttccctgatgcagtcactacacgaggacaaaaacatttacgcgaattaatagcaatgaaaaaaagaggacatcgtgccgtagtcttttttgcgggcttacacaatggttttgattgttttaaagtggcagaatatattgacccagaatacgacaagttgttacaagaggcgatacaagaaggcgtagaggtgtatgcctatgcaggtaaatttgatttttctgataaaaaaccaaccgcactttctctcacccattgtgtaccttatatcggtaaaaagtaa

SEQ ID NO: 51468 - protein, 240 aa, Pasteurella multocida
MQLPPLQSATLIRRYKRFLADVQLDNGEVLTIHCANTGAMTGCGEAGDIVWYSHSDSQTRKYPHSWELTELKNGNMVCINTHRSNQLTLEALQNKQIKALAMYEQILPEVKYGEENSRIDFLLKGDGLPDCYVEVKSVTLVKNTIGMFPDAVTTRGQKHLRELIAMKKRGHRAVVFFAGLHNGFDCFKVAEYIDPEYDKLLQEAIQEGVEVYAYAGKFDFSDKKPTALSLTHCVPYIGKK

SEQ ID NO: 51469 - DNA, 708 bp, Photorhabdus luminescens subsp
  CDS (1)..(708): transl_table=11
atggaattccatccacctttacaatctgccacgctaattcgtcgttataaacgcttcctggctgatgtcatcacaccggaaggtgaaacactgactatccactgtgccaatacaggtgccatgaccggctgtgcgacaccgggagatacggtttggtattccacctccgataatccaaaacgtaaatacccaaacagttgggaattgacagaaacaccggctggtcactggatttgtgtcaatacgctcagagcaaatgatttagtcgccgaggctattgcacaaaatgccattccagaattttctgaatataaaaaaatcagccgggaagtgaaatatggcgaagagaacagtcggatagatttactgttacaagcagaacagcaggttaattgctatattgaagtgaaatcagtgacactgctccaagaaaattgtggctatttcccagatgctgtcacgacccgcggacagaaacacttgcgggaattgcagcacatagcagaacaagggcaaagagctgttttattttttgctgttctgcattctgggatcaatcaggtcgcggcggctgcacatattgatcataattattcatctcttttggaacaagcgcaaaactctggggtcgaagttatctgttaccaggccaacatgacgggaaaagggatggttttaggcgataagttaacttttttactgaaatga

SEQ ID NO: 51470 - protein, 235 aa, Photorhabdus luminescens subsp
MEFHPPLQSATLIRRYKRFLADVITPEGETLTIHCANTGAMTGCATPGDTVWYSTSDNPKRKYPNSWELTETPAGHWICVNTLRANDLVAEAIAQNAIPEFSEYKKISREVKYGEENSRIDLLLQAEQQVNCYIEVKSVTLLQENCGYFPDAVTTRGQKHLRELQHIAEQGQRAVLFFAVLHSGINQVAAAAHIDHNYSSLLEQAQNSGVEVICYQANMTGKGMVLGDKLTFLLK

SEQ ID NO: 51471 - DNA, 705 bp, Photobacterium profundum
  CDS (1)..(705): transl_table=11
atgaagtttgatccccctcttcagtcagctacattaataaagcgctataaacgcttccttactgatattgaattacccgatggcgaaatacgcaccattcattgtgccaatacaggagcgatgactggctgtgctgaacccggaaataccgtttggttctcaacatcagaaaataaaaaacgtaaatatcctaatagctgggagctcgctgaaacagcaaatgggcattggatctgtgttaacacagcacaagctaaccgactggttgtagaggcaattaacgctggtaccatcacagaattacaaggctattcgtcgctaagaaccgaagttaagtatggtagtgaaaacagcaggatagatattctgttagaagataaaaataaacctgtctgctatattgaggtgaaaagcgttacattattagataatggtcaaggttttttccccgatgcggtaacaactcgagggcaaaaacacttaagggaattgatcgaagtcgctcaaaatggtcaaagatcagtactttttttcgctattttgcattcaggtattgaaaatgtgtctgcggcacaccacatagacccggactactatcgtttaattaaacaagcagaacaggctggcgttgaaatcatctgttataaagcaacattaaaccaagatgaaatcaaattaaaccactgtatgaatttcaaccaataa

SEQ ID NO: 51472 - protein, 234 aa, Photobacterium profundum
MKFDPPLQSATLIKRYKRFLTDIELPDGEIRTIHCANTGAMTGCAEPGNTVWFSTSENKKRKYPNSWELAETANGHWICVNTAQANRLVVEAINAGTITELQGYSSLRTEVKYGSENSRIDILLEDKNKPVCYIEVKSVTLLDNGQGFFPDAVTTRGQKHLRELIEVAQNGQRSVLFFAILHSGIENVSAAHHIDPDYYRLIKQAEQAGVEIICYKATLNQDEIKLNHCMNFNQ

SEQ ID NO: 51473 - DNA, 681 bp, Picrophilus torridus
  CDS (1)..(681): transl_table=11
atgtcgccatttataaaacgcgggcatggattcatggttttaagttttgaaaatctaattgacgctgtaattgtatcaagaataaaccgcttcgttgtaaaatgcatggtaaacaatgaggaggtctatgcgcatttgcatgatccgggaaggcttaatgaaataatatatccaggaaataaaataaaattaagaaaaactgatggtaaaaaatataattattctgttacctttggccatgacggatttaattacacattaaatgatgcaaggtttcattcaatgatagcatcacagtttttaagactgggcttcaaaaaggagtataaatacatggattccagaatagattttcttcttgatgaatatctaatagaggtaaaatcctgcacccttgtaaattctaaaaaggccatgtttcctgatgctgtaacaaggaggggaacacatcatttaaatgtgctattaaattcgatacaagatggttatagaccatacattatgtttttgatattcaacgagcgtgcggaatgctttacaccaaataaatgcagggatcctgaattttccgggacattttacagggcagttaaaaacggtgtttcatcgaaattcctggttttttatataagggaaaattctatatattttgataaggaaatatcaatgtgcgttgattaa

SEQ ID NO: 51474 - protein, 226 aa, Picrophilus torridus
MSPFIKRGHGFMVLSFENLIDAVIVSRINRFVVKCMVNNEEVYAHLHDPGRLNEIIYPGNKIKLRKTDGKKYNYSVTFGHDGFNYTLNDARFHSMIASQFLRLGFKKEYKYMDSRIDFLLDEYLIEVKSCTLVNSKKAMFPDAVTRRGTHHLNVLLNSIQDGYRPYIMFLIFNERAECFTPNKCRDPEFSGTFYRAVKNGVSSKFLVFYIRENSIYFDKEISMCVD

SEQ ID NO: 51475 - DNA, 756 bp, Prochlorococcus marinus
  CDS (1)..(756): transl_table=11
atgatcggcaaaaccattaccaacttttctccgcttacggaaggcatattactgaaaagatataaacgttttcttgcagatgtggagcttgacactggggaagtagtaactgcacattgtgcgaatacaggacccatgaaaggtgtattacatgttggcggacgtgtcagattaagacactctccttcaccttctaggaagttaagttggtcttgggaacaagctcaggttccttctggtcaatctttttcttgggttggagttaatactgctttacctaataagttggttaggcttgcaattgaggcaggttgcttaaagcaagagttaggtgagatttttgaaattaaaaatgaagtgacgtatggggttgcaaggaaaagtcgaattgatttgctattaactcctcatttcaacaattcagattctcgtaagatttttgtagaaattaaaaatacaacttgggctaaagggtctacagctgttttccctgacacagttacaacaagaggacaaaagcatttgcaagaaatgattaatgaagtgccttcttcacgagcggtcttggttccttgcattagcagaaatgatattgaagtatttgttcctggtgattcagctgatgctaagtatggcgatctttttagattggctctgaatgcaggagtagaagtaataccttgcgcttttgattttcatttggattgcatcacttgggaaggcactaaaccattccttaaaggagaaaatttttga

SEQ ID NO: 51476 - protein, 251 aa, Prochlorococcus marinus
MIGKTITNFSPLTEGILLKRYKRFLADVELDTGEVVTAHCANTGPMKGVLHVGGRVRLRHSPSPSRKLSWSWEQAQVPSGQSFSWVGVNTALPNKLVRLAIEAGCLKQELGEIFEIKNEVTYGVARKSRIDLLLTPHFNNSDSRKIFVEIKNTTWAKGSTAVFPDTVTTRGQKHLQEMINEVPSSRAVLVPCISRNDIEVFVPGDSADAKYGDLFRLALNAGVEVIPCAFDFHLDCITWEGTKPFLKGENF

SEQ ID NO: 51477 - DNA, 747 bp, Prochlorococcus marinus subsp
  CDS (1)..(747): transl_table=11
atgaatgatcgaataattgaatttgaaccattaattgaaggtattttaattaaaagatataaaagatttctcgctgatattcagattgaaaatggagaaatagttactgcccattgtgctaatacaggcccgatgaagggtcttttaaacgaaggagctaacgtaagaattagcttctcttcatcaactaaaagaaagctaccttggacttgggaacaagtaaaagtaataggaagagataacaaagaggtatgggttgggataaatacattatttgcaaataaactgattagaaaagttattgaacaaaacctattcaaagataaactcggggagatagctaaaatcaagtctgaagtaccttatggcaaagataaaaaaagtagaattgattttcttttaactccaaaatcttcaaatcctgataatcgtaacatttatgttgaggttaaaaatactacttggacaaaaaataatgtagctcttttccctgatacggagactaaaagaggacaaaaacatttaatagaattaaaaggcttaattcctgaaagtaaaagtgttttagttccttgcattacaagaaaagatatagattattttgcccctggagatgaatcagatccattgtatggagagctttttcgagaatcaattagtgcaggtatgttactaattccatgctgttttgagtttcattcagatcatgtagcttggaaaggatttaaacccttaaaattaaattaa

SEQ ID NO: 51478 - protein, 248 aa, Prochlorococcus marinus subsp
MNDRIIEFEPLIEGILIKRYKRFLADIQIENGEIVTAHCANTGPMKGLLNEGANVRISFSSSTKRKLPWTWEQVKVIGRDNKEVWVGINTLFANKLIRKVIEQNLFKDKLGEIAKIKSEVPYGKDKKSRIDFLLTPKSSNPDNRNIYVEVKNTTWTKNNVALFPDTETKRGQKHLIELKGLIPESKSVLVPCITRKDIDYFAPGDESDPLYGELFRESISAGMLLIPCCFEFHSDHVAWKGFKPLKLN

SEQ ID NO: 51479 - DNA, 708 bp, Pseudomonas aeruginosa
  CDS (1)..(708): transl_table=11
atgcgtttcgagcagccactggaagaaggccgcctgctgcgtcgctacaagcgtttcctcgccgatatcgagagcgccggcggcgagcgcctgactatccactgtccgaataccggttcgatgctcaattgcatgagcgaaggttgccgggtctggttcagccgctccaacgaccccaagcgcaagctgccggggacctgggagctgagcgagactccgcagggccgcctggcctgcgtcaacacggcgcgggccaaccgcctggtagaggaggcgctgctggccggggacatcgcggagcttgccggtttcaccgctctgcgccgggaagtggcctacggcgtagagaacagtcgcgccgactttcgcctggaataccccacgggcgcactgttcatcgaggtgaagagcgtcaccctgggcttcgacgaaaccgccgtggcggcctttcccgacgcggtgacgctgcgcggtgccaagcacctgcgcgaactggcggcgctggcgcgggaggggatccgcgcggtgcagctgtactgcgtgaacctttccggggtcgaggcggtgcgccccgccgacgagatcgatccagcctatggcaaggcgttgcgcgaggcggcgcaagcgggcgtcgaggtgctggcctatggcgccgaggtgacgacggaaggattgaacctggcgcggcgcctcccggtgcgactctga

SEQ ID NO: 51480 - protein, 235 aa, Pseudomonas aeruginosa
MRFEQPLEEGRLLRRYKRFLADIESAGGERLTIHCPNTGSMLNCMSEGCRVWFSRSNDPKRKLPGTWELSETPQGRLACVNTARANRLVEEALLAGDIAELAGFTALRREVAYGVENSRADFRLEYPTGALFIEVKSVTLGFDETAVAAFPDAVTLRGAKHLRELAALAREGIRAVQLYCVNLSGVEAVRPADEIDPAYGKALREAAQAGVEVLAYGAEVTTEGLNLARRLPVRL

SEQ ID NO: 51481 - DNA, 714 bp, Pseudomonas putida
  CDS (1)..(714): transl_table=11
atgcgtttctctccttcactcgagcagggccgcctgttgcgtcgctacaagcgctttctggccgatatcgaactggccagcggcgagcagatgactatccactgcccgaataccggctccatgctcaactgcatgcgtgaaggtgggcaggtgtggttcagccgctccaacgaccccaagcgcaagctgccagggacctgggaaatcagcgaaaccccccaggggcggttggcctgcgtgaataccgggcgggccaatgcgttggtcgaagaggccctgcgcgccggtacaatcactgaactggccggtttcactgcactcaagcgcgaagtggcctatggcgaggaaggcagccgtatcgactttcgcctggaattcgagggtgccccggcctatgtcgaggtcaagagtgtgacgctgggctaccccgacactgcagttgcggccttccctgatgcggtgactcaacgcggtgcgaaacacctgcgtgagctggcaaagctggcccggcagggcgtgcgggccgtgcagctgtattgcgtgaacctgaccggtatcgacgctgtgcgcccggctgaagaaatcgatacggcctacgcccaggcgctgcgcgctgccgtagcggacggggtggaggtgctggcctatggcactcggctggacgccgagggtatcgtcatcgatcgccgcttgccggtgctgctgaccccttga

SEQ ID NO: 51482 - protein, 237 aa, Pseudomonas putida
MRFSPSLEQGRLLRRYKRFLADIELASGEQMTIHCPNTGSMLNCMREGGQVWFSRSNDPKRKLPGTWEISETPQGRLACVNTGRANALVEEALRAGTITELAGFTALKREVAYGEEGSRIDFRLEFEGAPAYVEVKSVTLGYPDTAVAAFPDAVTQRGAKHLRELAKLARQGVRAVQLYCVNLTGIDAVRPAEEIDTAYAQALRAAVADGVEVLAYGTRLDAEGIVIDRRLPVLLTP

SEQ ID NO: 51483 - DNA, 714 bp, Pseudomonas syringae pv
  CDS (1)..(714): transl_table=11
atgcgtttttccccagagctcgaacagggtcgcctgctggtgcgctacaagcgctttctggctgatatcgaaaccgacagcggtgagttgctgaccattcactgccccaacaccggctcgatgctcaactgcatgatgcccggtgggcgggtatggttcagtcgctccaatgaccccaagcgcaagctgccgggcacttgggaaatcagcgagacgccgcaaggccgcttggcctgtatcaataccggacgggccaatacgctggtcgaagaagcattgcgcgccggggtgatccgcgaacttgaggggtttacagcgctcaagcgtgaggtggcctacgggcaggaaaaaagccgtgtggactttcgtctggaatacccggacggctacctgtacctggaggtaaaaagtgtgaccctgggtttcgccgactctgcggtggcagcgtttcccgacgcggtcacccagcgtggggcgcggcaccttcgcgaactggccacgctggcccgtgaaggcgtgcgagcggtgttgctgtactgcgtcaatctcacgggcatagaggctgtgcgcccggccaaagagatcgacccggcgtacgccgctgcactacgcgaagcggtcgatgccggcgtgcagatcctcgcgtatggggtgcagttgacgccagaagcggtatatatcgaccggcatctcgaggtgcactggccggattga

SEQ ID NO: 51484 - protein, 237 aa, Pseudomonas syringae pv
MRFSPELEQGRLLVRYKRFLADIETDSGELLTIHCPNTGSMLNCMMPGGRVWFSRSNDPKRKLPGTWEISETPQGRLACINTGRANTLVEEALRAGVIRELEGFTALKREVAYGQEKSRVDFRLEYPDGYLYLEVKSVTLGFADSAVAAFPDAVTQRGARHLRELATLAREGVRAVLLYCVNLTGIEAVRPAKEIDPAYAAALREAVDAGVQILAYGVQLTPEAVYIDRHLEVHWPD

SEQ ID NO: 51485 - DNA, 720 bp, Pyrobaculum aerophilum
  CDS (1)..(720): transl_table=11
gtgggaattcccggaggagagatcttacaacttccgacgcctgatgtggagggggtgtttttaaagcgacttaatagatttgccggcgtggcgctgataggggggagggagtcgtatgtacacattcacgatccagggcggctgagggagttgttgttccccggggctaagatatgggctaggagaaccgtcagggggaggaccgagtattacctcgccgccgtggagctagacgacgaattggtcttagttgactcgtcgttgcacaataaaatagctgtgtggcttatagaaaacggctatttgttgaggggctattcgcttgagaagagagagcctgcttttggcagaggccgttttgacctattactgaagtccccggaggggaggcgggcgcttgtagagatcaagggcgtgactttagaagtaggcggcagggcgcttttccctgacgccccaacctcacggggggcccgccacatggaggaactggccagggccgtggccgagggttacgaggctcacgtaatcttcctagtgttgaggaagagggcggagtcgatgtcgccccactgggagatggaccggaaatttgccgagagcctcctccgggctcataaggctggcgttaaaattcacgctgttaagttggagatgtttaaatgggggttgcggttttcaagcgagttgccggtggacttatctcctagagatttctaa

SEQ ID NO: 51486 - protein, 239 aa, Pyrobaculum aerophilum
MGIPGGEILQLPTPDVEGVFLKRLNRFAGVALIGGRESYVHIHDPGRLRELLFPGAKIWARRTVRGRTEYYLAAVELDDELVLVDSSLHNKIAVWLIENGYLLRGYSLEKREPAFGRGRFDLLLKSPEGRRALVEIKGVTLEVGGRALFPDAPTSRGARHMEELARAVAEGYEAHVIFLVLRKRAESMSPHWEMDRKFAESLLRAHKAGVKIHAVKLEMFKWGLRFSSELPVDLSPRDF

SEQ ID NO: 51487 - DNA, 693 bp, Pyrococcus furiosus
  CDS (1)..(693): transl_table=11
atgaaacttatggaagtttctcccctttttccttgtatatttttaagaagagttaaccgatttgtgggattggtgagaattaaggaaagaattgaaagagctcttatcacaaatactggtagactaaatgagttcatgatcccagggagaataggctattgtactccaaaagcgggcggtaaaacaaggtacattcttcttggatttgaagatcatggaaagatagcaatcattgatactagacttcagggaaaagcatttgagaaaataattgagaaggaacttcttcctgaactggaaggttgtagaataataaagagagagccaagggttggagaatccagactagactatttgcttgaatgttcgaaaggagagatattcgtagaaactaagagtgcagttttgagggaaggggaatatgctatgtatccagattgtccatcagttagaggtcaaaggcatataaaagagctaataaagttggcgagagatggaaaaagggccatgattgtgtttataggggccctaccaaatgtaagcaaatttaaaccctacaagaagggagatccgaaaattgctgaattgttaaaggaagctcttgaggctggagtagaaattcgggcgttgggacttcacatggagcttagtggagaaataatatacagaggagagttaggagtagaaatctaa

SEQ ID NO: 51488 - protein, 230 aa, Pyrococcus furiosus
MKLMEVSPLFPCIFLRRVNRFVGLVRIKERIERALITNTGRLNEFMIPGRIGYCTPKAGGKTRYILLGFEDHGKIAIIDTRLQGKAFEKIIEKELLPELEGCRIIKREPRVGESRLDYLLECSKGEIFVETKSAVLREGEYAMYPDCPSVRGQRHIKELIKLARDGKRAMIVFIGALPNVSKFKPYKKGDPKIAELLKEALEAGVEIRALGLHMELSGEIIYRGELGVEI

SEQ ID NO: 51489 - DNA, 720 bp, Rhizobium meliloti
  CDS (1)..(720): transl_table=11
ttgaatttccctcgcccgctcgtacctgcgacgcttgtgcagcgttacaagcgcttcctgttcgacgctattctggccgatggaacggcaatcaccggttcatgcccgaataccggctcgatgcgtggcctgaccataccgggctcgccgatctggctctcggaacacgacagcccaacacgcaagtatcgccacatgctggagatcgtcgaggcggacggcacgctggtcggcatcaacaccggattgccgaaccggatcgccgaagaggcgatcatggccggacaggtgggcaatctccacacctacggcacgctccggcgcgagcagagatacggccgcaattcgaggatcgacattctgctcagcgatgcggaaaagggcctcgcctatgtcgaggtgaagaacgtccatttcagccgcgtccgcggtctcgccgaattcccggacagcccgacacaacgcggcgcgaaacatctagaggaactgggcgatatggtcgaggcgggacaccgcgcgatcatgctctatcttatccagagaggcgattgcagtcgcttccgcatatgccgtgagctcgacccggtttatgctcgtgctttcgaaagggcgagcgcccgcggggtcgaggcctatgcggtcaagtgcgcggtatcgccggggcaaatcgtggcggcaggaccgatcgtagtggacgaaccggtccctgctgttttatga

SEQ ID NO: 51490 - protein, 239 aa, Rhizobium meliloti
MNFPRPLVPATLVQRYKRFLFDAILADGTAITGSCPNTGSMRGLTIPGSPIWLSEHDSPTRKYRHMLEIVEADGTLVGINTGLPNRIAEEAIMAGQVGNLHTYGTLRREQRYGRNSRIDILLSDAEKGLAYVEVKNVHFSRVRGLAEFPDSPTQRGAKHLEELGDMVEAGHRAIMLYLIQRGDCSRFRICRELDPVYARAFERASARGVEAYAVKCAVSPGQIVAAGPIVVDEPVPAVL

SEQ ID NO: 51491 - DNA, 705 bp, Salmonella paratyphi
  CDS (1)..(705): transl_table=11
atgctattctcaccccctttacaacgcgctacgttgattcagcgctataaacgttttttagctgatgtcatcacccctgacggtacgacgcttacgctgcactgtcctaatactggcgcgatgaccggctgcgccacgcctggcgataccgtctggtattcgacatcagaaaatactaaacgcaaatatccgcatacctgggaattgactgaaacgcaattcggcgcattcatttgcgtgaatacgctgcgggcgaaccagctaacgaaagaagcaattcaggagaatcgcctgccggcgctggcggggtacaatattctgaaaagtgaagtcaaatatggcgccgaacgcagccgtatagattttatgttacaggcagatttccgcccggactgctatattgaagtgaaatcggtcacgttagcggaaaaagaaaacggttattttcccgacgccatcaccgaacgagggcaaaaacatcttcgggagttgatgggcgttgcggcggcaggtcatcgcgcggtggtggtgttcgcggtgctgcactccgccattacacgtttttcccccgcacgtcatatcgatataaaatacgcgcagctattgagcgaggctcagaataaaggcgtggaagttttagcttataaagcagaactttcagcccaaaaaatggaactgaacgaaccagtacccataacgttgtag

SEQ ID NO: 51492 - protein, 234 aa, Salmonella paratyphi
MLFSPPLQRATLIQRYKRFLADVITPDGTTLTLHCPNTGAMTGCATPGDTVWYSTSENTKRKYPHTWELTETQFGAFICVNTLRANQLTKEAIQENRLPALAGYNILKSEVKYGAERSRIDFMLQADFRPDCYIEVKSVTLAEKENGYFPDAITERGQKHLRELMGVAAAGHRAVVVFAVLHSAITRFSPARHIDIKYAQLLSEAQNKGVEVLAYKAELSAQKMELNEPVPITL

SEQ ID NO: 51493 - DNA, 705 bp, Salmonella typhimurium
  CDS (1)..(705): transl_table=11
atgctattttcaccccctttacaacgcgctacgctgattcagcgctataaacgttttttagccgatgtgatcacccctgacggtacgacgcttacgctgcactgtcctaataccggcgcgatgaccggctgcgccacgcctggcgataccgtctggtattcgacatcagaaaatactaaacgcaaatatccgcatacctgggaattgactgaaacgcaatccggcgcattcatttgcgtgaatacgctgcgggcgaaccagctaacgaaagaagcgattcaggagaatcgcctgccggcgctggcggggtacaatattctgaaaagtgaagtcaaatatggcgccgagcgcagccgtatagattttatgttacaggcagatttccgcccggactgctatattgaagtgaaatcggtcacgttagcggaaaaagaaaacggttattttcccgacgccatcaccgaacgagggcaaaaacatcttcgggaattgatgggcgttgcggcggcaggtcatcgcgcagtggtggtgttcgcggtgctgcactccgccattacacgtttttcccccgcacgtcatatcgatataaaatacgcgcagctattgagcgaggctcagaataaaggcgtggaagttttagcttataaagcagaactttcagcccaaaaaatggaactgaacgaaccagtacccataacgttgtag

SEQ ID NO: 51494 - protein, 234 aa, Salmonella typhimurium
MLFSPPLQRATLIQRYKRFLADVITPDGTTLTLHCPNTGAMTGCATPGDTVWYSTSENTKRKYPHTWELTETQSGAFICVNTLRANQLTKEAIQENRLPALAGYNILKSEVKYGAERSRIDFMLQADFRPDCYIEVKSVTLAEKENGYFPDAITERGQKHLRELMGVAAAGHRAVVVFAVLHSAITRFSPARHIDIKYAQLLSEAQNKGVEVLAYKAELSAQKMELNEPVPITL

SEQ ID NO: 51495 - DNA, 705 bp, Shewanella oneidensis
  CDS (1)..(705): transl_table=11
atgcactttactccagcactgaaaccgggaaaattactcaaacgttacaagcgttttctcgccgatgttcaactcgaagacggcagtgaaatcaccgtccactgtccgaatacaggctcaatgcgtaactgcctgttcccgggtgaaaccctgtggttctcaacgtccagcaatactaaacgtaagtatgcccacacgtgggaattaatgacgaccccaacaggtgcgctgattggcattcactcaggcaatgccaacgccctggtcgaggaagcgcttaataaaggcatcatcaccgaactgacaggctacgacagtttacgccgcgaagtgaagtatggagatgaaaatagccgtattgatatcttgctagagtgcgctcaaaaaaccgcctgctatatagaagtcaaaagttgtactttgcaggaaaatggccaaggttatttccccgatgcagtgagtcttcgcggccaaaaacacctgcgagaattaatgcatatggctagccttgggcatagagcggtattgttatttgtggtgcaacatactgacattatgagtgtggctcccgcagcacacatcgaccctgaatacgctaacttattgaaaaaatctgttttatcaggagtagaagtactagcgtatcgctgtgaaatatcccctagtgagatacatctagcccaatcgtgtccagtccgagtatga

SEQ ID NO: 51496 - protein, 234 aa, Shewanella oneidensis
MHFTPALKPGKLLKRYKRFLADVQLEDGSEITVHCPNTGSMRNCLFPGETLWFSTSSNTKRKYAHTWELMTTPTGALIGIHSGNANALVEEALNKGIITELTGYDSLRREVKYGDENSRIDILLECAQKTACYIEVKSCTLQENGQGYFPDAVSLRGQKHLRELMHMASLGHRAVLLFVVQHTDIMSVAPAAHIDPEYANLLKKSVLSGVEVLAYRCEISPSEIHLAQSCPVRV

SEQ ID NO: 51497 - DNA, 693 bp, Silicibacter pomeroyi
  CDS (1)..(693): transl_table=11
atgcgctttcaaacaactcttgtccccgcccgcctgatccgtcgctacaaacgctttctggccgattgccagttggaagacgggcgcgaggtgaccgcccattgcgccaatcccggctcgatgatggggctggcggaccccggaacgaaaatctggctggaacccaatgacgatccgaagaagaagctgaagttcggctggcggttggtcgatcacgagaacggccatttcaccggtgtcgatacctcggtcccgaaccgggccttgaagaccgcgctcgagcgccgcgccattccgtcgctggccgcctatgaaacggtgcggcccgaggtgaaatacggccagaacagccgcatcgactttctgctgagcgggcccggcctggcggacgcctatgtcgaggtcaaaagcgtgacactgtgccgtgagcccggcctggccgagtttcccgacagcgtgaccgcgcgcggcgccaagcatctggcagagctggctgcgatggccgggctggggcatcgggcgatcatgctttatctggtacagcggaccgattgcgacagattcaccctggccgcggatatcgacccggcctatgcgcgcgcctttgaaacggcccgcgcgcagggtgtggaaaagctgatcctgaccacccatatctctcctcaaggagtcgaaatcgccgatatgctttga

SEQ ID NO: 51498 - protein, 230 aa, Silicibacter pomeroyi
MRFQTTLVPARLIRRYKRFLADCQLEDGREVTAHCANPGSMMGLADPGTKIWLEPNDDPKKKLKFGWRLVDHENGHFTGVDTSVPNRALKTALERRAIPSLAAYETVRPEVKYGQNSRIDFLLSGPGLADAYVEVKSVTLCREPGLAEFPDSVTARGAKHLAELAAMAGLGHRAIMLYLVQRTDCDRFTLAADIDPAYARAFETARAQGVEKLILTTHISPQGVEIADML

SEQ ID NO: 51499 - DNA, 723 bp, Sulfolobus solfataricus
  CDS (1)..(723): transl_table=11
atgaatgaaagcaactcccaagatctaactagagtctcgcccttttatattaaagaggggtttagcgtatacgagtttactgaaaaattatttgaggcatatgttatagaacgaataaatagattcttagttaaagtaacccttgacggggaagaaatccttgtacatttacacgatcctggcagattaaaagaattaatttaccctggaaacttagttctaataagggaaacaaaaggtaataagacaaaattttcaataactgcagcttacgctaactcaagatttatagtattagatagtagattacataacattatagcctctaaatttataccaaaaatctacgaaaaggaggttaaggtaggaaatagtagaattgacttcaagtatgataatacatacttggaagtaaaaggctgtacattggtggaaaacgagatagcttatttcccagacgctccaaccgaaagaggcagaaagcacctaaaagagttgagagaattaatgagaaagggatttaacgcaatactattgattctagtaatgaggaacgacgctaaatgcttcttacctaatgagaaaaccgatcccaaattttctgttgagttttgggattcaataaaggaaggattaaaagtctacataaagacttttagcttaatcggaaataagatagtctatgtcggagatattccactatgcaaaacaaatttaacttaa

SEQ ID NO: 51500 - protein, 240 aa, Sulfolobus solfataricus
MNESNSQDLTRVSPFYIKEGFSVYEFTEKLFEAYVIERINRFLVKVTLDGEEILVHLHDPGRLKELIYPGNLVLIRETKGNKTKFSITAAYANSRFIVLDSRLHNIIASKFIPKIYEKEVKVGNSRIDFKYDNTYLEVKGCTLVENEIAYFPDAPTERGRKHLKELRELMRKGFNAILLILVMRNDAKCFLPNEKTDPKFSVEFWDSIKEGLKVYIKTFSLIGNKIVYVGDIPLCKTNLT

SEQ ID NO: 51501 - DNA, 678 bp, Sulfolobus tokodaii
  CDS (1)..(678): transl_table=11
atgattgtttatagttttcccacactatatgaggagattgtgaaagctaggattaaccgttttacagtagtaacagagagtgagaaaatttgtcaccttcacgatcctggaagacttaaggagcttatttatcctggtaacaaaatattaataagaaacgttaacggaaaaagaaaaaccaattgtcaagttacagcagcatggagcggtaaagaatgggttgtaacagattccagtatacataacgaaatagctagaaggtttttacccagtgatgccaaatctgaagtaacggtagggaaaagtaggattgactttgcatttgataatacatatgttgaggttaagggctgtactcttgctagagatggtatagctcttttccctgatgctccgactaagagaggaaaaagacatctagatgagttgatagagcttaggagaaatggatattcagttttactcatgattctcgtttttagaactgatgttgtgtgcttttctcctaattttgatacagaccgagatttttctaatacatttattaaagcattaaaagagggcgtaaatgttgaagttaaagtgtttcaattagataaagaaaatatagtatataagggagaaattcctgtttgtcaccaaattcttgaaaaatcaactaatttctccttaccctaa

SEQ ID NO: 51502 - protein, 225 aa, Sulfolobus tokodaii
MIVYSFPTLYEEIVKARINRFTVVTESEKICHLHDPGRLKELIYPGNKILIRNVNGKRKTNCQVTAAWSGKEWVVTDSSIHNEIARRFLPSDAKSEVTVGKSRIDFAFDNTYVEVKGCTLARDGIALFPDAPTKRGKRHLDELIELRRNGYSVLLMILVFRTDVVCFSPNFDTDRDFSNTFIKALKEGVNVEVKVFQLDKENIVYKGEIPVCHQILEKSTNFSLP

SEQ ID NO: 51503 - DNA, 756 bp, Symbiobacterium thermophilum
  CDS (1)..(756): transl_table=11
gtgaaaggagcagaaccgttggctgaacttcgtctgcgggccacctttctcgaacgccccaaccgcttcgtcgcccgggtccgcctggaggacggccgggaggtgccggtgcacgtggcctcatcgggccgtatgaaggagcttctggtgcccggtgcgccggtgatcgtgacgctgcaaggcgacgcgtctgcgcagccaacccggccgttcgggggccggaagaccgccggcaggctgctcatggtccgtaccgggtccacctgggtctcggtggatacatccttgcccgggaagctcttccaccaggcggtggtcgcggggagctgcgctcccttcgccgggtacaccgaggtacgtcccgagtaccggtacggcggcagccgcatcgatttcctgctgaccgcgccggacctgcccccgtgcctggtggaggtgaagtccgtcacctccgtgctgccggacgcggacggcgcccgcgtggcgcggttcccggacgcgccgacggcccgcggcgcccgccacctggacgaactggccggggccgtgcgggaagggtacagggcggccgtctgcttcatcacgcagcgggacgacgcccaggccttcggcccgtgggacgagatcgatccgttcttcggtgaaaccctgcgcaaagtggctcgggccggggtggagatccgggccttcgtcacgcacgtgaccccggagggcgccgtcctgggcggggagcttcccgtacggctggcgcggtga

SEQ ID NO: 51504 - protein, 251 aa, Symbiobacterium thermophilum
MKGAEPLAELRLRATFLERPNRFVARVRLEDGREVPVHVASSGRMKELLVPGAPVIVTLQGDASAQPTRPFGGRKTAGRLLMVRTGSTWVSVDTSLPGKLFHQAVVAGSCAPFAGYTEVRPEYRYGGSRIDFLLTAPDLPPCLVEVKSVTSVLPDADGARVARFPDAPTARGARHLDELAGAVREGYRAAVCFITQRDDAQAFGPWDEIDPFFGETLRKVARAGVEIRAFVTHVTPEGAVLGGELPVRLAR

SEQ ID NO: 51505 - DNA, 726 bp, Synechococcus elongatus
  CDS (1)..(726): transl_table=11
gtgactcccccattctgttggtactatccaccgctccaagaaggaattctctgtcggcgctatcagcgattttttgctgagattgagttgacctcgggcgatcgcgttacggcccactgcccaaatacagggccaatgacagggatttgccaagtaggtgctcccgttcaagtctcctaccatgcggatcccaagcgtaagctagcctatacgtgggaaatgatttttgttgacggtacctgggtaggggtgaataccagtctgcccaatcgggtcattgcttcggcgttggcggcaggcatcctaccggaactggctggctacggcactcagcagcgagaggtggcctacggtcaagagcgcagccgcattgacttttacttaacggatcatcctcaagagccccccgcctatgttgaggtgaaaaataccacttgggcgcaagggggtttagccctgtttcctgatacggtcaccagccgcggtcaaaaacatctgcgggaactgcaacggctgcggcaaacccaaccagaaactcgggtgtgtatgctctactttattaatcgcggcgattgcgatcgctttgcgcccggagatagtgctgatcccacctatggacagctcctacgcgctgcctacaaccaaggggtggaaattttgccctaccgcttcgccattgaaccaaggggcattcagttcttgggaactgccaagctgttgctctag

SEQ ID NO: 51506 - protein, 241 aa, Synechococcus elongatus
MTPPFCWYYPPLQEGILCRRYQRFFAEIELTSGDRVTAHCPNTGPMTGICQVGAPVQVSYHADPKRKLAYTWEMIFVDGTWVGVNTSLPNRVIASALAAGILPELAGYGTQQREVAYGQERSRIDFYLTDHPQEPPAYVEVKNTTWAQGGLALFPDTVTSRGQKHLRELQRLRQTQPETRVCMLYFINRGDCDRFAPGDSADPTYGQLLRAAYNQGVEILPYRFAIEPRGIQFLGTAKLLL

SEQ ID NO: 51507 - DNA, 711 bp, Synechococcus sp
  CDS (1)..(711): transl_table=11
atgcctcagcggctctatacctatccccctctgttgcgggggcgcttgctccagcgctacaaacgcttttttgctgatattgaactcgacagtggcgagacgatcacggctcactgcccgaacacggggccaatgacgggcgtttgtcagatgggcaatctggtttatgtctctaaatcagacaatcccaaacggaagttggcctacacctgggaactgattgaggtcacggataacgaaccgacttgggtgggtgtcaatacggggctaccgaatcgggtggttcaagccctgctcgagcagcgttgcttgccggtgttgggcgactatggcgaggtgcagcgcgaggtcccgtatggcgagaacagtcggattgatttccgattaacgggcgatcgccccatctatgtcgaggtgaaaaatacgacttggacggctggtcgcctcgcgcttttcccagataccgtcacgactcgcggccagaagcacttgcgggagctgacagcgattttgctggaagcgcgagcggtcatgctctacttcatcaatcggggcgattgcactgctttcgcgccgggagatagcgccgacccaacctatgggcagctgttgcggactggcattgctgccggtcttgaagtctatccctgccaatttcagatcagtcctgaaggcattgattttttaggcgttgcccctttgcaactctaa

SEQ ID NO: 51508 - protein, 236 aa, Synechococcus sp
MPQRLYTYPPLLRGRLLQRYKRFFADIELDSGETITAHCPNTGPMTGVCQMGNLVYVSKSDNPKRKLAYTWELIEVTDNEPTWVGVNTGLPNRVVQALLEQRCLPVLGDYGEVQREVPYGENSRIDFRLTGDRPIYVEVKNTTWTAGRLALFPDTVTTRGQKHLRELTAILLEARAVMLYFINRGDCTAFAPGDSADPTYGQLLRTGIAAGLEVYPCQFQISPEGIDFLGVAPLQL

SEQ ID NO: 51509 - DNA, 765 bp, Synechococcus sp
  CDS (1)..(765): transl_table=11
atgaccggctgcacgacccccggcgatgccctgcttagctttgaaccgcttgaagaaggcgttctgatcaagcgctacaagcgttttctggcggatgtagaactcagcagcggagaggtgatcaccgcccactgcgccaacaccggcccgatgactggggtgttaatcccaggccagcgggttcgactgcgccatgccccctcacccaagcgcaagctggcttggacctgggagcaagccgaggtgccaggggcggacggtgccccctgctgggtgggcatcaacacggcgctgcccaaccgcttgataagggccacgatcgaagccggctgcttggccgctcagctggggcccatcgccagcatccgcgccgaagtggcctacggagccaacaaacgcagccggattgatctgctgctcacgccgaccgactccaatcctgatcagcggccgatctatctcgaggtgaaaaacaccacctggaccgatggcaccacagccctgttcccagacacggtgactgaacgtggccagaagcacctggtggagctgatgggtgttcttccagattccagagcggtgttggttccctgtctgagtcgtccggatgtgacggagttcgcgccaggggacagcgcggatccgcgctatggagaactgttccgcgaggcgatcaaagccggcgtggaggtgctgccctgccgcttccgcttccaggcagatggaattcgctgggaagggatcagacccttgaaacaactttga

SEQ ID NO: 51510 - protein, 254 aa, Synechococcus sp
MTGCTTPGDALLSFEPLEEGVLIKRYKRFLADVELSSGEVITAHCANTGPMTGVLIPGQRVRLRHAPSPKRKLAWTWEQAEVPGADGAPCWVGINTALPNRLIRATIEAGCLAAQLGPIASIRAEVAYGANKRSRIDLLLTPTDSNPDQRPIYLEVKNTTWTDGTTALFPDTVTERGQKHLVELMGVLPDSRAVLVPCLSRPDVTEFAPGDSADPRYGELFREAIKAGVEVLPCRFRFQADGIRWEGIRPLKQL

SEQ ID NO: 51511 - DNA, 714 bp, Synechocystis sp
  CDS (1)..(714): transl_table=11
atggactttctctatccctatccgcctctaattagtggcattttggtaaaacgctacaaacgctttttagctgatgtggagttagataatggtgagatagtcacagctcattgtcctaacactggccccatgacaggggtgtgccaagttggggcgcaggtctacctgtctaagagtgataatccccagcgtaaattagcctatacctgggaaatgatccaaattgatggtacgtgggttggggtaaacactgccttgcccaatcgggtcatcaagcaggctttggctgataggatttttcctaacttaacgaacagctacgatacttttaagcccgaagttccctatggtaaagataaaaaaagtcgtattgactttttgctcactaagccagaagaaaagtcaatttatgtagaagtaaaaaatactaccttgtcccaagaaaaattggctttatttcccgatacggaaaccaccagagggcaaaaacatctccaggagttaatagatattctccctacagcccgggcagtgatgctttacttcatcaatcggggtgattgtacccatttttcccccggagatgcctacgatcgccgttatggagaactattccgtcaggcgatcgccgctggggtggaggtaatgccctgtcgatttatggttaatccggagggggttaaattccttggcatggcagagttagtggtttga

SEQ ID NO: 51512 - protein, 237 aa, Synechocystis sp
MDFLYPYPPLISGILVKRYKRFLADVELDNGEIVTAHCPNTGPMTGVCQVGAQVYLSKSDNPQRKLAYTWEMIQIDGTWVGVNTALPNRVIKQALADRIFPNLTNSYDTFKPEVPYGKDKKSRIDFLLTKPEEKSIYVEVKNTTLSQEKLALFPDTETTRGQKHLQELIDILPTARAVMLYFINRGDCTHFSPGDAYDRRYGELFRQAIAAGVEVMPCRFMVNPEGVKFLGMAELVV

SEQ ID NO: 51513 - DNA, 669 bp, Thermoplasma acidophilum
  CDS (1)..(669)
atgcggtttgagggtctgataggagcgagaattttgaagaggatcaacaggttcgccgtacagatcgatgtggaaggcaggacggaactggcgcatctgcacgatcctggcaggcttctggagatcgtttatcccggaaatgaggtccttgtgaggaggacggatggcccaaagctgaaatggaggattgagttcgggaagatcaacggaagatacgtgttaatagattccgggctgcactcggatatagccagaaggttccttcccgagggcgcggttccagaggtcagggttggaaggaaacgaatagatttcaggtacggggacgattacatagaggtcaaggggtgcaccctcatggcgaacggaatcgccatgtttccagacgctcctacgaagaggggcctggaacacctgaagacgctcgaaacgctcgcctcatcaggatacagatcgcatgtaatgatgataataaccagggacgacgtgagatgcttctaccccaacttcgaaaccgatcccaagttcgcagaggcgttcctgaggctggtgccggcatacgtgaaggcacacttcctgaccttcggcttcgacggcctttacctgaggtatgccggcagcatcggcctctgcgctgatgtcggtcatggcaccaacggaagattgtga

SEQ ID NO: 51514 - protein, 222 aa, Thermoplasma acidophilum
MRFEGLIGARILKRINRFAVQIDVEGRTELAHLHDPGRLLEIVYPGNEVLVRRTDGPKLKWRIEFGKINGRYVLIDSGLHSDIARRFLPEGAVPEVRVGRKRIDFRYGDDYIEVKGCTLMANGIAMFPDAPTKRGLEHLKTLETLASSGYRSHVMMIITRDDVRCFYPNFETDPKFAEAFLRLVPAYVKAHFLTFGFDGLYLRYAGSIGLCADVGHGTNGRL

SEQ ID NO: 51515 - DNA, 669 bp, Thermotoga maritima
  CDS (1)..(669): transl_table=11
atgagactgatacttccagctgatacggaagggatctttctggaaagaaagagcagatttacgggagttgctcttgtcgaagggaaaaagaccctgatacacatccacaatacagggcgccttccgcttttgaaaaaaggaaaaagagttctcctgaagcgtgcagaatccgatcgaaggaagaccggctgggaccttctggcagtcgaacacagaaatgaattcgtctttgtccattcgggtttccacagtatcgtggccgggaagattctggaagaactgttcccgggctccacgatagaaagcgagaaacgctttgaaaacagcaggttcgatttcctgatcgacaggaggacctttgtggaagtgaagggatgtacgtacgaagaagatggtgtcgcgatgtttccagacgcacccacaggacgcggaagaagacacatcgaggagctgatcaggtctgtgaaaagcggttttaaggctcttttgttgatcctggttttcctcgaaagcgactgttttcttccgaacagaagcgttgacccggctttttcagagattttctggcgcgctctaaacagcggtgttaatatcgacgtgttcagggtaaaatacgatggagagtacctgtgttcaacagagaaactgtcgatctgtgaggaggtgtag

SEQ ID NO: 51516 - protein, 222 aa, Thermotoga maritima
MRLILPADTEGIFLERKSRFTGVALVEGKKTLIHIHNTGRLPLLKKGKRVLLKRAESDRRKTGWDLLAVEHRNEFVFVHSGFHSIVAGKILEELFPGSTIESEKRFENSRFDFLIDRRTFVEVKGCTYEEDGVAMFPDAPTGRGRRHIEELIRSVKSGFKALLLILVFLESDCFLPNRSVDPAFSEIFWRALNSGVNIDVFRVKYDGEYLCSTEKLSICEEV

SEQ ID NO: 51517 - DNA, 690 bp, Thermoanaerobacter tengcongensis
  CDS (1)..(690): transl_table=11
atgattattaaaaatccgataataaaagggaaattcatagaaaggttaaatagatttgaagcctatgttgaaatagatggcattaaaaccctggttcatgtcccaaatacagggcgactgaaagagatcctcgtaaaaggggcagatgtgcttttagaagtgagagaaaaaaaggggagaaaaactccttatgagcttgcctttgcctataaagggaaaaggcttatatcaattgattctcaagtgccaaataaagtgtttctggagagcataaaaaaagggatagttgaagagtttagaggatatgaactggtggaaaaggaaaaaagctttgggaacagtaaatttgacataaaacttacaaatggaaaggaaatttgctacatagaagtgaagggtgttactttggaggtagatggagtagccaagtttcctgatgcgccgacagaaagaggtagaaagcatttaaaggagctcataaaagtcaaagaagaagggatgagagcggcagttgttttcttaattcaaatggatgacatcaaatactttactccaaatgacgaacaggaccctcaatttggacaatttttaagagaagctttcacaaaaggcgtagaagtttatgcctatacctgcgatgtgggagaaaattttattaatttaaaaaacagggtacaggtagtgctgtaa

SEQ ID NO: 51518 - protein, 229 aa, Thermoanaerobacter tengcongensis
MIIKNPIIKGKFIERLNRFEAYVEIDGIKTLVHVPNTGRLKEILVKGADVLLEVREKKGRKTPYELAFAYKGKRLISIDSQVPNKVFLESIKKGIVEEFRGYELVEKEKSFGNSKFDIKLTNGKEICYIEVKGVTLEVDGVAKFPDAPTERGRKHLKELIKVKEEGMRAAVVFLIQMDDIKYFTPNDEQDPQFGQFLREAFTKGVEVYAYTCDVGENFINLKNRVQVVL

SEQ ID NO: 51519 - DNA, 651 bp, Thermoplasma volcanium
  CDS (1)..(651)
atggaatttactgatctgttgccttgtactgttgtagaacgcgtaaacaggtttctcgtaaatgtcaaattaaacgataagatcgtagaggcgcatcttcacgatcctgggaggcttaaagaaataatatatacaggaaataaagtattagttcggagaaaaagcggtaaaaagacaggttataggattacatttggcctaagagaagatcaatatatactcattgattctgggcttcattcacaaatagctagtcacttcgtaagtcaggagtgtaaaccagaagtaaaaatagacgataggaggttggattttgcttgtaatgatatattcatagaggtaaaaggctgcacactttccattgacggagtcgcaatcttcccagatgctccaactctacgaggatacgaacaccttcgtcttttagagagattggcgcaggaagggaagggagcatacgtactttttctaatattcagtgatgctacttcatttaggccgaactcggaaactgatccacgtttttcagatgaattttacaaggctctaaagaatggtgtgaaattttcttttaaaaggttcagcttcgatggtaaatacctcaaatattctggtgatatacttacatttgatggagatgataaaagttga

SEQ ID NO: 51520 - protein, 216 aa, Thermoplasma volcanium
MEFTDLLPCTVVERVNRFLVNVKLNDKIVEAHLHDPGRLKEIIYTGNKVLVRRKSGKKTGYRITFGLREDQYILIDSGLHSQIASHFVSQECKPEVKIDDRRLDFACNDIFIEVKGCTLSIDGVAIFPDAPTLRGYEHLRLLERLAQEGKGAYVLFLIFSDATSFRPNSETDPRFSDEFYKALKNGVKFSFKRFSFDGKYLKYSGDILTFDGDDKS

SEQ ID NO: 51521 - DNA, 735 bp, Vibrio cholerae
  CDS (1)..(735)
atgcacttttccccacctctacaaaaaggaaccttactcaaacgttacaaacgctttttggccgatgtcacgctggaagatggttcggtgatcaccatgcattgtgcgaacacaggcgccatgactggctgcgccgagccgggcagtacggtgtggttttctacatcggataatcccaaacgcaaatacgcccacagttgggaactgacgcagacccaagcaggtcactggatttgcgtgaataccgcgcgagccaacgcattggtggtcgaagcgattttggcaggagagatcccacaactgcggggttatgacgcactcagtacggaggtgaagtacggtcatgaaaatagccgtatcgatatcttgctaaagtcagattctcaaccacactgctttatagaagtaaaaagcgtcactcttttggatgagattcaaggcgataaagggcaaggttactttcctgatgcggtgacaacccgtggtcagaagcatctgcgtgagctggcggaagtcgctaaagatggaagcaggtcgatacttttatttgccgttttgcattcagggattgaaaaagtcgctcccgctctccatatagacgcgaactattcacagttactaaaagcggcacaagaagccggagtggaagtgttgtgctacaaagcgtcactttcaaaacacgagatccgaatggtatctgaggtcaaatttgcccatcaagtgacaaaaaattga

SEQ ID NO: 51522 - protein, 244 aa, Vibrio cholerae
MHFSPPLQKGTLLKRYKRFLADVTLEDGSVITMHCANTGAMTGCAEPGSTVWFSTSDNPKRKYAHSWELTQTQAGHWICVNTARANALVVEAILAGEIPQLRGYDALSTEVKYGHENSRIDILLKSDSQPHCFIEVKSVTLLDEIQGDKGQGYFPDAVTTRGQKHLRELAEVAKDGSRSILLFAVLHSGIEKVAPALHIDANYSQLLKAAQEAGVEVLCYKASLSKHEIRMVSEVKFAHQVTKN

SEQ ID NO: 51523 - DNA, 717 bp, Vibrio parahaemolyticus
  CDS (1)..(717): transl_table=11
atgcaattcaaacccgctttagagtcagccactctacttaaacgctacaaacgcttccttgctgatatcgaatttgataatggtgaggtgcgcaccatccactgtgcgaacaccggtgcgatgacaggttgcgcgacacccggtaataaagtttggttttcaacgtccgacaacccaaaacgcaaataccccaacagctgggagctaagtgaaaccgagcaagggcatcgtatttgtatcaatactgcccgcgccaaccaattagccgttgaggctattgaaaataatgtcatttcagagctttgcggatatgacacacttcaaactgaagtgaaatatggcaatgaaaatagtcgaattgatatcttgctcagcgcaagcgacaagccaaagtgctatatagaagtgaaaagcgtcactcttcttgatgagacaggctcagctggacaaggatacttcccagatgccgtcacgactcgtggtcaaaagcacctgagagagctcacagaaatggcacaaaatggaagtagagccatacttttattcactgttttacattcaggtattgaaaaagtatccgcggcacaccatatagacgcgaaatattcactattactcaaacaagcacaagacgccggagtagaagttctctgctataaagccgaactgagcaatactgaaatgaagctaatttccgctattgattttatcaattaa

SEQ ID NO: 51524 - protein, 238 aa, Vibrio parahaemolyticus
MQFKPALESATLLKRYKRFLADIEFDNGEVRTIHCANTGAMTGCATPGNKVWFSTSDNPKRKYPNSWELSETEQGHRICINTARANQLAVEAIENNVISELCGYDTLQTEVKYGNENSRIDILLSASDKPKCYIEVKSVTLLDETGSAGQGYFPDAVTTRGQKHLRELTEMAQNGSRAILLFTVLHSGIEKVSAAHHIDAKYSLLLKQAQDAGVEVLCYKAELSNTEMKLISAIDFIN

SEQ ID NO: 51525 - DNA, 717 bp, Vibrio vulnificus
  CDS (1)..(717): transl_table=11
atgcatttcgaacccgcgctagattgcgccctattacaaaaacgctataaacgctttctcgccgatgtgacctatcaaagcggcgatacaggcacgattcattgtgccaataccggcgctatgactggttgcgcaacccctggtgataaagtgtggtattccacttccaacaacaccaaacgaaaatacccccacagttgggaaattacagaaacggagcagggtcatcttatctgtgtcaataccattcgcgccaaccaactcgcggtggaagccattgagcaaggctggattaaagagctctcagggtatgagcgacttcaaactgaagtgaaatatggtcatgaaaatagtcgaattgatatcttgctcagcgcaagcgaccgaccagcgtgctatatagaagtaaagagtgtcaccttgctagatgacaccgagcctggacaaggcttctttcctgatgcagtgaccacccgtggacaaaaacacctgcgagagctcacagaaatggcacaaaatggaagtagagccatacttttatttgctgttttacattcaggtattgaaaaagttgctgcggcgctccatatagacgccaaatattcccaattactcaaacaagcacaaaaagccggagttgaagtcctctgctataaagcagagatcagcaatactgaaatcaaactcaattctgctattgcgtttaacaatagctag

SEQ ID NO: 51526 - protein, 238 aa, Vibrio vulnificus
MHFEPALDCALLQKRYKRFLADVTYQSGDTGTIHCANTGAMTGCATPGDKVWYSTSNNTKRKYPHSWEITETEQGHLICVNTIRANQLAVEAIEQGWIKELSGYERLQTEVKYGHENSRIDILLSASDRPACYIEVKSVTLLDDTEPGQGFFPDAVTTRGQKHLRELTEMAQNGSRAILLFAVLHSGIEKVAAALHIDAKYSQLLKQAQKAGVEVLCYKAEISNTEIKLNSAIAFNNS

SEQ ID NO: 51527 - DNA, 717 bp, Vibrio vulnificus
  CDS (1)..(717): transl_table=11
atgcatttcgaacccgcgctagattgcgccctattacaaaaacgctataaacgctttctcgccgatgtgacctatcaaagcggcgatacaggcacgattcattgtgccaataccggcgccatgactggttgcgcaacccctggtgataaagtgtggtattccacttccaacaacaccaaacgaaaatacccccacagttgggaaattacagaaacgcagcagggtcatcttatctgtgtcaataccattcgcgccaaccagctcacggtggaagccattgagcaaggctggattaaagagctctcagggtatgagcaacttcaaactgaagtgaaatatggtcatgaaaatagtcgaattgatatcttgctcagcgcaagcgaccgaccagcatgctatatagaagtaaagagtgtcaccttgctagatgacaccgagcctggacaaggcttctttcctgatgcagtgaccacccgtggacaaaaacacctgcgagagctcacagaaatggcacaaaatggaagtagagccatacttttatttgctgttttacattcaggtattgaaaaagttgctgcggcgctccatatagacgccaaatattcccaattactcaaacaagcacaaaaagccggagttgaagtcctctgctataaagcagagatcagcaatactgaaatcaaactcaattctgctattgcgtttaacaatagctag

SEQ ID NO: 51528 - protein, 238 aa, Vibrio vulnificus
MHFEPALDCALLQKRYKRFLADVTYQSGDTGTIHCANTGAMTGCATPGDKVWYSTSNNTKRKYPHSWEITETQQGHLICVNTIRANQLTVEAIEQGWIKELSGYEQLQTEVKYGHENSRIDILLSASDRPACYIEVKSVTLLDDTEPGQGFFPDAVTTRGQKHLRELTEMAQNGSRAILLFAVLHSGIEKVAAALHIDAKYSQLLKQAQKAGVEVLCYKAEISNTEIKLNSAIAFNNS

SEQ ID NO: 51529 - DNA, 738 bp, Yersinia pestis
  CDS (1)..(738): transl_table=11
ttgctgcaatttactcccccgttacaacccgccacacttattctgcggtacaaacgctttttagctgatattgtgacgcccgctggagaggcgctgactattcattgcgcgaatactggagcaatgacgggttgtgctacgcctggagataccatctggtattcaacatcagataatccgaaacggaagtatcctcagagctgggagctgacacagacccaaaccggtgattggatttgtgtcaatacgatgcgcgccaatgagttagtgaacttggcaattgaaaaaaatcagattgctgaattatctggttacaattttgtcagaaaagaagttaagtatggcgaagagaacagccgtatagacttgttattgcaggcagaagatagacgtgactgctatattgaagtcaaatcagtcaccttattacaacaacagtgtggttattttccagatgcggttactctaaggggccagaagcatcttcgggaattacaaaacagggttgtcaacggccaccgggcagtacttttctttgcggtattgcatacgggaatcaaacaagttgcaccagcccgacacattgatcgtcgctatgcagagttgctagtccaggctcagcaggcaggagtagaggttatttgttatggttttcaactatcgcctgacggtatcgagctaaacacccgtttaccgttattactggacgaaatgctttcatcagaaaacgctgaataa

SEQ ID NO: 51530 - protein, 245 aa, Yersinia pestis
MLQFTPPLQPATLILRYKRFLADIVTPAGEALTIHCANTGAMTGCATPGDTIWYSTSDNPKRKYPQSWELTQTQTGDWICVNTMRANELVNLAIEKNQIAELSGYNFVRKEVKYGEENSRIDLLLQAEDRRDCYIEVKSVTLLQQQCGYFPDAVTLRGQKHLRELQNRVVNGHRAVLFFAVLHTGIKQVAPARHIDRRYAELLVQAQQAGVEVICYGFQLSPDGIELNTRLPLLLDEMLSSENAE

SEQ ID NO: 51531 - DNA, 738 bp, Yersinia pseudotuberculosis
  CDS (1)..(738)
atgctacaatttactcccccgttacaacccgccacacttattctgcggtacaaacgctttttagctgatattgtgacgcccgctggagaggcgctgactattcattgcgcgaatactggagcaatgacgggttgtgctacgcctggagataccatctggtattcaacatcagataatccgaaacggaagtatcctcagagctgggagctgacacagacccaaaccggtgattggatttgtgtcaatacgatgcgcgccaatgagttagtgaacttggcaattgaaaaaaatcagattgctgaattatctggttacaattttgtcagaaaagaagttaagtatggcgaagagaacagccgtatagacttgttattgcaggcagaagatagacgtgactgctatattgaagtcaaatcagtcaccttattacaacaacagtgtggttattttccagatgcggttactctaaggggccagaagcatcttcgggaattacaaaacagggttgtcaacggccaccgggcagtacttttctttgcggtattgcatacgggaatcaaacaagttgcaccagcccgacacattgatcgtcgctatgcagagttgctagtccaggctcagcaggcaggagtagaggttatttgttatggttttcaactatcgcctgacggtatcgagctaaacacccgtttaccgttattacaggacgaaatgctttcatcagaaaacgctgaataa

SEQ ID NO: 51532 - protein, 245 aa, Yersinia pseudotuberculosis
MLQFTPPLQPATLILRYKRFLADIVTPAGEALTIHCANTGAMTGCATPGDTIWYSTSDNPKRKYPQSWELTQTQTGDWICVNTMRANELVNLAIEKNQIAELSGYNFVRKEVKYGEENSRIDLLLQAEDRRDCYIEVKSVTLLQQQCGYFPDAVTLRGQKHLRELQNRVVNGHRAVLFFAVLHTGIKQVAPARHIDRRYAELLVQAQQAGVEVICYGFQLSPDGIELNTRLPLLQDEMLSSENAE

SEQ ID NO: 51533 - DNA, 24 bp, Artificial sequence
  (1)..(24): primer
atggaattttctccccctctacag

SEQ ID NO: 51534 - DNA, 24 bp, Artificial sequence
  (1)..(24): primer
ttacaatgtaaccggcagtgattt

SEQ ID NO: 51535 - protein, 261 aa, Artificial sequence
  Variant (2)..(3): xaa in position 2 to 3 is any amino acid
  Variant (5)..(6): xaa in position 5 to 6 is any amino acid
  Variant (8)..(8): xaa in position 8 is any amino acid
  Variant (10)..(11): xaa in position 10 to 11 is any amino acid
  Variant (14)..(16): xaa in position 14 to 16 is any amino acid
  Variant (18)..(22): xaa in position 18 to 22 is any amino acid
  Variant (23)..(32): xaa in position 23 to 32 is any or no amino acid
  Variant (34)..(35): xaa in position 34 to 35 is any amino acid
  Variant (39)..(39): xaa in position 39 is any amino acid
  Variant (41)..(45): xaa in position 41 to 45 is any amino acid
  Variant (46)..(46): xaa in position 46 is any or no amino acid
  Variant (48)..(49): xaa in position 48 to 49 is any amino acid
  Variant (51)..(58): xaa in position 51 to 58 is any amino acid
  Variant (59)..(60): xaa in position 59 to 60 is any or no amino acid
  Variant (63)..(76): xaa in position 63 to 76 is any amino acid
  Variant (77)..(87): xaa in position 77 to 87 is any or no amino acid
  Variant (89)..(89): xaa in position 89 is any amino acid
  Variant (91)..(93): xaa in position 91 to 93 is any amino acid
  Variant (95)..(95): xaa in position 95 is any amino acid
  Variant (97)..(100): xaa in position 97 to 100 is any amino acid
  Variant (102)..(107): xaa in position 102 to 107 is any amino acid
  Variant (108)..(124): xaa in position 108 to 124 is any or no amino acid
  Variant (126)..(128): xaa in position 126 to 128 is any amino acid
  Variant (130)..(130): xaa in position 130 is any amino acid
  Variant (131)..(133): xaa in position 131 to 133 is any or no amino acid
  Variant (138)..(139): xaa in position 138 to 139 is any amino acid
  Variant (141)..(143): xaa in position 141 to 143 is any amino acid
  Variant (144)..(155): xaa in position 144 to 155 is any or no amino acid
  Variant (161)..(162): xaa in position 161 to 162 is any amino acid
  Variant (164)..(169): xaa in position 164 to 169 is any amino acid
  Variant (170)..(174): xaa in position 170 to 174 is any or no amino acid
  Variant (176)..(176): xaa in position 176 is any amino acid
  Variant (180)..(181): xaa in position 180 to 181 is any amino acid
  Variant (183)..(183): xaa in position 183 is any amino acid
  Variant (186)..(186): xaa in position 186 is any amino acid
  Variant (190)..(190): xaa in position 190 is any amino acid
  Variant (193)..(198): xaa in position 193 to 198 is any amino acid
  Variant (200)..(200): xaa in position 200 is any amino acid
  Variant (201)..(203): xaa in position 201 to 203 is any or no amino acid
  Variant (205)..(205): xaa in position 205 is any amino acid
  Variant (207)..(207): xaa in position 207 is any amino acid
  Variant (209)..(209): xaa in position 209 is any amino acid
  Variant (211)..(224): xaa in position 211 to 224 is any amino acid
  Variant (225)..(225): xaa in position 225 is any or no amino acid
  Variant (227)..(228): xaa in position 227 to 228 is any amino acid
  Variant (230)..(235): xaa in position 230 to 235 is any amino acid
  Variant (237)..(239): xaa in position 237 to 239 is any amino acid
  Variant (242)..(251): xaa in position 242 to 251 is any amino acid
  Variant (252)..(260): xaa in position 252 to 260 is any or no amino acid
LXXAXXIXRXXRFXXXVXXXXXXXXXXXXXXXHXXNTGXMXXXXXXGXXVXXXXXXXXXXRKXXXXXXXXXXXXXXXXXXXXXXXXXVXTXXXNXLXXXXLXXXXXXXXXXXXXXXXXXXXXXXEXXXGXXXXSRIDXXLXXXXXXXXXXXXXXXYVEVKXXTXXXXXXXXXXXAXFPDXXTXRGXKHLXELXXXXXXGXXXXAXLXFXVXXXXXXXXXXXXXXXDXXYXXXXXXAXXXGVXXXXXXXXXXXXXXXXXXXI

SEQ ID NO: 51536 - protein, 35 aa, Artificial sequence
  Variant (2)..(3): xaa in position 2 to 3 is any amino acid
  Variant (4)..(4): xaa in position 4 is any or no amino acid
  Variant (7)..(13): xaa in position 7 to 13 is any amino acid
  Variant (14)..(14): xaa in position 14 is any or no amino acid
  Variant (16)..(23): xaa in position 16 to 23 is any amino acid
  Variant (24)..(24): xaa in position 24 is Asp or Asn
  Variant (25)..(25): xaa in position 25 is Pro, Ser or Thr
  Variant (27)..(29): xaa in position 27 to 29 is any amino acid
  Variant (30)..(30): xaa in position 30 is Ala, Glu, Gly, Asn, Gln, Ser or Thr
  Variant (31)..(34): xaa in position 31 to 34 is any amino acid
  Variant (35)..(35): xaa in position 35 is Asp, Glu, Gly, Asn or Gln
RXXXRFXXXXXXXXGXXXXXXXXXXGXXXXXXXXX

SEQ ID NO: 51537 - protein, 7 aa, Artificial sequence
  Variant (3)..(3): xaa in position 3 is any amino acid
  Variant (5)..(5): xaa in position 5 is any amino acid
  Variant (6)..(6): xaa in position 6 is any or no amino acid
SRXDXXL

SEQ ID NO: 51538 - protein, 5 aa, Artificial sequence
  Variant (4)..(4): xaa in position 4 is Gly, Asn or Ser
  Variant (5)..(5): xaa in position 5 is Ala, Cys, Thr or Val
EVKXX

SEQ ID NO: 51539 - protein, 16 aa, Artificial sequence
  Variant (4)..(4): xaa in position 4 is Ala, Ser or Thr
  Variant (5)..(5): xaa in position 5 is any amino acid
  Variant (6)..(6): xaa in position 6 is Ser or Thr
  Variant (7)..(7): xaa in position 7 is any amino acid
  Variant (10)..(10): xaa in position 10 is any amino acid
  Variant (11)..(11): xaa in position 11 is Lys or Arg
  Variant (13)..(13): xaa in position 13 is Ile, Leu, Met or Val
  Variant (14)..(14): xaa in position 14 is any amino acid
  Variant (16)..(16): xaa in position 16 is Leu or Met
FPDXXXXRGXXHXXEX

SEQ ID NO: 51540 - DNA, 612 bp, Escherichia coli; identical to SEQ ID NO: 15395
  CDS (1)..(612)

SEQ ID NO: 51541 - protein, 203 aa, Escherichia coli; identical to SEQ ID NO: 15396

SEQ ID NO: 51542 - DNA, 558 bp, Mesorhizobium loti MAFF303099; identical to SEQ ID NO: 15397
  CDS (1)..(558): transl_table=11

SEQ ID NO: 51543 - protein, 185 aa, Mesorhizobium loti MAFF303099; identical to SEQ ID NO: 15398

SEQ ID NO: 51544 - DNA, 591 bp, Mesorhizobium loti MAFF303099; identical to SEQ ID NO: 15399
  CDS (1)..(591): transl_table=11

SEQ ID NO: 51545 - protein, 196 aa, Mesorhizobium loti MAFF303099; identical to SEQ ID NO: 15400

SEQ ID NO: 51546 - DNA, 558 bp, Mesorhizobium loti MAFF303099; identical to SEQ ID NO: 15401
  CDS (1)..(558): transl_table=11

SEQ ID NO: 51547 - protein, 185 aa, Mesorhizobium loti MAFF303099; identical to SEQ ID NO: 15402

SEQ ID NO: 51548 - DNA, 579 bp, Vibrio cholerae O1 biovar eltor str. N16961; identical to SEQ ID NO: 15403
  CDS (1)..(579): transl_table=11

SEQ ID NO: 51549 - protein, 192 aa, Vibrio cholerae O1 biovar eltor str. N16961; identical to SEQ ID NO: 15404

SEQ ID NO: 51550 - DNA, 561 bp, Bacillus halodurans C-125; identical to SEQ ID NO: 15405
  CDS (1)..(561): transl_table=11

SEQ ID NO: 51551 - protein, 186 aa, Bacillus halodurans C-125; identical to SEQ ID NO: 15406

SEQ ID NO: 51552 - DNA, 612 bp, Pasteurella multocida subsp. multocida str. Pm70; identical to SEQ ID NO: 15407
  CDS (1)..(612): transl_table=11

SEQ ID NO: 51553 - protein, 203 aa, Pasteurella multocida subsp. multocida str. Pm70; identical to SEQ ID NO: 15408

SEQ ID NO: 51554 - DNA, 771 bp, Lactococcus lactis subsp. lactis Il1403; identical to SEQ ID NO: 15409
  CDS (1)..(771): transl_table=11

SEQ ID NO: 51555 - protein, 256 aa, Lactococcus lactis subsp. lactis Il1403; identical to SEQ ID NO: 15410

SEQ ID NO: 51556 - DNA, 612 bp, Lactococcus lactis subsp. lactis Il1403; identical to SEQ ID NO: 15411
  CDS (1)..(612): transl_table=11

SEQ ID NO: 51557 - protein, 203 aa, Lactococcus lactis subsp. lactis Il1403; identical to SEQ ID NO: 15412

SEQ ID NO: 51558 - DNA, 603 bp, Lactococcus lactis subsp. lactis Il1403; identical to SEQ ID NO: 15413
  CDS (1)..(603): transl_table=11

SEQ ID NO: 51559 - protein, 200 aa, Lactococcus lactis subsp. lactis Il1403; identical to SEQ ID NO: 15414

SEQ ID NO: 51560 - DNA, 612 bp, Lactococcus lactis subsp. lactis Il1403; identical to SEQ ID NO: 15415
  CDS (1)..(612): transl_table=11

SEQ ID NO: 51561 - protein, 203 aa, Lactococcus lactis subsp. lactis Il1403; identical to SEQ ID NO: 15416

SEQ ID NO: 51562 - DNA, 462 bp, Lactococcus lactis subsp. lactis Il1403; identical to SEQ ID NO: 15417
  CDS (1)..(462): transl_table=11

SEQ ID NO: 51563 - protein, 153 aa, Lactococcus lactis subsp. lactis Il1403; identical to SEQ ID NO: 15418

SEQ ID NO: 51564 - DNA, 567 bp, Streptococcus pyogenes M1 GAS; identical to SEQ ID NO: 15419
  CDS (1)..(567): transl_table=11

SEQ ID NO: 51565 - protein, 188 aa, Streptococcus pyogenes M1 GAS; identical to SEQ ID NO: 15420

SEQ ID NO: 51566 - DNA, 513 bp, Neisseria meningitidis Z2491; identical to SEQ ID NO: 15421
  CDS (1)..(513): transl_table=11

SEQ ID NO: 51567 - protein, 170 aa, Neisseria meningitidis Z2491; identical to SEQ ID NO: 15422

SEQ ID NO: 51568 - DNA, 549 bp, Escherichia coli O157:H7; identical to SEQ ID NO: 15423
  CDS (1)..(549): transl_table=11

SEQ ID NO: 51569 - protein, 182 aa, Escherichia coli O157:H7; identical to SEQ ID NO: 15424

SEQ ID NO: 51570 - DNA, 558 bp, Streptococcus pneumoniae TIGR4; identical to SEQ ID NO: 15425
  CDS (1)..(558): transl_table=11

SEQ ID NO: 51571 - protein, 185 aa, Streptococcus pneumoniae TIGR4; identical to SEQ ID NO: 15426

SEQ ID NO: 51572 - DNA, 561 bp, Clostridium acetobutylicum ATCC 824; identical to SEQ ID NO: 15427
  CDS (1)..(561): transl_table=11

SEQ ID NO: 51573 - protein, 186 aa, Clostridium acetobutylicum ATCC 824; identical to SEQ ID NO: 15428

SEQ ID NO: 51574 - DNA, 615 bp, Clostridium acetobutylicum ATCC 824; identical to SEQ ID NO: 15429
  CDS (1)..(615): transl_table=11

SEQ ID NO: 51575 - protein, 204 aa, Clostridium acetobutylicum ATCC 824; identical to SEQ ID NO: 15430

SEQ ID NO: 51576 - DNA, 600 bp, Staphylococcus aureus subsp. aureus Mu50; identical to SEQ ID NO: 15431
  CDS (1)..(600): transl_table=11

SEQ ID NO: 51577 - protein, 199 aa, Staphylococcus aureus subsp. aureus Mu50; identical to SEQ ID NO: 15432

SEQ ID NO: 51578 - DNA, 552 bp, Escherichia coli K12; identical to SEQ ID NO: 15433
  CDS (1)..(552): transl_table=11

SEQ ID NO: 51579 - protein, 183 aa, Escherichia coli K12; identical to SEQ ID NO: 15434

SEQ ID NO: 51580 - DNA, 615 bp, Sinorhizobium meliloti 1021; identical to SEQ ID NO: 15435
  CDS (1)..(615): transl_table=11

SEQ ID NO: 51581 - protein, 204 aa, Sinorhizobium meliloti 1021; identical to SEQ ID NO: 15436

SEQ ID NO: 51582 - DNA, 552 bp, Salmonella typhimurium LT2; identical to SEQ ID NO: 15437
  CDS (1)..(552): transl_table=11

SEQ ID NO: 51583 - protein, 183 aa, Salmonella typhimurium LT2; identical to SEQ ID NO: 15438

SEQ ID NO: 51584 - DNA, 564 bp, Listeria monocytogenes EGD-e; identical to SEQ ID NO: 15439
  CDS (1)..(564): transl_table=11

SEQ ID NO: 51585 - protein, 187 aa, Listeria monocytogenes EGD-e; identical to SEQ ID NO: 15440

SEQ ID NO: 51586 - DNA, 570 bp, Listeria innocua Clip11262; identical to SEQ ID NO: 15441
  CDS (1)..(570): transl_table=11

SEQ ID NO: 51587 - protein, 189 aa, Listeria innocua Clip11262; identical to SEQ ID NO: 15442

SEQ ID NO: 51588 - DNA, 564 bp, Listeria innocua Clip11262; identical to SEQ ID NO: 15443
  CDS (1)..(564): transl_table=11

SEQ ID NO: 51589 - protein, 187 aa, Listeria innocua Clip11262; identical to SEQ ID NO: 15444

SEQ ID NO: 51590 - DNA, 579 bp, Nostoc sp. PCC 7120; identical to SEQ ID NO: 15445
  CDS (1)..(579): transl_table=11

SEQ ID NO: 51591 - protein, 192 aa, Nostoc sp. PCC 7120; identical to SEQ ID NO: 15446

SEQ ID NO: 51592 - DNA, 828 bp, Nostoc sp. PCC 7120; identical to SEQ ID NO: 15447
  CDS (1)..(828): transl_table=11

SEQ ID NO: 51593 - protein, 275 aa, Nostoc sp. PCC 7120; identical to SEQ ID NO: 15448

SEQ ID NO: 51594 - DNA, 513 bp, Ralstonia solanacearum GMI1000; identical to SEQ ID NO: 15449
  CDS (1)..(513): transl_table=11

SEQ ID NO: 51595 - protein, 170 aa, Ralstonia solanacearum GMI1000; identical to SEQ ID NO: 15450

SEQ ID NO: 51596 - DNA, 618 bp, Agrobacterium tumefaciens str. C58; identical to SEQ ID NO: 15451
  CDS (1)..(618): transl_table=11

SEQ ID NO: 51597 - protein, 205 aa, Agrobacterium tumefaciens str. C58; identical to SEQ ID NO: 15452

SEQ ID NO: 51598 - DNA, 561 bp, Agrobacterium tumefaciens str. C58; identical to SEQ ID NO: 15453
  CDS (1)..(561): transl_table=11

SEQ ID NO: 51599 - protein, 186 aa, Agrobacterium tumefaciens str. C58; identical to SEQ ID NO: 15454

SEQ ID NO: 51600 - DNA, 633 bp, Agrobacterium tumefaciens str. C58; identical to SEQ ID NO: 15455
  CDS (1)..(633): transl_table=11

SEQ ID NO: 51601 - protein, 210 aa, Agrobacterium tumefaciens str. C58; identical to SEQ ID NO: 15456

SEQ ID NO: 51602 - DNA, 687 bp, Brucella melitensis 16M; identical to SEQ ID NO: 15457
  CDS (1)..(687): transl_table=11

SEQ ID NO: 51603 - protein, 228 aa, Brucella melitensis 16M; identical to SEQ ID NO: 15458

SEQ ID NO: 51604 - DNA, 681 bp, Pyrobaculum aerophilum str. IM2; identical to SEQ ID NO: 15459
  CDS (1)..(681): transl_table=11

SEQ ID NO: 51605 - protein, 226 aa, Pyrobaculum aerophilum str. IM2; identical to SEQ ID NO: 15460

SEQ ID NO: 51606 - DNA, 585 bp, Clostridium perfringens str. 13; identical to SEQ ID NO: 15461
  CDS (1)..(585): transl_table=11

SEQ ID NO: 51607 - protein, 194 aa, Clostridium perfringens str. 13; identical to SEQ ID NO: 15462

SEQ ID NO: 51608 - DNA, 501 bp, Pyrococcus furiosus DSM 3638; identical to SEQ ID NO: 15463
  CDS (1)..(501): transl_table=11

SEQ ID NO: 51609 - protein, 166 aa, Pyrococcus furiosus DSM 3638; identical to SEQ ID NO: 15464

SEQ ID NO: 51610 - DNA, 687 bp, Corynebacterium glutamicum ATCC 13032; identical to SEQ ID NO: 15465
  CDS (1)..(687): transl_table=11

SEQ ID NO: 51611 - protein, 228 aa, Corynebacterium glutamicum ATCC 13032; identical to SEQ ID NO: 15466

SEQ ID NO: 51612 - DNA, 576 bp, Methanosarcina acetivorans C2A; identical to SEQ ID NO: 15467
  CDS (1)..(576): transl_table=11

SEQ ID NO: 51613 - protein, 191 aa, Methanosarcina acetivorans C2A; identical to SEQ ID NO: 15468

SEQ ID NO: 51614 - DNA, 600 bp, Methanosarcina acetivorans C2A; identical to SEQ ID NO: 15469
  CDS (1)..(600): transl_table=11

SEQ ID NO: 51615 - protein, 199 aa, Methanosarcina acetivorans C2A; identical to SEQ ID NO: 15470

SEQ ID NO: 51616 - DNA, 525 bp, Methanosarcina acetivorans C2A; identical to SEQ ID NO: 15471
  CDS (1)..(525): transl_table=11

SEQ ID NO: 51617 - protein, 174 aa, Methanosarcina acetivorans C2A; identical to SEQ ID NO: 15472

SEQ ID NO: 51618 - DNA, 555 bp, Methanosarcina acetivorans C2A; identical to SEQ ID NO: 15473
  CDS (1)..(555): transl_table=11

SEQ ID NO: 51619 - protein, 184 aa, Methanosarcina acetivorans C2A; identical to SEQ ID NO: 15474

SEQ ID NO: 51620 - DNA, 663 bp, Thermoanaerobacter tengcongensis MB4; identical to SEQ ID NO: 15475
  CDS (1)..(663): transl_table=11

SEQ ID NO: 51621 - protein, 220 aa, Thermoanaerobacter tengcongensis MB4; identical to SEQ ID NO: 15476

SEQ ID NO: 51622 - DNA, 528 bp, Streptomyces coelicolor A3(2); identical to SEQ ID NO: 15477
  CDS (1)..(528)

SEQ ID NO: 51623 - protein, 175 aa, Streptomyces coelicolor A3(2); identical to SEQ ID NO: 15478

SEQ ID NO: 51624 - DNA, 804 bp, Streptomyces coelicolor A3(2); identical to SEQ ID NO: 15479
  CDS (1)..(804)

SEQ ID NO: 51625 - protein, 267 aa, Streptomyces coelicolor A3(2); identical to SEQ ID NO: 15480

SEQ ID NO: 51626 - DNA, 582 bp, Streptomyces coelicolor A3(2); identical to SEQ ID NO: 15481
  CDS (1)..(582)

SEQ ID NO: 51627 - protein, 193 aa, Streptomyces coelicolor A3(2); identical to SEQ ID NO: 15482

SEQ ID NO: 51628 - DNA, 564 bp, Methanosarcina mazei Go1; identical to SEQ ID NO: 15483
  CDS (1)..(564): transl_table=11

SEQ ID NO: 51629 - protein, 187 aa, Methanosarcina mazei Go1; identical to SEQ ID NO: 15484

SEQ ID NO: 51630 - DNA, 702 bp, Methanosarcina mazei Go1; identical to SEQ ID NO: 15485
  CDS (1)..(702): transl_table=11

SEQ ID NO: 51631 - protein, 233 aa, Methanosarcina mazei Go1; identical to SEQ ID NO: 15486

SEQ ID NO: 51632 - DNA, 579 bp, Xanthomonas campestris pv. campestris str. ATCC 33913; identical to SEQ ID NO: 15487
  CDS (1)..(579): transl_table=11

SEQ ID NO: 51633 - protein, 192 aa, Xanthomonas campestris pv. campestris str. ATCC 33913; identical to SEQ ID NO: 15488

SEQ ID NO: 51634 - DNA, 579 bp, Xanthomonas axonopodis pv. citri str. 306; identical to SEQ ID NO: 15489
  CDS (1)..(579): transl_table=11

SEQ ID NO: 51635 - protein, 192 aa, Xanthomonas axonopodis pv. citri str. 306; identical to SEQ ID NO: 15490

SEQ ID NO: 51636 - DNA, 639 bp, Streptococcus agalactiae 2603V/R; identical to SEQ ID NO: 15491
  CDS (1)..(639): transl_table=11

SEQ ID NO: 51637 - protein, 212 aa, Streptococcus agalactiae 2603V/R; identical to SEQ ID NO: 15492

SEQ ID NO: 51638 - DNA, 549 bp, Streptococcus agalactiae 2603V/R; identical to SEQ ID NO: 15493
  CDS (1)..(549): transl_table=11

SEQ ID NO: 51639 - protein, 182 aa, Streptococcus agalactiae 2603V/R; identical to SEQ ID NO: 15494

SEQ ID NO: 51640 - DNA, 540 bp, Oceanobacillus iheyensis HTE831; identical to SEQ ID NO: 15495
  CDS (1)..(540): transl_table=11

SEQ ID NO: 51641 - protein, 179 aa, Oceanobacillus iheyensis HTE831; identical to SEQ ID NO: 15496

SEQ ID NO: 51642 - DNA, 675 bp, Bifidobacterium longum NCC2705; identical to SEQ ID NO: 15497
  CDS (1)..(675): transl_table=11

SEQ ID NO: 51643 - protein, 224 aa, Bifidobacterium longum NCC2705; identical to SEQ ID NO: 15498

SEQ ID NO: 51644 - DNA, 678 bp, Bifidobacterium longum NCC2705; identical to SEQ ID NO: 15499
  CDS (1)..(678): transl_table=11

SEQ ID NO: 51645 - protein, 225 aa, Bifidobacterium longum NCC2705; identical to SEQ ID NO: 15500

SEQ ID NO: 51646 - DNA, 597 bp, Leptospira interrogans serovar Lai str. 56601; identical to SEQ ID NO: 15501
  CDS (1)..(597): transl_table=11

SEQ ID NO: 51647 - protein, 198 aa, Leptospira interrogans serovar Lai str. 56601; identical to SEQ ID NO: 15502

SEQ ID NO: 51648 - DNA, 579 bp, Shewanella oneidensis MR-1; identical to SEQ ID NO: 15503
  CDS (1)..(579): transl_table=11

SEQ ID NO: 51649 - protein, 192 aa, Shewanella oneidensis MR-1; identical to SEQ ID NO: 15504

SEQ ID NO: 51650 - DNA, 630 bp, Shewanella oneidensis MR-1; identical to SEQ ID NO: 15505
  CDS (1)..(630): transl_table=11

SEQ ID NO: 51651 - protein, 209 aa, Shewanella oneidensis MR-1; identical to SEQ ID NO: 15506

SEQ ID NO: 51652 - DNA, 699 bp, Streptococcus mutans UA159; identical to SEQ ID NO: 15507
  CDS (1)..(699): transl_table=11

SEQ ID NO: 51653 - protein, 232 aa, Streptococcus mutans UA159; identical to SEQ ID NO: 15508

SEQ ID NO: 51654 - DNA, 648 bp, Streptomyces coelicolor A3(2); identical to SEQ ID NO: 15509
  CDS (1)..(648)

SEQ ID NO: 51655 - protein, 215 aa, Streptomyces coelicolor A3(2); identical to SEQ ID NO: 15510

SEQ ID NO: 51656 - DNA, 567 bp, Pseudomonas putida KT2440; identical to SEQ ID NO: 15511
  CDS (1)..(567): transl_table=11

SEQ ID NO: 51657 - protein, 188 aa, Pseudomonas putida KT2440; identical to SEQ ID NO: 15512

SEQ ID NO: 51658 - DNA, 552 bp, Escherichia coli CFT073; identical to SEQ ID NO: 15513
  CDS (1)..(552): transl_table=11

SEQ ID NO: 51659 - protein, 183 aa, Escherichia coli CFT073; identical to SEQ ID NO: 15514

SEQ ID NO: 51660 - DNA, 549 bp, Escherichia coli CFT073; identical to SEQ ID NO: 15515
  CDS (1)..(549): transl_table=11

SEQ ID NO: 51661 - protein, 182 aa, Escherichia coli CFT073; identical to SEQ ID NO: 15516

SEQ ID NO: 51662 - DNA, 588 bp, Mycoplasma penetrans HF-2; identical to SEQ ID NO: 15517
  CDS (1)..(588): transl_table=4

SEQ ID NO: 51663 - protein, 195 aa, Mycoplasma penetrans HF-2; identical to SEQ ID NO: 15518

SEQ ID NO: 51664 - DNA, 771 bp, Vibrio vulnificus CMCP6; identical to SEQ ID NO: 15519
  CDS (1)..(771): transl_table=11

SEQ ID NO: 51665 - protein, 256 aa, Vibrio vulnificus CMCP6; identical to SEQ ID NO: 15520

SEQ ID NO: 51666 - DNA, 594 bp, Vibrio vulnificus CMCP6; identical to SEQ ID NO: 15521
  CDS (1)..(594): transl_table=11

SEQ ID NO: 51667 - protein, 197 aa, Vibrio vulnificus CMCP6; identical to SEQ ID NO: 15522

SEQ ID NO: 51668 - DNA, 549 bp, Vibrio vulnificus CMCP6; identical to SEQ ID NO: 15523
  CDS (1)..(549): transl_table=11

SEQ ID NO: 51669 - protein, 182 aa, Vibrio vulnificus CMCP6; identical to SEQ ID NO: 15524

SEQ ID NO: 51670 - DNA, 621 bp, Bradyrhizobium japonicum USDA 110; identical to SEQ ID NO: 15525
  CDS (1)..(621)

SEQ ID NO: 51671 - protein, 206 aa, Bradyrhizobium japonicum USDA 110; identical to SEQ ID NO: 15526

SEQ ID NO: 51672 - DNA, 564 bp, Clostridium tetani E88; identical to SEQ ID NO: 15527
  CDS (1)..(564): transl_table=11

SEQ ID NO: 51673 - protein, 187 aa, Clostridium tetani E88; identical to SEQ ID NO: 15528

SEQ ID NO: 51674 - DNA, 618 bp, Lactobacillus plantarum WCFS1; identical to SEQ ID NO: 15529
  CDS (1)..(618): transl_table=11

SEQ ID NO: 51675 - protein, 205 aa, Lactobacillus plantarum WCFS1; identical to SEQ ID NO: 15530

SEQ ID NO: 51676 - DNA, 609 bp, Lactobacillus plantarum WCFS1; identical to SEQ ID NO: 15531
  CDS (1)..(609): transl_table=11

SEQ ID NO: 51677 - protein, 202 aa, Lactobacillus plantarum WCFS1; identical to SEQ ID NO: 15532

SEQ ID NO: 51678 - DNA, 555 bp, Lactobacillus plantarum WCFS1; identical to SEQ ID NO: 15533
  CDS (1)..(555): transl_table=11

SEQ ID NO: 51679 - protein, 184 aa, Lactobacillus plantarum WCFS1; identical to SEQ ID NO: 15534

SEQ ID NO: 51680 - DNA, 603 bp, Lactobacillus plantarum WCFS1; identical to SEQ ID NO: 15535
  CDS (1)..(603): transl_table=11

SEQ ID NO: 51681 - protein, 200 aa, Lactobacillus plantarum WCFS1; identical to SEQ ID NO: 15536

SEQ ID NO: 51682 - DNA, 621 bp, Lactobacillus plantarum WCFS1; identical to SEQ ID NO: 15537
  CDS (1)..(621): transl_table=11

SEQ ID NO: 51683 - protein, 206 aa, Lactobacillus plantarum WCFS1; identical to SEQ ID NO: 15538

SEQ ID NO: 51684 - DNA, 570 bp, Lactobacillus plantarum WCFS1; identical to SEQ ID NO: 15539
  CDS (1)..(570): transl_table=11

SEQ ID NO: 51685 - protein, 189 aa, Lactobacillus plantarum WCFS1; identical to SEQ ID NO: 15540

SEQ ID NO: 51686 - DNA, 561 bp, Lactobacillus plantarum WCFS1; identical to SEQ ID NO: 15541
  CDS (1)..(561): transl_table=11

SEQ ID NO: 51687 - protein, 186 aa, Lactobacillus plantarum WCFS1; identical to SEQ ID NO: 15542

SEQ ID NO: 51688 - DNA, 555 bp, Vibrio parahaemolyticus RIMD 2210633; identical to SEQ ID NO: 15543
  CDS (1)..(555): transl_table=11

SEQ ID NO: 51689 - protein, 184 aa, Vibrio parahaemolyticus RIMD 2210633; identical to SEQ ID NO: 15544

SEQ ID NO: 51690 - DNA, 549 bp, Vibrio parahaemolyticus RIMD 2210633; identical to SEQ ID NO: 15545
  CDS (1)..(549): transl_table=11

SEQ ID NO: 51691 - protein, 182 aa, Vibrio parahaemolyticus RIMD 2210633; identical to SEQ ID NO: 15546

SEQ ID NO: 51692 - DNA, 552 bp, Salmonella enterica subsp. enterica serovar Typhi Ty2; identical to SEQ ID NO: 15547
  CDS (1)..(552): transl_table=11

SEQ ID NO: 51693 - protein, 183 aa, Salmonella enterica subsp. enterica serovar Typhi Ty2; identical to SEQ ID NO: 15548

SEQ ID NO: 51694 - DNA, 759 bp, Bacteroides thetaiotaomicron VPI-5482; identical to SEQ ID NO: 15549
  CDS (1)..(759): transl_table=11

SEQ ID NO: 51695 - protein, 252 aa, Bacteroides thetaiotaomicron VPI-5482; identical to SEQ ID NO: 15550

SEQ ID NO: 51696 - DNA, 624 bp, Bacteroides thetaiotaomicron VPI-5482; identical to SEQ ID NO: 15551
  CDS (1)..(624): transl_table=11

SEQ ID NO: 51697 - protein, 207 aa, Bacteroides thetaiotaomicron VPI-5482; identical to SEQ ID NO: 15552

SEQ ID NO: 51698 - DNA, 564 bp, Bacteroides thetaiotaomicron VPI-5482; identical to SEQ ID NO: 15553
  CDS (1)..(564): transl_table=11

SEQ ID NO: 51699 - protein, 187 aa, Bacteroides thetaiotaomicron VPI-5482; identical to SEQ ID NO: 15554

SEQ ID NO: 51700 - DNA, 606 bp, Bacteroides thetaiotaomicron VPI-5482; identical to SEQ ID NO: 15555
  CDS (1)..(606): transl_table=11

SEQ ID NO: 51701 - protein, 201 aa, Bacteroides thetaiotaomicron VPI-5482; identical to SEQ ID NO: 15556

SEQ ID NO: 51702 - DNA, 552 bp, Bacteroides thetaiotaomicron VPI-5482; identical to SEQ ID NO: 15557
  CDS (1)..(552): transl_table=11

SEQ ID NO: 51703 - protein, 183 aa, Bacteroides thetaiotaomicron VPI-5482; identical to SEQ ID NO: 15558

SEQ ID NO: 51704 - DNA, 846 bp, Enterococcus faecalis V583; identical to SEQ ID NO: 15559
  CDS (1)..(846): transl_table=11

SEQ ID NO: 51705 - protein, 281 aa, Enterococcus faecalis V583; identical to SEQ ID NO: 15560

SEQ ID NO: 51706 - DNA, 639 bp, Enterococcus faecalis V583; identical to SEQ ID NO: 15561
  CDS (1)..(639): transl_table=11

SEQ ID NO: 51707 - protein, 212 aa, Enterococcus faecalis V583; identical to SEQ ID NO: 15562

SEQ ID NO: 51708 - DNA, 582 bp, Enterococcus faecalis V583; identical to SEQ ID NO: 15563
  CDS (1)..(582): transl_table=11

SEQ ID NO: 51709 - protein, 193 aa, Enterococcus faecalis V583; identical to SEQ ID NO: 15564

SEQ ID NO: 51710 - DNA, 723 bp, Bacillus cereus ATCC 14579; identical to SEQ ID NO: 15565
  CDS (1)..(723): transl_table=11

SEQ ID NO: 51711 - protein, 240 aa, Bacillus cereus ATCC 14579; identical to SEQ ID NO: 15566

SEQ ID NO: 51712 - DNA, 561 bp, Bacillus cereus ATCC 14579; identical to SEQ ID NO: 15567
  CDS (1)..(561): transl_table=11

SEQ ID NO: 51713 - protein, 186 aa, Bacillus cereus ATCC 14579; identical to SEQ ID NO: 15568

SEQ ID NO: 51714 - DNA, 666 bp, Bacillus anthracis str. Ames; identical to SEQ ID NO: 15569
  CDS (1)..(666): transl_table=11

SEQ ID NO: 51715 - protein, 221 aa, Bacillus anthracis str. Ames; identical to SEQ ID NO: 15570

SEQ ID NO: 51716 - DNA, 564 bp, Bacillus anthracis str. Ames; identical to SEQ ID NO: 15571
  CDS (1)..(564): transl_table=11

SEQ ID NO: 51717 - protein, 187 aa, Bacillus anthracis str. Ames; identical to SEQ ID NO: 15572

SEQ ID NO: 51718 - DNA, 723 bp, Bacillus anthracis str. Ames; identical to SEQ ID NO: 15573
  CDS (1)..(723): transl_table=11

SEQ ID NO: 51719 - protein, 240 aa, Bacillus anthracis str. Ames; identical to SEQ ID NO: 15574

SEQ ID NO: 51720 - DNA, 618 bp, Helicobacter hepaticus ATCC 51449; identical to SEQ ID NO: 15575
  CDS (1)..(618): transl_table=11

SEQ ID NO: 51721 - protein, 205 aa, Helicobacter hepaticus ATCC 51449; identical to SEQ ID NO: 15576

SEQ ID NO: 51722 - DNA, 555 bp, Rhodopirellula baltica SH 1; identical to SEQ ID NO: 15577
  CDS (1)..(555): transl_table=11

SEQ ID NO: 51723 - protein, 184 aa, Rhodopirellula baltica SH 1; identical to SEQ ID NO: 15578

SEQ ID NO: 51724 - DNA, 522 bp, Chromobacterium violaceum ATCC 12472; identical to SEQ ID NO: 15579
  CDS (1)..(522): transl_table=11

SEQ ID NO: 51725 - protein, 173 aa, Chromobacterium violaceum ATCC 12472; identical to SEQ ID NO: 15580

SEQ ID NO: 51726 - DNA, 561 bp, Gloeobacter violaceus PCC 7421; identical to SEQ ID NO: 15581
  CDS (1)..(561): transl_table=11

SEQ ID NO: 51727 - protein, 186 aa, Gloeobacter violaceus PCC 7421; identical to SEQ ID NO: 15582

SEQ ID NO: 51728 - DNA, 771 bp, Vibrio vulnificus YJ016; identical to SEQ ID NO: 15583
  CDS (1)..(771): transl_table=11

SEQ ID NO: 51729 - protein, 256 aa, Vibrio vulnificus YJ016; identical to SEQ ID NO: 15584

SEQ ID NO: 51730 - DNA, 558 bp, Vibrio vulnificus YJ016; identical to SEQ ID NO: 15585
  CDS (1)..(558): transl_table=11

SEQ ID NO: 51731 - protein, 185 aa, Vibrio vulnificus YJ016; identical to SEQ ID NO: 15586

SEQ ID NO: 51732 - DNA, 657 bp, Vibrio vulnificus YJ016; identical to SEQ ID NO: 15587
  CDS (1)..(657): transl_table=11

SEQ ID NO: 51733 - protein, 218 aa, Vibrio vulnificus YJ016; identical to SEQ ID NO: 15588

SEQ ID NO: 51734 - DNA, 621 bp, Vibrio vulnificus YJ016; identical to SEQ ID NO: 15589
  CDS (1)..(621): transl_table=11

SEQ ID NO: 51735 - protein, 206 aa, Vibrio vulnificus YJ016; identical to SEQ ID NO: 15590

SEQ ID NO: 51736 - DNA, 570 bp, Corynebacterium diphtheriae NCTC 13129; identical to SEQ ID NO: 15591
  CDS (1)..(570): transl_table=11

SEQ ID NO: 51737 - protein, 189 aa, Corynebacterium diphtheriae NCTC 13129; identical to SEQ ID NO: 15592

SEQ ID NO: 51738 - DNA, 573 bp, Rhodopseudomonas palustris CGA009; identical to SEQ ID NO: 15593
  CDS (1)..(573): transl_table=11

SEQ ID NO: 51739 - protein, 190 aa, Rhodopseudomonas palustris CGA009; identical to SEQ ID NO: 15594

SEQ ID NO: 51740 - DNA, 615 bp, Lactobacillus johnsonii NCC 533; identical to SEQ ID NO: 15595
  CDS (1)..(615): transl_table=11

SEQ ID NO: 51741 - protein, 204 aa, Lactobacillus johnsonii NCC 533; identical to SEQ ID NO: 15596

SEQ ID NO: 51742 - DNA, 564 bp, Bacillus cereus ATCC 10987; identical to SEQ ID NO: 15597
  CDS (1)..(564): transl_table=11

SEQ ID NO: 51743 - protein, 187 aa, Bacillus cereus ATCC 10987; identical to SEQ ID NO: 15598

SEQ ID NO: 51744 - DNA, 2154 bp, Neurospora crassa; identical to SEQ ID NO: 15599
  CDS (1)..(2154)

SEQ ID NO: 51745 - protein, 717 aa, Neurospora crassa; identical to SEQ ID NO: 15600

SEQ ID NO: 51746 - DNA, 660 bp, Magnaporthe grisea 70-15; identical to SEQ ID NO: 15601
  CDS (1)..(660)

SEQ ID NO: 51747 - protein, 219 aa, Magnaporthe grisea 70-15; identical to SEQ ID NO: 15602

SEQ ID NO: 51748 - DNA, 699 bp, Gibberella zeae PH-1; identical to SEQ ID NO: 15603
  CDS (1)..(699)

SEQ ID NO: 51749 - protein, 232 aa, Gibberella zeae PH-1; identical to SEQ ID NO: 15604

SEQ ID NO: 51750 - DNA, 699 bp, Gibberella zeae PH-1; identical to SEQ ID NO: 15605
  CDS (1)..(699)

SEQ ID NO: 51751 - protein, 232 aa, Gibberella zeae PH-1; identical to SEQ ID NO: 15606

SEQ ID NO: 51752 - DNA, 690 bp, Ustilago maydis 521; identical to SEQ ID NO: 15607
  CDS (1)..(690)

SEQ ID NO: 51753 - protein, 229 aa, Ustilago maydis 521; identical to SEQ ID NO: 15608

SEQ ID NO: 51754 - DNA, 702 bp, Aspergillus nidulans FGSC A4; identical to SEQ ID NO: 15609
  CDS (1)..(702)

SEQ ID NO: 51755 - protein, 233 aa, Aspergillus nidulans FGSC A4; identical to SEQ ID NO: 15610

SEQ ID NO: 51756 - DNA, 618 bp, Aspergillus nidulans FGSC A4; identical to SEQ ID NO: 15611
  CDS (1)..(618)

SEQ ID NO: 51757 - protein, 205 aa, Aspergillus nidulans FGSC A4; identical to SEQ ID NO: 15612

SEQ ID NO: 51758 - DNA, 573 bp, Candida glabrata CBS138; identical to SEQ ID NO: 15613
  CDS (1)..(573)

SEQ ID NO: 51759 - protein, 190 aa, Candida glabrata CBS138; identical to SEQ ID NO: 15614

SEQ ID NO: 51760 - DNA, 570 bp, Kluyveromyces lactis NRRL Y-1140; identical to SEQ ID NO: 15615
  CDS (1)..(570)

SEQ ID NO: 51761 - protein, 189 aa, Kluyveromyces lactis NRRL Y-1140; identical to SEQ ID NO: 15616

SEQ ID NO: 51762 - DNA, 693 bp, Debaryomyces hansenii CBS767; identical to SEQ ID NO: 15617
  CDS (1)..(693)

SEQ ID NO: 51763 - protein, 230 aa, Debaryomyces hansenii CBS767; identical to SEQ ID NO: 15618

SEQ ID NO: 51764 - DNA, 690 bp, Debaryomyces hansenii CBS767; identical to SEQ ID NO: 15619
  CDS (1)..(690)

SEQ ID NO: 51765 - protein, 229 aa, Debaryomyces hansenii CBS767; identical to SEQ ID NO: 15620

SEQ ID NO: 51766 - DNA, 666 bp, Yarrowia lipolytica CLIB99; identical to SEQ ID NO: 15621
  CDS (1)..(666)

SEQ ID NO: 51767 - protein, 221 aa, Yarrowia lipolytica CLIB99; identical to SEQ ID NO: 15622

SEQ ID NO: 51768 - DNA, 840 bp, Yarrowia lipolytica CLIB99; identical to SEQ ID NO: 15623
  CDS (1)..(840)

SEQ ID NO: 51769 - protein, 279 aa, Yarrowia lipolytica CLIB99; identical to SEQ ID NO: 15624

SEQ ID NO: 51770 - DNA, 642 bp, Cryptococcus neoformans var. neoformans JEC21; identical to SEQ ID NO: 15625
  CDS (1)..(642)

SEQ ID NO: 51771 - protein, 213 aa, Cryptococcus neoformans var. neoformans JEC21; identical to SEQ ID NO: 15626

SEQ ID NO: 51772 - DNA, 546 bp, Dictyostelium discoideum; identical to SEQ ID NO: 15627
  CDS (1)..(546)

SEQ ID NO: 51773 - protein, 181 aa, Dictyostelium discoideum; identical to SEQ ID NO: 15628

SEQ ID NO: 51774 - DNA, 576 bp, Dictyostelium discoideum; identical to SEQ ID NO: 15629
  CDS (1)..(576)

SEQ ID NO: 51775 - protein, 191 aa, Dictyostelium discoideum; identical to SEQ ID NO: 15630

SEQ ID NO: 51776 - DNA, 591 bp, Dictyostelium discoideum; identical to SEQ ID NO: 15631
  CDS (1)..(591)

SEQ ID NO: 51777 - protein, 196 aa, Dictyostelium discoideum; identical to SEQ ID NO: 15632

SEQ ID NO: 51778 - DNA, 573 bp, Dictyostelium discoideum; identical to SEQ ID NO: 15633
  CDS (1)..(573)

SEQ ID NO: 51779 - protein, 190 aa, Dictyostelium discoideum; identical to SEQ ID NO: 15634

SEQ ID NO: 51780 - DNA, 459 bp, Entamoeba histolytica HM-1:IMSS; identical to SEQ ID NO: 15635
  CDS (1)..(459)

SEQ ID NO: 51781 - protein, 152 aa, Entamoeba histolytica HM-1:IMSS; identical to SEQ ID NO: 15636

SEQ ID NO: 51782 - DNA, 609 bp, Entamoeba histolytica HM-1:IMSS; identical to SEQ ID NO: 15637
  CDS (1)..(609)

SEQ ID NO: 51783 - protein, 202 aa, Entamoeba histolytica HM-1:IMSS; identical to SEQ ID NO: 15638

SEQ ID NO: 51784 - DNA, 609 bp, Entamoeba histolytica HM-1:IMSS; identical to SEQ ID NO: 15639
  CDS (1)..(609)

SEQ ID NO: 51785 - protein, 202 aa, Entamoeba histolytica HM-1:IMSS; identical to SEQ ID NO: 15640

SEQ ID NO: 51786 - DNA, 549 bp, Entamoeba histolytica HM-1:IMSS; identical to SEQ ID NO: 15641
  CDS (1)..(549)

SEQ ID NO: 51787 - protein, 182 aa, Entamoeba histolytica HM-1:IMSS; identical to SEQ ID NO: 15642

SEQ ID NO: 51788 - DNA, 612 bp, Entamoeba histolytica HM-1:IMSS; identical to SEQ ID NO: 15643
  CDS (1)..(612)

SEQ ID NO: 51789 - protein, 203 aa, Entamoeba histolytica HM-1:IMSS; identical to SEQ ID NO: 15644

SEQ ID NO: 51790 - DNA, 615 bp, Entamoeba histolytica HM-1:IMSS; identical to SEQ ID NO: 15645
  CDS (1)..(615)

SEQ ID NO: 51791 - protein, 204 aa, Entamoeba histolytica HM-1:IMSS; identical to SEQ ID NO: 15646

SEQ ID NO: 51792 - DNA, 924 bp, Candida albicans SC5314; identical to SEQ ID NO: 15647
  CDS (1)..(924): transl_table=12

SEQ ID NO: 51793 - protein, 307 aa, Candida albicans SC5314; identical to SEQ ID NO: 15648

SEQ ID NO: 51794 - DNA, 888 bp, Thermus thermophilus HB27; identical to SEQ ID NO: 15649
  CDS (1)..(888): transl_table=11

SEQ ID NO: 51795 - protein, 295 aa, Thermus thermophilus HB27; identical to SEQ ID NO: 15650

SEQ ID NO: 51796 - DNA, 594 bp, Desulfovibrio vulgaris subsp. vulgaris str. Hildenborough; identical to SEQ ID NO: 15651
  CDS (1)..(594): transl_table=11

SEQ ID NO: 51797 - protein, 197 aa, Desulfovibrio vulgaris subsp. vulgaris str. Hildenborough; identical to SEQ ID NO: 15652

SEQ ID NO: 51798 - DNA, 570 bp, Listeria monocytogenes str. 4b F2365; identical to SEQ ID NO: 15653
  CDS (1)..(570): transl_table=11

SEQ ID NO: 51799 - protein, 189 aa, Listeria monocytogenes str. 4b F2365; identical to SEQ ID NO: 15654

SEQ ID NO: 51800 - DNA, 564 bp, Listeria monocytogenes str. 4b F2365; identical to SEQ ID NO: 15655
  CDS (1)..(564): transl_table=11

SEQ ID NO: 51801 - protein, 187 aa, Listeria monocytogenes str. 4b F2365; identical to SEQ ID NO: 15656

SEQ ID NO: 51802 - DNA, 564 bp, Bacillus thuringiensis serovar konkukian str. 97-27; identical to SEQ ID NO: 15657
  CDS (1)..(564): transl_table=11

SEQ ID NO: 51803 - protein, 187 aa, Bacillus thuringiensis serovar konkukian str. 97-27; identical to SEQ ID NO: 15658

SEQ ID NO: 51804 - DNA, 486 bp, Staphylococcus aureus subsp. aureus MRSA252; identical to SEQ ID NO: 15659
  CDS (1)..(486): transl_table=11

SEQ ID NO: 51805 - protein, 161 aa, Staphylococcus aureus subsp. aureus MRSA252; identical to SEQ ID NO: 15660

SEQ ID NO: 51806 - DNA, 600 bp, Staphylococcus aureus subsp. aureus MRSA252; identical to SEQ ID NO: 15661
  CDS (1)..(600): transl_table=11

SEQ ID NO: 51807 - protein, 199 aa, Staphylococcus aureus subsp. aureus MRSA252; identical to SEQ ID NO: 15662

SEQ ID NO: 51808 - DNA, 627 bp, Erwinia carotovora subsp. atroseptica SCRI1043; identical to SEQ ID NO: 15663
  CDS (1)..(627)

SEQ ID NO: 51809 - protein, 208 aa, Erwinia carotovora subsp. atroseptica SCRI1043; identical to SEQ ID NO: 15664

SEQ ID NO: 51810 - DNA, 573 bp, Propionibacterium acnes KPA171202; identical to SEQ ID NO: 15665
  CDS (1)..(573): transl_table=11

SEQ ID NO: 51811 - protein, 190 aa, Propionibacterium acnes KPA171202; identical to SEQ ID NO: 15666

SEQ ID NO: 51812 - DNA, 510 bp, Desulfotalea psychrophila LSv54; identical to SEQ ID NO: 15667
  CDS (1)..(510): transl_table=11

SEQ ID NO: 51813 - protein, 169 aa, Desulfotalea psychrophila LSv54; identical to SEQ ID NO: 15668

SEQ ID NO: 51814 - DNA, 579 bp, Bacillus licheniformis ATCC 14580; identical to SEQ ID NO: 15669
  CDS (1)..(579): transl_table=11

SEQ ID NO: 51815 - protein, 192 aa, Bacillus licheniformis ATCC 14580; identical to SEQ ID NO: 15670

SEQ ID NO: 51816 - DNA, 564 bp, Bacillus cereus E33L; identical to SEQ ID NO: 15671
  CDS (1)..(564): transl_table=11

SEQ ID NO: 51817 - protein, 187 aa, Bacillus cereus E33L; identical to SEQ ID NO: 15672

SEQ ID NO: 51818 - DNA, 603 bp, Mannheimia succiniciproducens MBEL55E; identical to SEQ ID NO: 15673
  CDS (1)..(603): transl_table=11

SEQ ID NO: 51819 - protein, 200 aa, Mannheimia succiniciproducens MBEL55E; identical to SEQ ID NO: 15674

SEQ ID NO: 51820 - DNA, 597 bp, Mannheimia succiniciproducens MBEL55E; identical to SEQ ID NO: 15675
  CDS (1)..(597): transl_table=11

SEQ ID NO: 51821 - protein, 198 aa, Mannheimia succiniciproducens MBEL55E; identical to SEQ ID NO: 15676

SEQ ID NO: 51822 - DNA, 606 bp, Bacteroides fragilis YCH46; identical to SEQ ID NO: 15677
  CDS (1)..(606): transl_table=11

SEQ ID NO: 51823 - protein, 201 aa, Bacteroides fragilis YCH46; identical to SEQ ID NO: 15678

SEQ ID NO: 51824 - DNA, 630 bp, Bacteroides fragilis YCH46; identical to SEQ ID NO: 15679
  CDS (1)..(630): transl_table=11

SEQ ID NO: 51825 - protein, 209 aa, Bacteroides fragilis YCH46; identical to SEQ ID NO: 15680

SEQ ID NO: 51826 - DNA, 627 bp, Bacteroides fragilis YCH46; identical to SEQ ID NO: 15681
  CDS (1)..(627): transl_table=11

SEQ ID NO: 51827 - protein, 208 aa, Bacteroides fragilis YCH46; identical to SEQ ID NO: 15682

SEQ ID NO: 51828 - DNA, 591 bp, Methylococcus capsulatus str. Bath; identical to SEQ ID NO: 15683
  CDS (1)..(591): transl_table=11

SEQ ID NO: 51829 - protein, 196 aa, Methylococcus capsulatus str. Bath; identical to SEQ ID NO: 15684

SEQ ID NO: 51830 - DNA, 648 bp, Photobacterium profundum SS9; identical to SEQ ID NO: 15685
  CDS (1)..(648): transl_table=11

SEQ ID NO: 51831 - protein, 215 aa, Photobacterium profundum SS9; identical to SEQ ID NO: 15686

SEQ ID NO: 51832 - DNA, 549 bp, Photobacterium profundum SS9; identical to SEQ ID NO: 15687
  CDS (1)..(549): transl_table=11

SEQ ID NO: 51833 - protein, 182 aa, Photobacterium profundum SS9; identical to SEQ ID NO: 15688

SEQ ID NO: 51834 - DNA, 564 bp, Photobacterium profundum SS9; identical to SEQ ID NO: 15689
  CDS (1)..(564): transl_table=11

SEQ ID NO: 51835 - protein, 187 aa, Photobacterium profundum SS9; identical to SEQ ID NO: 15690

SEQ ID NO: 51836 - DNA, 561 bp, Haloarcula marismortui ATCC 43049; identical to SEQ ID NO: 15691
  CDS (1)..(561): transl_table=11

SEQ ID NO: 51837 - protein, 186 aa, Haloarcula marismortui ATCC 43049; identical to SEQ ID NO: 15692

SEQ ID NO: 51838 - DNA, 675 bp, Geobacillus kaustophilus HTA426; identical to SEQ ID NO: 15693
  CDS (1)..(675): transl_table=11

SEQ ID NO: 51839 - protein, 224 aa, Geobacillus kaustophilus HTA426; identical to SEQ ID NO: 15694

SEQ ID NO: 51840 - DNA, 558 bp, Geobacillus kaustophilus HTA426; identical to SEQ ID NO: 15695
  CDS (1)..(558): transl_table=11

SEQ ID NO: 51841 - protein, 185 aa, Geobacillus kaustophilus HTA426; identical to SEQ ID NO: 15696

SEQ ID NO: 51842 - DNA, 552 bp, Azoarcus sp. EbN1; identical to SEQ ID NO: 15697
  CDS (1)..(552): transl_table=11

SEQ ID NO: 51843 - protein, 183 aa, Azoarcus sp. EbN1; identical to SEQ ID NO: 15698

SEQ ID NO: 51844 - DNA, 600 bp, Zymomonas mobilis subsp. mobilis ZM4; identical to SEQ ID NO: 15699
  CDS (1)..(600): transl_table=11

SEQ ID NO: 51845 - protein, 199 aa, Zymomonas mobilis subsp. mobilis ZM4; identical to SEQ ID NO: 15700

SEQ ID NO: 51846 - DNA, 693 bp, Dehalococcoides ethenogenes 195; identical to SEQ ID NO: 15701
  CDS (1)..(693): transl_table=11

SEQ ID NO: 51847 - protein, 230 aa, Dehalococcoides ethenogenes 195; identical to SEQ ID NO: 15702

SEQ ID NO: 51848 - DNA, 486 bp, Staphylococcus aureus subsp. aureus COL; identical to SEQ ID NO: 15703
  CDS (1)..(486): transl_table=11

SEQ ID NO: 51849 - protein, 161 aa, Staphylococcus aureus subsp. aureus COL; identical to SEQ ID NO: 15704

SEQ ID NO: 51850 - DNA, 600 bp, Staphylococcus aureus subsp. aureus COL; identical to SEQ ID NO: 15705
  CDS (1)..(600): transl_table=11

SEQ ID NO: 51851 - protein, 199 aa, Staphylococcus aureus subsp. aureus COL; identical to SEQ ID NO: 15706

SEQ ID NO: 51852 - DNA, 615 bp, Lactobacillus acidophilus NCFM; identical to SEQ ID NO: 15707
  CDS (1)..(615): transl_table=11

SEQ ID NO: 51853 - protein, 204 aa, Lactobacillus acidophilus NCFM; identical to SEQ ID NO: 15708

SEQ ID NO: 51854 - DNA, 600 bp, Vibrio fischeri ES114; identical to SEQ ID NO: 15709
  CDS (1)..(600): transl_table=11

SEQ ID NO: 51855 - protein, 199 aa, Vibrio fischeri ES114; identical to SEQ ID NO: 15710

SEQ ID NO: 51856 - DNA, 546 bp, Vibrio fischeri ES114; identical to SEQ ID NO: 15711
  CDS (1)..(546): transl_table=11

SEQ ID NO: 51857 - protein, 181 aa, Vibrio fischeri ES114; identical to SEQ ID NO: 15712

SEQ ID NO: 51858 - DNA, 552 bp, Vibrio fischeri ES114; identical to SEQ ID NO: 15713
  CDS (1)..(552): transl_table=11

SEQ ID NO: 51859 - protein, 183 aa, Vibrio fischeri ES114; identical to SEQ ID NO: 15714

SEQ ID NO: 51860 - DNA, 756 bp, Vibrio fischeri ES114; identical to SEQ ID NO: 15715
  CDS (1)..(756): transl_table=11

SEQ ID NO: 51861 - protein, 251 aa, Vibrio fischeri ES114; identical to SEQ ID NO: 15716

SEQ ID NO: 51862 - DNA, 522 bp, Bacteroides fragilis NCTC 9343; identical to SEQ ID NO: 15717
  CDS (1)..(522): transl_table=11

SEQ ID NO: 51863 - protein, 173 aa, Bacteroides fragilis NCTC 9343; identical to SEQ ID NO: 15718

SEQ ID NO: 51864 - DNA, 600 bp, Bacteroides fragilis NCTC 9343; identical to SEQ ID NO: 15719
  CDS (1)..(600): transl_table=11

SEQ ID NO: 51865 - protein, 199 aa, Bacteroides fragilis NCTC 9343; identical to SEQ ID NO: 15720

SEQ ID NO: 51866 - DNA, 630 bp, Bacteroides fragilis NCTC 9343; identical to SEQ ID NO: 15721
  CDS (1)..(630): transl_table=11

SEQ ID NO: 51867 - protein, 209 aa, Bacteroides fragilis NCTC 9343; identical to SEQ ID NO: 15722

SEQ ID NO: 51868 - DNA, 624 bp, Bacteroides fragilis NCTC 9343; identical to SEQ ID NO: 15723
  CDS (1)..(624): transl_table=11

SEQ ID NO: 51869 - protein, 207 aa, Bacteroides fragilis NCTC 9343; identical to SEQ ID NO: 15724

SEQ ID NO: 51870 - DNA, 552 bp, Bacteroides fragilis NCTC 9343; identical to SEQ ID NO: 15725
  CDS (1)..(552): transl_table=11

SEQ ID NO: 51871 - protein, 183 aa, Bacteroides fragilis NCTC 9343; identical to SEQ ID NO: 15726

SEQ ID NO: 51872 - DNA, 588 bp, Bacteroides fragilis NCTC 9343; identical to SEQ ID NO: 15727
  CDS (1)..(588): transl_table=11

SEQ ID NO: 51873 - protein, 195 aa, Bacteroides fragilis NCTC 9343; identical to SEQ ID NO: 15728

SEQ ID NO: 51874 - DNA, 690 bp, Brucella abortus biovar 1 str. 9-941; identical to SEQ ID NO: 15729
  CDS (1)..(690): transl_table=11

SEQ ID NO: 51875 - protein, 229 aa, Brucella abortus biovar 1 str. 9-941; identical to SEQ ID NO: 15730

SEQ ID NO: 51876 - DNA, 690 bp, Chloroflexus aurantiacus; identical to SEQ ID NO: 15731
  CDS (1)..(690)

SEQ ID NO: 51877 - protein, 229 aa, Chloroflexus aurantiacus; identical to SEQ ID NO: 15732

SEQ ID NO: 51878 - DNA, 564 bp, Chloroflexus aurantiacus; identical to SEQ ID NO: 15733
  CDS (1)..(564)

SEQ ID NO: 51879 - protein, 187 aa, Chloroflexus aurantiacus; identical to SEQ ID NO: 15734

SEQ ID NO: 51880 - DNA, 615 bp, Lactobacillus gasseri; identical to SEQ ID NO: 15735
  CDS (1)..(615)

SEQ ID NO: 51881 - protein, 204 aa, Lactobacillus gasseri; identical to SEQ ID NO: 15736

SEQ ID NO: 51882 - DNA, 606 bp, Magnetospirillum magnetotacticum MS-1; identical to SEQ ID NO: 15737
  CDS (1)..(606)

SEQ ID NO: 51883 - protein, 201 aa, Magnetospirillum magnetotacticum MS-1; identical to SEQ ID NO: 15738

SEQ ID NO: 51884 - DNA, 702 bp, Leuconostoc mesenteroides subsp. mesenteroides ATCC 8293; identical to SEQ ID NO: 15739
  CDS (1)..(702)

SEQ ID NO: 51885 - protein, 233 aa, Leuconostoc mesenteroides subsp. mesenteroides ATCC 8293; identical to SEQ ID NO: 15740

SEQ ID NO: 51886 - DNA, 561 bp, Nostoc punctiforme PCC 73102; identical to SEQ ID NO: 15741
  CDS (1)..(561)

SEQ ID NO: 51887 - protein, 186 aa, Nostoc punctiforme PCC 73102; identical to SEQ ID NO: 15742

SEQ ID NO: 51888 - DNA, 594 bp, Nostoc punctiforme PCC 73102; identical to SEQ ID NO: 15743
  CDS (1)..(594)

SEQ ID NO: 51889 - protein, 197 aa, Nostoc punctiforme PCC 73102; identical to SEQ ID NO: 15744

SEQ ID NO: 51890 - DNA, 702 bp, Nostoc punctiforme PCC 73102; identical to SEQ ID NO: 15745
  CDS (1)..(702)

SEQ ID NO: 51891 - protein, 233 aa, Nostoc punctiforme PCC 73102; identical to SEQ ID NO: 15746

SEQ ID NO: 51892 - DNA, 675 bp, Bifidobacterium longum DJO10A; identical to SEQ ID NO: 15747
  CDS (1)..(675)

SEQ ID NO: 51893 - protein, 224 aa, Bifidobacterium longum DJO10A; identical to SEQ ID NO: 15748

SEQ ID NO: 51894 - DNA, 633 bp, Bifidobacterium longum DJO10A; identical to SEQ ID NO: 15749
  CDS (1)..(633)

SEQ ID NO: 51895 - protein, 210 aa, Bifidobacterium longum DJO10A; identical to SEQ ID NO: 15750

SEQ ID NO: 51896 - DNA, 609 bp, Desulfovibrio desulfuricans G20; identical to SEQ ID NO: 15751
  CDS (1)..(609)

SEQ ID NO: 51897 - protein, 202 aa, Desulfovibrio desulfuricans G20; identical to SEQ ID NO: 15752

SEQ ID NO: 51898 - DNA, 558 bp, Desulfovibrio desulfuricans G20; identical to SEQ ID NO: 15753
  CDS (1)..(558)

SEQ ID NO: 51899 - protein, 185 aa, Desulfovibrio desulfuricans G20; identical to SEQ ID NO: 15754

SEQ ID NO: 51900 - DNA, 576 bp, Anabaena variabilis ATCC 29413; identical to SEQ ID NO: 15755
  CDS (1)..(576)

SEQ ID NO: 51901 - protein, 191 aa, Anabaena variabilis ATCC 29413; identical to SEQ ID NO: 15756

SEQ ID NO: 51902 - DNA, 561 bp, Anabaena variabilis ATCC 29413; identical to SEQ ID NO: 15757
  CDS (1)..(561)

SEQ ID NO: 51903 - protein, 186 aa, Anabaena variabilis ATCC 29413; identical to SEQ ID NO: 15758

SEQ ID NO: 51904 - DNA, 576 bp, Actinobacillus pleuropneumoniae serovar 1 str. 4074; identical to SEQ ID NO: 15759
  CDS (1)..(576)

SEQ ID NO: 51905 - protein, 191 aa, Actinobacillus pleuropneumoniae serovar 1 str. 4074; identical to SEQ ID NO: 15760

SEQ ID NO: 51906 - DNA, 501 bp, Burkholderia cepacia R18194; identical to SEQ ID NO: 15761
  CDS (1)..(501)

SEQ ID NO: 51907 - protein, 166 aa, Burkholderia cepacia R18194; identical to SEQ ID NO: 15762

SEQ ID NO: 51908 - DNA, 609 bp, Burkholderia cepacia R18194; identical to SEQ ID NO: 15763
  CDS (1)..(609)

SEQ ID NO: 51909 - protein, 202 aa, Burkholderia cepacia R18194; identical to SEQ ID NO: 15764

SEQ ID NO: 51910 - DNA, 528 bp, Listeria monocytogenes str. 4b H7858; identical to SEQ ID NO: 15765
  CDS (1)..(528): transl_table=11

SEQ ID NO: 51911 - protein, 175 aa, Listeria monocytogenes str. 4b H7858; identical to SEQ ID NO: 15766

SEQ ID NO: 51912 - DNA, 570 bp, Listeria monocytogenes str. 4b H7858; identical to SEQ ID NO: 15767
  CDS (1)..(570): transl_table=11

SEQ ID NO: 51913 - protein, 189 aa, Listeria monocytogenes str. 4b H7858; identical to SEQ ID NO: 15768

SEQ ID NO: 51914 - DNA, 564 bp, Bacillus cereus G9241; identical to SEQ ID NO: 15769
  CDS (1)..(564): transl_table=11

SEQ ID NO: 51915 - protein, 187 aa, Bacillus cereus G9241; identical to SEQ ID NO: 15770

SEQ ID NO: 51916 - DNA, 558 bp, Bacillus cereus G9241; identical to SEQ ID NO: 15771
  CDS (1)..(558): transl_table=11

SEQ ID NO: 51917 - protein, 185 aa, Bacillus cereus G9241; identical to SEQ ID NO: 15772

SEQ ID NO: 51918 - DNA, 588 bp, Burkholderia fungorum LB400; identical to SEQ ID NO: 15773
  CDS (1)..(588)

SEQ ID NO: 51919 - protein, 195 aa, Burkholderia fungorum LB400; identical to SEQ ID NO: 15774

SEQ ID NO: 51920 - DNA, 555 bp, Thermobifida fusca; identical to SEQ ID NO: 15775
  CDS (1)..(555)

SEQ ID NO: 51921 - protein, 184 aa, Thermobifida fusca; identical to SEQ ID NO: 15776

SEQ ID NO: 51922 - DNA, 513 bp, Cytophaga hutchinsonii; identical to SEQ ID NO: 15777
  CDS (1)..(513)

SEQ ID NO: 51923 - protein, 170 aa, Cytophaga hutchinsonii; identical to SEQ ID NO: 15778

SEQ ID NO: 51924 - DNA, 654 bp, Cytophaga hutchinsonii; identical to SEQ ID NO: 15779
  CDS (1)..(654)

SEQ ID NO: 51925 - protein, 217 aa, Cytophaga hutchinsonii; identical to SEQ ID NO: 15780

SEQ ID NO: 51926 - DNA, 744 bp, Microbulbifer degradans 2-40; identical to SEQ ID NO: 15781
  CDS (1)..(744)

SEQ ID NO: 51927 - protein, 247 aa, Microbulbifer degradans 2-40; identical to SEQ ID NO: 15782

SEQ ID NO: 51928 - DNA, 549 bp, Microbulbifer degradans 2-40; identical to SEQ ID NO: 15783
  CDS (1)..(549)

SEQ ID NO: 51929 - protein, 182 aa, Microbulbifer degradans 2-40; identical to SEQ ID NO: 15784

SEQ ID NO: 51930 - DNA, 417 bp, Oenococcus oeni PSU-1; identical to SEQ ID NO: 15785
  CDS (1)..(417)

SEQ ID NO: 51931 - protein, 138 aa, Oenococcus oeni PSU-1; identical to SEQ ID NO: 15786

SEQ ID NO: 51932 - DNA, 567 bp, Pediococcus pentosaceus ATCC 25745; identical to SEQ ID NO: 15787
  CDS (1)..(567)

SEQ ID NO: 51933 - protein, 188 aa, Pediococcus pentosaceus ATCC 25745; identical to SEQ ID NO: 15788

SEQ ID NO: 51934 - DNA, 555 bp, Pediococcus pentosaceus ATCC 25745; identical to SEQ ID NO: 15789
  CDS (1)..(555)

SEQ ID NO: 51935 - protein, 184 aa, Pediococcus pentosaceus ATCC 25745; identical to SEQ ID NO: 15790

SEQ ID NO: 51936 - DNA, 552 bp, Pediococcus pentosaceus ATCC 25745; identical to SEQ ID NO: 15791
  CDS (1)..(552)

SEQ ID NO: 51937 - protein, 183 aa, Pediococcus pentosaceus ATCC 25745; identical to SEQ ID NO: 15792

SEQ ID NO: 51938 - DNA, 465 bp, Streptococcus suis 89/1591; identical to SEQ ID NO: 15793
  CDS (1)..(465)

SEQ ID NO: 51939 - protein, 154 aa, Streptococcus suis 89/1591; identical to SEQ ID NO: 15794

SEQ ID NO: 51940 - DNA, 606 bp, Desulfovibrio desulfuricans G20; identical to SEQ ID NO: 15795
  CDS (1)..(606)

SEQ ID NO: 51941 - protein, 201 aa, Desulfovibrio desulfuricans G20; identical to SEQ ID NO: 15796

SEQ ID NO: 51942 - DNA, 543 bp, Chloroflexus aurantiacus; identical to SEQ ID NO: 15797
  CDS (1)..(543)

SEQ ID NO: 51943 - protein, 180 aa, Chloroflexus aurantiacus; identical to SEQ ID NO: 15798

SEQ ID NO: 51944 - DNA, 186 bp, Brevibacterium linens BL2; identical to SEQ ID NO: 15799
  CDS (1)..(186)

SEQ ID NO: 51945 - protein, 61 aa, Brevibacterium linens BL2; identical to SEQ ID NO: 15800

SEQ ID NO: 51946 - DNA, 612 bp, Lactococcus lactis subsp. cremoris SK11; identical to SEQ ID NO: 15801
  CDS (1)..(612)

SEQ ID NO: 51947 - protein, 203 aa, Lactococcus lactis subsp. cremoris SK11; identical to SEQ ID NO: 15802

SEQ ID NO: 51948 - DNA, 588 bp, Lactococcus lactis subsp. cremoris SK11; identical to SEQ ID NO: 15803
  CDS (1)..(588)

SEQ ID NO: 51949 - protein, 195 aa, Lactococcus lactis subsp. cremoris SK11; identical to SEQ ID NO: 15804

SEQ ID NO: 51950 - DNA, 597 bp, Lactobacillus casei ATCC 334; identical to SEQ ID NO: 15805
  CDS (1)..(597)

SEQ ID NO: 51951 - protein, 198 aa, Lactobacillus casei ATCC 334; identical to SEQ ID NO: 15806

SEQ ID NO: 51952 - DNA, 705 bp, Lactobacillus casei ATCC 334; identical to SEQ ID NO: 15807
  CDS (1)..(705)

SEQ ID NO: 51953 - protein, 234 aa, Lactobacillus casei ATCC 334; identical to SEQ ID NO: 15808

SEQ ID NO: 51954 - DNA, 591 bp, Lactobacillus delbrueckii subsp. bulgaricus ATCC BAA-365; identical to SEQ ID NO: 15809
  CDS (1)..(591)

SEQ ID NO: 51955 - protein, 196 aa, Lactobacillus delbrueckii subsp. bulgaricus ATCC BAA-365; identical to SEQ ID NO: 15810

SEQ ID NO: 51956 - DNA, 609 bp, Bacillus anthracis str. A2012; identical to SEQ ID NO: 15811
  CDS (1)..(609): n means a or g or c or t/u, s means g or c

SEQ ID NO: 51957 - protein, 202 aa, Bacillus anthracis str. A2012; identical to SEQ ID NO: 15812
  Xaa in position 136 is unknown

SEQ ID NO: 51958 - DNA, 534 bp, Anaeromyxobacter dehalogenans 2CP-C; identical to SEQ ID NO: 15813
  CDS (1)..(534): transl_table=11

SEQ ID NO: 51959 - protein, 177 aa, Anaeromyxobacter dehalogenans 2CP-C; identical to SEQ ID NO: 15814

SEQ ID NO: 51960 - DNA, 663 bp, Streptococcus pneumoniae TIGR4; identical to SEQ ID NO: 15815
  CDS (1)..(663)

SEQ ID NO: 51961 - protein, 220 aa, Streptococcus pneumoniae TIGR4; identical to SEQ ID NO: 15816

SEQ ID NO: 51962 - DNA, 558 bp, Burkholderia vietnamiensis G4; identical to SEQ ID NO: 15817
  CDS (1)..(558): transl_table=11

SEQ ID NO: 51963 - protein, 185 aa, Burkholderia vietnamiensis G4; identical to SEQ ID NO: 15818

SEQ ID NO: 51964 - DNA, 576 bp, Crocosphaera watsonii WH 8501; identical to SEQ ID NO: 15819
  CDS (1)..(576): transl_table=11

SEQ ID NO: 51965 - protein, 191 aa, Crocosphaera watsonii WH 8501; identical to SEQ ID NO: 15820

SEQ ID NO: 51966 - DNA, 555 bp, Chlorobium phaeobacteroides DSM 266; identical to SEQ ID NO: 15821
  CDS (1)..(555): transl_table=11

SEQ ID NO: 51967 - protein, 184 aa, Chlorobium phaeobacteroides DSM 266; identical to SEQ ID NO: 15822

SEQ ID NO: 51968 - DNA, 618 bp, Chlorobium phaeobacteroides BS1; identical to SEQ ID NO: 15823
  CDS (1)..(618): transl_table=11

SEQ ID NO: 51969 - protein, 205 aa, Chlorobium phaeobacteroides BS1; identical to SEQ ID NO: 15824

SEQ ID NO: 51970 - DNA, 576 bp, Exiguobacterium sp. 255-15; identical to SEQ ID NO: 15825
  CDS (1)..(576): transl_table=11

SEQ ID NO: 51971 - protein, 191 aa, Exiguobacterium sp. 255-15; identical to SEQ ID NO: 15826

SEQ ID NO: 51972 - DNA, 552 bp, Exiguobacterium sp. 255-15; identical to SEQ ID NO: 15827
  CDS (1)..(552): transl_table=11

SEQ ID NO: 51973 - protein, 183 aa, Exiguobacterium sp. 255-15; identical to SEQ ID NO: 15828

SEQ ID NO: 51974 - DNA, 702 bp, Exiguobacterium sp. 255-15; identical to SEQ ID NO: 15829
  CDS (1)..(702): transl_table=11

SEQ ID NO: 51975 - protein, 233 aa, Exiguobacterium sp. 255-15; identical to SEQ ID NO: 15830

SEQ ID NO: 51976 - DNA, 642 bp, Methanosarcina barkeri str. fusaro; identical to SEQ ID NO: 15831
  CDS (1)..(642): transl_table=11

SEQ ID NO: 51977 - protein, 213 aa, Methanosarcina barkeri str. fusaro; identical to SEQ ID NO: 15832

SEQ ID NO: 51978 - DNA, 600 bp, Methanosarcina barkeri str. fusaro; identical to SEQ ID NO: 15833
  CDS (1)..(600): transl_table=11

SEQ ID NO: 51979 - protein, 199 aa, Methanosarcina barkeri str. fusaro; identical to SEQ ID NO: 15834

SEQ ID NO: 51980 - DNA, 549 bp, Methanosarcina barkeri str. fusaro; identical to SEQ ID NO: 15835
  CDS (1)..(549): transl_table=11

SEQ ID NO: 51981 - protein, 182 aa, Methanosarcina barkeri str. fusaro; identical to SEQ ID NO: 15836

SEQ ID NO: 51982 - DNA, 609 bp, Methanosarcina barkeri str. fusaro; identical to SEQ ID NO: 15837
  CDS (1)..(609): transl_table=11

SEQ ID NO: 51983 - protein, 202 aa, Methanosarcina barkeri str. fusaro; identical to SEQ ID NO: 15838

SEQ ID NO: 51984 - DNA, 531 bp, Desulfuromonas acetoxidans DSM 684; identical to SEQ ID NO: 15839
  CDS (1)..(531): transl_table=11

SEQ ID NO: 51985 - protein, 176 aa, Desulfuromonas acetoxidans DSM 684; identical to SEQ ID NO: 15840

SEQ ID NO: 51986 - DNA, 555 bp, Jannaschia sp. CCS1; identical to SEQ ID NO: 15841
  CDS (1)..(555): transl_table=11

SEQ ID NO: 51987 - protein, 184 aa, Jannaschia sp. CCS1; identical to SEQ ID NO: 15842

SEQ ID NO: 51988 - DNA, 630 bp, Frankia sp. EAN1pec; identical to SEQ ID NO: 15843
  CDS (1)..(630): transl_table=11

SEQ ID NO: 51989 - protein, 209 aa, Frankia sp. EAN1pec; identical to SEQ ID NO: 15844

SEQ ID NO: 51990 - DNA, 555 bp, Shewanella baltica OS155; identical to SEQ ID NO: 15845
  CDS (1)..(555): transl_table=11

SEQ ID NO: 51991 - protein, 184 aa, Shewanella baltica OS155; identical to SEQ ID NO: 15846

SEQ ID NO: 51992 - DNA, 585 bp, Shewanella baltica OS155; identical to SEQ ID NO: 15847
  CDS (1)..(585): transl_table=11

SEQ ID NO: 51993 - protein, 194 aa, Shewanella baltica OS155; identical to SEQ ID NO: 15848

SEQ ID NO: 51994 - DNA, 726 bp, Ralstonia metallidurans CH34; identical to SEQ ID NO: 15849
  CDS (1)..(726): transl_table=11

SEQ ID NO: 51995 - protein, 241 aa, Ralstonia metallidurans CH34; identical to SEQ ID NO: 15850

SEQ ID NO: 51996 - DNA, 549 bp, Paracoccus denitrificans PD1222; identical to SEQ ID NO: 15851
  CDS (1)..(549): transl_table=11

SEQ ID NO: 51997 - protein, 182 aa, Paracoccus denitrificans PD1222; identical to SEQ ID NO: 15852

SEQ ID NO: 51998 - DNA, 615 bp, Shewanella frigidimarina NCIMB 400; identical to SEQ ID NO: 15853
  CDS (1)..(615): transl_table=11

SEQ ID NO: 51999 - protein, 204 aa, Shewanella frigidimarina NCIMB 400; identical to SEQ ID NO: 15854

SEQ ID NO: 52000 - DNA, 777 bp, Escherichia coli; identical to SEQ ID NO: 15855
  CDS (1)..(777): transl_table=11

SEQ ID NO: 52001 - protein, 258 aa, Escherichia coli; identical to SEQ ID NO: 15856

SEQ ID NO: 52002 - DNA, 651 bp, Pseudomonas fluorescens; identical to SEQ ID NO: 15857
  CDS (1)..(651): transl_table=11

SEQ ID NO: 52003 - protein, 216 aa, Pseudomonas fluorescens; identical to SEQ ID NO: 15858

SEQ ID NO: 52004 - DNA, 579 bp, Staphylococcus haemolyticus; identical to SEQ ID NO: 15859
  CDS (1)..(579): transl_table=11

SEQ ID NO: 52005 - protein, 192 aa, Staphylococcus haemolyticus; identical to SEQ ID NO: 15860

SEQ ID NO: 52006 - DNA, 648 bp, Aspergillus fumigatus Af293; identical to SEQ ID NO: 15861
  CDS (1)..(648)

SEQ ID NO: 52007 - protein, 215 aa, Aspergillus fumigatus Af293; identical to SEQ ID NO: 15862

SEQ ID NO: 52008 - DNA, 747 bp, Aspergillus fumigatus Af293; identical to SEQ ID NO: 15863
  CDS (1)..(747)

SEQ ID NO: 52009 - protein, 248 aa, Aspergillus fumigatus Af293; identical to SEQ ID NO: 15864

SEQ ID NO: 52010 - DNA, 687 bp, Aspergillus fumigatus Af293; identical to SEQ ID NO: 15865
  CDS (1)..(687)

SEQ ID NO: 52011 - protein, 228 aa, Aspergillus fumigatus Af293; identical to SEQ ID NO: 15866

SEQ ID NO: 52012 - DNA, 603 bp, Lactobacillus crispatus; identical to SEQ ID NO: 15867
  CDS (1)..(603): transl_table=11

SEQ ID NO: 52013 - protein, 200 aa, Lactobacillus crispatus; identical to SEQ ID NO: 15868

SEQ ID NO: 52014 - DNA, 642 bp, Cryptococcus neoformans var; identical to SEQ ID NO: 15869
  CDS (1)..(642)

SEQ ID NO: 52015 - protein, 213 aa, Cryptococcus neoformans var; identical to SEQ ID NO: 15870

SEQ ID NO: 52016 - DNA, 513 bp, Klebsiella pneumoniae; identical to SEQ ID NO: 15871
  CDS (1)..(513): transl_table=11

SEQ ID NO: 52017 - protein, 170 aa, Klebsiella pneumoniae; identical to SEQ ID NO: 15872

SEQ ID NO: 52018 - DNA, 555 bp, Vibrio cholerae non; identical to SEQ ID NO: 15873
  CDS (1)..(555): transl_table=11

SEQ ID NO: 52019 - protein, 184 aa, Vibrio cholerae non; identical to SEQ ID NO: 15874

SEQ ID NO: 52020 - DNA, 645 bp, Rhizobium etli; identical to SEQ ID NO: 15875
  CDS (1)..(645): transl_table=11

SEQ ID NO: 52021 - protein, 214 aa, Rhizobium etli; identical to SEQ ID NO: 15876

SEQ ID NO: 52022 - DNA, 558 bp, Bacillus stearothermophilus; identical to SEQ ID NO: 15877
  CDS (1)..(558): transl_table=11

SEQ ID NO: 52023 - protein, 185 aa, Bacillus stearothermophilus; identical to SEQ ID NO: 15878

SEQ ID NO: 52024 - DNA, 594 bp, Rhizobium leguminosarum bv; identical to SEQ ID NO: 15879
  CDS (1)..(594): transl_table=11

SEQ ID NO: 52025 - protein, 197 aa, Rhizobium leguminosarum bv; identical to SEQ ID NO: 15880

SEQ ID NO: 52026 - DNA, 573 bp, Dictyostelium discoideum; identical to SEQ ID NO: 15881
  CDS (1)..(573)

SEQ ID NO: 52027 - protein, 190 aa, Dictyostelium discoideum; identical to SEQ ID NO: 15882

SEQ ID NO: 52028 - DNA, 657 bp, Physcomitrella patens; identical to SEQ ID NO: 15883
  CDS (1)..(657)

SEQ ID NO: 52029 - protein, 218 aa, Physcomitrella patens; identical to SEQ ID NO: 15884

SEQ ID NO: 52030 - DNA, 636 bp, Aeromonas hydrophila; identical to SEQ ID NO: 15885
  CDS (1)..(636): transl_table=11

SEQ ID NO: 52031 - protein, 211 aa, Aeromonas hydrophila; identical to SEQ ID NO: 15886

SEQ ID NO: 52032 - DNA, 600 bp, Aeromonas hydrophila; identical to SEQ ID NO: 15887
  CDS (1)..(600): transl_table=11

SEQ ID NO: 52033 - protein, 199 aa, Aeromonas hydrophila; identical to SEQ ID NO: 15888

SEQ ID NO: 52034 - DNA, 678 bp, Corynebacterium glutamicum; identical to SEQ ID NO: 15889
  CDS (1)..(678): transl_table=11

SEQ ID NO: 52035 - protein, 225 aa, Corynebacterium glutamicum; identical to SEQ ID NO: 15890

SEQ ID NO: 52036 - DNA, 624 bp, Lactococcus lactis; identical to SEQ ID NO: 15891
  CDS (1)..(624): transl_table=11

SEQ ID NO: 52037 - protein, 207 aa, Lactococcus lactis; identical to SEQ ID NO: 15892

SEQ ID NO: 52038 - DNA, 621 bp, Candida albicans; identical to SEQ ID NO: 15893
  CDS (1)..(621): transl_table=12

SEQ ID NO: 52039 - protein, 206 aa, Candida albicans; identical to SEQ ID NO: 15894

SEQ ID NO: 52040 - DNA, 519 bp, Staphylococcus aureus; identical to SEQ ID NO: 15895
  CDS (1)..(519): transl_table=11

SEQ ID NO: 52041 - protein, 172 aa, Staphylococcus aureus; identical to SEQ ID NO: 15896

SEQ ID NO: 52042 - DNA, 555 bp, Bacillus subtilis; identical to SEQ ID NO: 15897
  CDS (1)..(555): transl_table=11

SEQ ID NO: 52043 - protein, 184 aa, Bacillus subtilis; identical to SEQ ID NO: 15898

SEQ ID NO: 52044 - DNA, 552 bp, Escherichia coli; identical to SEQ ID NO: 15433
  CDS (1)..(552)

SEQ ID NO: 52045 - protein, 183 aa, Escherichia coli; identical to SEQ ID NO: 15434

SEQ ID NO: 52046 - DNA, 573 bp, Rhizobium leguminosarum bv; identical to SEQ ID NO: 15901
  CDS (1)..(573): transl_table=11

SEQ ID NO: 52047 - protein, 190 aa, Rhizobium leguminosarum bv; identical to SEQ ID NO: 15902

SEQ ID NO: 52048 - DNA, 552 bp, Rhizobium meliloti; identical to SEQ ID NO: 15903
  CDS (1)..(552): transl_table=11

SEQ ID NO: 52049 - protein, 183 aa, Rhizobium meliloti; identical to SEQ ID NO: 15904

SEQ ID NO: 52050 - DNA, 624 bp, Lactococcus lactis subsp; identical to SEQ ID NO: 15905
  CDS (1)..(624): transl_table=11

SEQ ID NO: 52051 - protein, 207 aa, Lactococcus lactis subsp; identical to SEQ ID NO: 15906

SEQ ID NO: 52052 - DNA, 645 bp, Methanococcus jannaschii; identical to SEQ ID NO: 15907
  CDS (1)..(645): transl_table=11

SEQ ID NO: 52053 - protein, 214 aa, Methanococcus jannaschii; identical to SEQ ID NO: 15908

SEQ ID NO: 52054 - DNA, 624 bp, Schizosaccharomyces pombe; identical to SEQ ID NO: 15909
  CDS (1)..(624)

SEQ ID NO: 52055 - protein, 207 aa, Schizosaccharomyces pombe; identical to SEQ ID NO: 15910

SEQ ID NO: 52056 - DNA, 591 bp, Saccharomyces cerevisiae; identical to SEQ ID NO: 15911
  CDS (1)..(591)

SEQ ID NO: 52057 - protein, 196 aa, Saccharomyces cerevisiae; identical to SEQ ID NO: 15912

SEQ ID NO: 52058 - DNA, 25 bp, Artificial sequence
  (1)..(25): primer
atgaacatgccaatgaccgaaagaa

SEQ ID NO: 52059 - DNA, 28 bp, Artificial sequence
  (1)..(28): primer
ttaaactgacgattcaactttataatct

SEQ ID NO: 52060 - protein, 204 aa, Artificial sequence; identical to SEQ ID NO: 15915
  Variant (2)..(4): xaa in position 2 to 4 is any amino acid
  Variant (5)..(9): xaa in position 5 to 9 is any or no amino acid
  Variant (11)..(26): xaa in position 11 to 26 is any or no amino acid
  Variant (28)..(28): xaa in position 28 is any amino acid
  Variant (31)..(41): xaa in position 31 to 41 is any amino acid
  Variant (42)..(92): xaa in position 42 to 92 is any or no amino acid
  Variant (94)..(94): xaa in position 94 is any or no amino acid
  Variant (97)..(97): xaa in position 97 is any amino acid
  Variant (98)..(101): xaa in position 98 to 101 is any or no amino acid
  Variant (103)..(106): xaa in position 103 to 106 is any amino acid
  Variant (108)..(109): xaa in position 108 to 109 is any amino acid
  Variant (110)..(112): xaa in position 110 to 112 is any or no amino acid
  Variant (114)..(119): xaa in position 114 to 119 is any amino acid
  Variant (120)..(152): xaa in position 120 to 152 is any or no amino acid
  Variant (154)..(154): xaa in position 154 is any amino acid
  Variant (156)..(159): xaa in position 156 to 159 is any amino acid
  Variant (163)..(166): xaa in position 163 to 166 is any or no amino acid
  Variant (168)..(169): xaa in position 168 to 169 is any or no amino acid
  Variant (172)..(172): xaa in position 172 is any or no amino acid
  Variant (175)..(177): xaa in position 175 to 177 is any or no amino acid
  Variant (188)..(188): xaa in position 188 is any amino acid
  Variant (191)..(193): xaa in position 191 to 193 is any amino acid
  Variant (195)..(196): xaa in position 195 to 196 is any amino acid
  Variant (198)..(198): xaa in position 198 is any amino acid
  Variant (200)..(200): xaa in position 200 is any amino acid

SEQ ID NO: 52061 - protein, 12 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is Ala, Cys, Thr or Val
  Variant (7)..(7): xaa in position 7 is any amino acid
  Variant (8)..(8): xaa in position 8 is Phe, Ile, Leu, Met or Val
  Variant (9)..(11): xaa in position 9 to 11 is any amino acid
  Variant (12)..(12): xaa in position 12 is Ala, Cys, Asp, Gly, Asn, Ser, Thr or Val
IXGXXXXXXXXX

SEQ ID NO: 52062 - protein, 43 aa, Artificial sequence; identical to SEQ ID NO: 15917
  Variant (2)..(2): xaa in position 2 is any amino acid
  Variant (3)..(4): xaa in position 3 to 4 is any or no amino acid
  Variant (6)..(10): xaa in position 6 to 10 is any amino acid
  Variant (11)..(12): xaa in position 11 to 12 is any or no amino acid
  Variant (14)..(14): xaa in position 14 is Ala, Ile or Val
  Variant (15)..(15): xaa in position 15 is any amino acid
  Variant (16)..(16): xaa in position 16 is Ile, Leu or Val
  Variant (17)..(17): xaa in position 17 is Asp, Gly or Thr
  Variant (18)..(19): xaa in position 18 to 19 is any amino acid
  Variant (20)..(20): xaa in position 20 is Ala, Cys, Gly, Ser, Thr or Val
  Variant (21)..(21): xaa in position 21 is any amino acid
  Variant (22)..(22): xaa in position 22 is Ala, Ile, Leu or Val
  Variant (23)..(23): xaa in position 23 is Ala, Gly or Ser
  Variant (24)..(25): xaa in position 24 to 25 is any amino acid
  Variant (26)..(26): xaa in position 26 is Ala, Cys, Ser or Thr
  Variant (27)..(27): xaa in position 27 is any amino acid
  Variant (28)..(28): xaa in position 28 is Ala, Ile or Val
  Variant (29)..(31): xaa in position 29 to 31 is any amino acid
  Variant (32)..(32): xaa in position 32 is Phe, Ile, Leu, Met or Val
  Variant (33)..(39): xaa in position 33 to 39 is any amino acid
  Variant (41)..(41): xaa in position 41 is any amino acid
  Variant (43)..(43): xaa in position 43 is Ala, Cys or Gly

SEQ ID NO: 52063 - DNA, 510 bp, Escherichia coli
  CDS (1)..(510)
atgtcttcccgcaataatccggcgcgtgtcgccatcgtgatggggtccaaaagcgactgggctaccatgcagttcgccgccgaaatcttcgaaatcctgaatgtcccgcaccacgttgaagtggtttctgctcaccgcacccccgataaactattcagcttcgccgaaagtgccgaagagaacggttatcaggtgattattgcgggcgcaggcggcgcagcgcacctgccaggcatgattgccgccaaaacgctggtgccagtgctgggcgtgccagtacagagcgccgcactgagcggtgtcgatagcctctactccatcgtacaaatgccacgcggcattccggtgggtacgctggcgattggtaaagctggcgcggcaaacgcggcattactggcagcacaaattcttgcgactcatgataaagaactgcaccagcgtctgaatgactggcgcaaagcacaaactgatgaagtgctggaaaacccggacccgcgaggtgcggcatga

SEQ ID NO: 52064 - protein, 169 aa, Escherichia coli
MSSRNNPARVAIVMGSKSDWATMQFAAEIFEILNVPHHVEVVSAHRTPDKLFSFAESAEENGYQVIIAGAGGAAHLPGMIAAKTLVPVLGVPVQSAALSGVDSLYSIVQMPRGIPVGTLAIGKAGAANAALLAAQILATHDKELHQRLNDWRKAQTDEVLENPDPRGAA

SEQ ID NO: 52065 - DNA, 498 bp, Mesorhizobium loti MAFF303099
  CDS (1)..(498): transl_table=11
ttgaacgatcaacgcgccgacgtcgccatcatcatgggcagccagtccgactgggcgacgatgcgccaggcggccgaaacgctggaggcgctgggcgtcccgcacaaacggctgatcatctcggcgcatcgcacgcccgaccggctctatgaattcgccaagggcgcaaaggccgccggctacaaggtgatcatcgccggcgccggcggtgccgcgcacctgcccggcatgacggcggcgatgacgccgctgccggtgttcggcgtgccggtggaatcgaaggcgctgtcggggcaggattcgctgctctccatcgtccagatgccagccggcattcctgtcgggacattggccatcggcaaggcgggtgcggccaatgcggccctgttggcagccgccgtgctggcgctcaacgacgacaagcttgcccagcgcctcgacgcctggcgcgcctcgcagaccgccaaggtcgccgacgaaccgacggacacgccgtga

SEQ ID NO: 52066 - protein, 165 aa, Mesorhizobium loti MAFF303099
MNDQRADVAIIMGSQSDWATMRQAAETLEALGVPHKRLIISAHRTPDRLYEFAKGAKAAGYKVIIAGAGGAAHLPGMTAAMTPLPVFGVPVESKALSGQDSLLSIVQMPAGIPVGTLAIGKAGAANAALLAAAVLALNDDKLAQRLDAWRASQTAKVADEPTDTP

SEQ ID NO: 52067 - DNA, 471 bp, Thermoplasma volcanium GSS1
  CDS (1)..(471): transl_table=11
atgccaaaggttgcagtaatcatggggagttcaagcgattacgaagtaatgaaagccgccatagatacactcaacgagttcggtgtagatgtaatctcgaaagtggtctctgcacataggactccagagtttatgatgcagtttgcaaaggaggcagcttcctctggaatagaagctataatagctggagcaggcggagctgcacacctgcctggcatggttgctgcgatgactccattgccggtgattggagtgccagttcctacgaaaaacctaggagggatggattccctgctatcaatagtgcaaatgccttctggtgtgccagtagctactgttgctattggcaattcgaagaatgcagctctgttggcaattcgaatactgtcaataaaatatcccgatcttatggccaaaatgtctgaatttatggaatctgaaaaacagcgggttcttcaagaaaagatctga

SEQ ID NO: 52068 - protein, 156 aa, Thermoplasma volcanium GSS1
MPKVAVIMGSSSDYEVMKAAIDTLNEFGVDVISKVVSAHRTPEFMMQFAKEAASSGIEAIIAGAGGAAHLPGMVAAMTPLPVIGVPVPTKNLGGMDSLLSIVQMPSGVPVATVAIGNSKNAALLAIRILSIKYPDLMAKMSEFMESEKQRVLQEKI

SEQ ID NO: 52069 - DNA, 489 bp, Arabidopsis thaliana
  CDS (1)..(489)
atgggttcagacacggatcttcttgttatgaaggatgctgccaaaattctggacatgtttggtgtcacacatgaggtaaagatagtttctgctcatcgcaccccagagatgatgtatacatatgcaacctcagctcatagtcgaggcgttcaagtcatcattgcaggtgctggtggtgctgctcacttaccaggtatggttgcttcactcactcctttgcctgtgattggtgtccctgtccaagctacccgtttggatggagttgattcacttctctccatcgttcagatgcctagaggtgttcctgttgcgacagttgcaataaacaatgcgaccaacgcagccttgcttgcagtccggatgttgggaatctctgataatgatcttgtctcaaggatgagacagtaccaagaagacatgagagatgagaacctgaataaaggagagaaacttgagacacaaggttgggaatcatatttgaaccagtga

SEQ ID NO: 52070 - protein, 162 aa, Arabidopsis thaliana
MGSDTDLLVMKDAAKILDMFGVTHEVKIVSAHRTPEMMYTYATSAHSRGVQVIIAGAGGAAHLPGMVASLTPLPVIGVPVQATRLDGVDSLLSIVQMPRGVPVATVAINNATNAALLAVRMLGISDNDLVSRMRQYQEDMRDENLNKGEKLETQGWESYLNQ

SEQ ID NO: 52071 - DNA, 1929 bp, Arabidopsis thaliana
  CDS (1)..(1929)
atgttgcttttgaaacaaagctcagctgctgttcttgtcgttggaaatacaactccagtccttcacacttctcgctccacctacagagttggaccttttccagtgaccagaacgcagtcgttccagagtttgactatggcaaatttgcagaagcttcccacttcttcgtctgggaaattgaatacggcttcagctgtgccctgtagctctcacgatgcttctcctatcagtgagaatcgcgagaataaacatgtccatggagtttctgagaaaattgtgggagttcttgggggtggacaattgggtcgtatgctttgccaagctgcttctcagttggctatcaaagtgatgattttagatccttctaaaaattgttcagcaagtgcattgtcctacggtcacatggttgatagctttgacgacagtgctacagtagaagaatttgcaaaaagatgtggagtcttaactgtagaaattgaacatgttgacgtggacacactagagaagcttgagaaacaaggagtggattgccaacccaaagcttctactattaggataatacaggataaatacatgcaaaaggttcatttctctcagcatggcatcccacttccagaatttatggagataagcgatattgaaggagcaagaaaagcaggtgaacttttcggttaccctcttatgatcaagagcaaacgattggcttatgatggacgtggaaatgcagttgccaacaaccaagatgagctttcttctgctgtaacggctcttggaggtttcagtcgtggtttgtatattgagaaatgggcaccttttgttaaggagttagctgttattgtggctagggggagagatggttctatggtttgttatcccgttgttgaaaccattcacagggataacatatgccatatagttaaagcacctgcagatgtgccttggaagattaacaaacttgccaccgatgttgcccaaaaggctgtcggttctttagaaggtgctggtgtttttgcagttgaactgttcttgacagaggatagtcagattctgctaaacgaagttgcacctagaccacacaacagtggccatcaaacgatcgagtgctgttatacttcacagtttgaacaacacttgcgagctgtggttggtcttccacttggtgatccgtcaatgagaactccggcgtccattatgtacaatattctgggagaagatgatggagaagcaggtttcaaattggctcatcggcttattgcaagggctctgtgtattccaggtgcatctgttcattggtatgacaagccagaaatgagaaagcagagaaagatgggtcacatcactcttgttgggcagtctatgggcattttggaacaaaggttacaatgcatattaagtgagcaaagccaccaagtacacgagacacctcgtgttgctatcatcatgggttcagacacggatcttcctgttatgaaggatgctgccaaaattctggacctgtttggtgtgacacatgaggtaaagatagtttctgctcatcgcaccccagagatgatgtatacatatgcaacctcagctcatagtcgaggcgttcaagtcattattgcaggtgctggtggtgctgctcacttaccaggtatggttgcttcactcactcctttgcctgtgattggtgtccctgtccgtgctacccgtttggatggagttgattcacttctttccatcgttcagatgcctagaggtgttcctgttgcgacagttgcaataaacaatgcgaccaacgcagccttgcttgcagttcggatgttgggaatctctgatacggatcttgtctcaaggatgaggcagtaccaggaagacatgagagatgagaacctgaataaaggagagaaactggagacagaaggttgggaatcatatttgaaccagtga

SEQ ID NO: 52072 - protein, 642 aa, Arabidopsis thaliana
MLLLKQSSAAVLVVGNTTPVLHTSRSTYRVGPFPVTRTQSFQSLTMANLQKLPTSSSGKLNTASAVPCSSHDASPISENRENKHVHGVSEKIVGVLGGGQLGRMLCQAASQLAIKVMILDPSKNCSASALSYGHMVDSFDDSATVEEFAKRCGVLTVEIEHVDVDTLEKLEKQGVDCQPKASTIRIIQDKYMQKVHFSQHGIPLPEFMEISDIEGARKAGELFGYPLMIKSKRLAYDGRGNAVANNQDELSSAVTALGGFSRGLYIEKWAPFVKELAVIVARGRDGSMVCYPVVETIHRDNICHIVKAPADVPWKINKLATDVAQKAVGSLEGAGVFAVELFLTEDSQILLNEVAPRPHNSGHQTIECCYTSQFEQHLRAVVGLPLGDPSMRTPASIMYNILGEDDGEAGFKLAHRLIARALCIPGASVHWYDKPEMRKQRKMGHITLVGQSMGILEQRLQCILSEQSHQVHETPRVAIIMGSDTDLPVMKDAAKILDLFGVTHEVKIVSAHRTPEMMYTYATSAHSRGVQVIIAGAGGAAHLPGMVASLTPLPVIGVPVRATRLDGVDSLLSIVQMPRGVPVATVAINNATNAALLAVRMLGISDTDLVSRMRQYQEDMRDENLNKGEKLETEGWESYLNQ

SEQ ID NO: 52073 - DNA, 486 bp, Bacillus halodurans C-125
  CDS (1)..(486): transl_table=11
atggagccagtcgttggcgtcatcatgggaagtacatccgattgggagacgatgcagcacgcatgtgaaatactcgaagaattagaggtaccgtacgaaaaaaaagtcgtgtcagcccaccgtacacctgatttaatgtttcaatatgcagaaaccgcacaggaacgcgggttgaaggtgattatcgcaggtgctggaggagctgctcatcttccagggatggtagcggccaaaacggtcgttcctgtcattggggtgccggttcaatcaaaggcactgaacgggcttgactcattactttcaatcgtacaaatgccgggcggtgttccggttgcgaccgttgcgattggaaaagctggagccacaaacgcggggctactggcggcgcaaatgatcggtgcctttgatcatcaagtggctgagcgagttcgcctgcgccgtgaaaaagtggaacaagctgtgctggaaagtagtgaatcgctatga

SEQ ID NO: 52074 - protein, 161 aa, Bacillus halodurans C-125
MEPVVGVIMGSTSDWETMQHACEILEELEVPYEKKVVSAHRTPDLMFQYAETAQERGLKVIIAGAGGAAHLPGMVAAKTVVPVIGVPVQSKALNGLDSLLSIVQMPGGVPVATVAIGKAGATNAGLLAAQMIGAFDHQVAERVRLRREKVEQAVLESSESL

SEQ ID NO: 52075 - DNA, 501 bp, Pasteurella multocida subsp. multocida str. Pm70
  CDS (1)..(501): transl_table=11
atgtcaaattgcacacctcaaattgcgattgtaatgggctcaaaaagtgactgggcaaccatgcaagaagcaacccatattcttgatgaattacaaattccttaccacgttgaagtggtgtctgcacatcgtaccccagataaattatttacctttgcagaaacagcgagtgcgaaaggttacaaagtgattattgcaggtgccggcggtgctgcccatttaccgggtatgatcgcgtcaaaaactttagtccctgtattgggcgtaccggtcaaaagttcgatgttaagtggcgttgatagtttgtattcgattgtgcaaatgcctaaggggattcctgtcggaaccttagcgattggtcctgcaggagcggctaatgcaggcttattagcagctcaaatcttagcagcctttgacacttcgctcctgacaagattgacggcatttcgagaaaagcaaacaaatagcgtactagaaaatccagatccacggatgccatag

SEQ ID NO: 52076 - protein, 166 aa, Pasteurella multocida subsp. multocida str. Pm70
MSNCTPQIAIVMGSKSDWATMQEATHILDELQIPYHVEVVSAHRTPDKLFTFAETASAKGYKVIIAGAGGAAHLPGMIASKTLVPVLGVPVKSSMLSGVDSLYSIVQMPKGIPVGTLAIGPAGAANAGLLAAQILAAFDTSLLTRLTAFREKQTNSVLENPDPRMP

SEQ ID NO: 52077 - DNA, 486 bp, Lactococcus lactis subsp. lactis Il1403
  CDS (1)..(486): transl_table=11
atggcagaagtagcaattatcatgggttcgagctcagattgggcgacaatgaaagaaacagcaaaaattttagatgactttggtttagcttatgaaaaaaaggtcgtatcagcacaccgaacaccagctttgatggctgaattttcgagccaagcccgtgaggcaggttataaagttatcatcgcaggtgctggtggagccgctcatttgccaggaatggtatctgctcagactctcgttccagtcattggcgttccaataaaatcacgcgctttatctggtctggattcactttattcaattgttcaaatgccggcaggggttcctgtagcgacaatggcaattggagaggctggagcaaaaaatgctgctttatttgctttgcaacttttggcgaatacaaacgagaatttataccaaaaattgttggtctatcgggctgctgcgcaagaaatggttgaggaatcaaacaaagcattactttaa

SEQ ID NO: 52078 - protein, 161 aa, Lactococcus lactis subsp. lactis Il1403
MAEVAIIMGSSSDWATMKETAKILDDFGLAYEKKVVSAHRTPALMAEFSSQAREAGYKVIIAGAGGAAHLPGMVSAQTLVPVIGVPIKSRALSGLDSLYSIVQMPAGVPVATMAIGEAGAKNAALFALQLLANTNENLYQKLLVYRAAAQEMVEESNKALL

SEQ ID NO: 52079 - DNA, 492 bp, Streptococcus pyogenes M1 GAS
  CDS (1)..(492): transl_table=11
atgaaaactccaattatttctattatcatgggctccaaatctgactgggcaaccatgcaaaaaacggctgaagttctagacaactttggcattgcttacgagaagaaagtcgtctctgcccaccgtacgccagacctcatgttcaagcatgctgaggaagcacgtggtcgtggcatcaaaatcatcatcgcaggagcaggtggggcagctcacttgcctggtatggtggcagctaaaacaacgctgcctgttatcggtgtgcctgtcaaatcacgtgccctttcaggtttggattcgctatattccattgtgcagatgcctggcggtgtgcctgtggcaaccatggctatcggagaagcgggagcgactaacgctgccctgacagccctccgtatcctctctatcgaggaccaaaatctggctgatgcgctagctcatttccatgaggaacaaggaaaaatcgcagaggagtcaagtggtgaactcatttaa

SEQ ID NO: 52080 - protein, 163 aa, Streptococcus pyogenes M1 GAS
MKTPIISIIMGSKSDWATMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSGELI

SEQ ID NO: 52081 - DNA, 486 bp, Neisseria meningitidis MC58
  CDS (1)..(486): transl_table=11
atgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgaatatggaattggaacaaatttaa

SEQ ID NO: 52082 - protein, 161 aa, Neisseria meningitidis MC58
MIQIGIIMGSNSDWPVMRQAAQFLEEFGVEYEARVVSAHRTPDLMFQYAETARARGIKAIIAGAGGAAHLPGMVAAKTTVPVLGVPVPSKYLRGEDSLLSIVQMPKGVPVATFAIGEAGAANAALFAVSMLANETPELAQKLADFRAKQEQAVLNMELEQI

SEQ ID NO: 52083 - DNA, 1017 bp, Methanothermobacter thermautotrophicus str. Delta H
  CDS (1)..(1017): transl_table=11
gtgaatctccagatgaagcccagagtgatgatactccttggaagtgcatctgatttcaggatagccgaaaaggcaatggaaatctttgaggaactcaggataccctatgacctgagggttgcctcagcccacaggacacatgaaaaggtaaaggcaatagtctcagaggccgtgaaggcgggtgttgaggtattcataggaatagcaggactatcagcccatcttccaggcatgatatctgcaaacacccacagacccgtcataggggtccctgttgacgttaaacttggagggctcgacgccctctttgcatgttcacagatgcccttccctgcccccgtcgccactgtgggggtagacaggggagaaaacgccgcaatactcgctgcccagataatagggataggagatcccggggtaagggaaagggttgcagatctaaggagaggtttctatgaacgcgtgcggagagatgaatgtcaggtgctcaacagcatagaggggtcctactatgcacccctggaggttgaaatgcctcccattggtgataaggtcccgtcagattcccaggatgaccccatggtatctgtgatacctggcagctactctgacatgaagatagccaagaagaccaccatgttcctcgaaaggatgggtataagctatgatctgaacgtcatatcacccataaggtaccctgaaagatttgagaggtaccttgagaagatggagaacgtgaagctcttcatagccataagcggcctctctgcacatgttacgggtgctgttgttgccctcagcgacaggccggtgataggggttccctgccccctcaagatgaacggctgggactcactcctctcaatgatcaacatgccgccgggtgtacctgttggaacggtgggggtaggtaacggtggtaacgccgcaatactggctgctgaaatgcttggaatatacgatgaaaagatagaatcgaggataaagaggataaagagccgttccgttaagttctaa

SEQ ID NO: 52084 - protein, 338 aa, Methanothermobacter thermautotrophicus str. Delta H
MNLQMKPRVMILLGSASDFRIAEKAMEIFEELRIPYDLRVASAHRTHEKVKAIVSEAVKAGVEVFIGIAGLSAHLPGMISANTHRPVIGVPVDVKLGGLDALFACSQMPFPAPVATVGVDRGENAAILAAQIIGIGDPGVRERVADLRRGFYERVRRDECQVLNSIEGSYYAPLEVEMPPIGDKVPSDSQDDPMVSVIPGSYSDMKIAKKTTMFLERMGISYDLNVISPIRYPERFERYLEKMENVKLFIAISGLSAHVTGAVVALSDRPVIGVPCPLKMNGWDSLLSMINMPPGVPVGTVGVGNGGNAAILAAEMLGIYDEKIESRIKRIKSRSVKF

SEQ ID NO: 52085 - DNA, 612 bp, Halobacterium sp. NRC-1
  CDS (1)..(612): transl_table=11
atgacaaccgtctcagacctcatcgacctgttcgagaccgaagcagcagccgaccatccgcccgacgaaacgcccgacgtcggcgtcatcatgggcagcgacagcgacctggacgtgatggcgggcgcacacgacgcgctcaccgacctcgggttcaccgagctcaccgactacgacgacccgccgaccggatacacgttcgaatcctgggtcgtctccgcccaccggacgccgacactcatggacgcgtacgcgcgcacagccgccgcccggggactggacgtcatcatcgccggcgcgggcgggaaatcagccgacctcccgaacatgaccgcgtcgctcgcctaccccattccggtcgttggggtgcccgtccaggagaaatccgtgccatcagtgatcggcatgccgaccggcgcgccgatcacggccgtcgacgccgggaaatcctacaacgccggcctcgctgccgcccagttcctcgccaccgacgaccccacgctcgccgaccgactgcgcgacctccaggccgcccgccaggagggggtcgccgatgtctccgcgcgcctccacagccagggaaccgacagccttcgcagcccccagaactaa

SEQ ID NO: 52086 - protein, 203 aa, Halobacterium sp. NRC-1
MTTVSDLIDLFETEAAADHPPDETPDVGVIMGSDSDLDVMAGAHDALTDLGFTELTDYDDPPTGYTFESWVVSAHRTPTLMDAYARTAAARGLDVIIAGAGGKSADLPNMTASLAYPIPVVGVPVQEKSVPSVIGMPTGAPITAVDAGKSYNAGLAAAQFLATDDPTLADRLRDLQAARQEGVADVSARLHSQGTDSLRSPQN

SEQ ID NO: 52087 - DNA, 495 bp, Campylobacter jejuni subsp. jejuni NCTC 11168
  CDS (1)..(495): transl_table=11
atgaattttgtttctattttaatgggaagcaagagtgattatgagactatgaaagaggctgctaaaactttagaaagttttggtgtaaagtatgaacttatcatctcatcagctcatcgtagtccaaaaagaacaaaagagtatattgcaaatgctgaagaaaaaggtgtgaaggtttttatagcagcagctggaatggcagcgcatttagctggagctgttgcagcttatacaacaaaacctgttttaggagtgcctatgtcaggaagcaatcttgcaagtatggattctttgttttctacggtgcaaatgcctagtggaattcctgtaggaactttagctattggtaaggctggagcaatcaatgctgcttatttggctatgcaaattttagctatttatgatgttgatttagcacaaaagcttaaagaagatcgtcttgaaaaagaaaaaaaacttgtatctgattcaaaagaagtagaagttttattataa

SEQ ID NO: 52088 - protein, 164 aa, Campylobacter jejuni subsp. jejuni NCTC 11168
MNFVSILMGSKSDYETMKEAAKTLESFGVKYELIISSAHRSPKRTKEYIANAEEKGVKVFIAAAGMAAHLAGAVAAYTTKPVLGVPMSGSNLASMDSLFSTVQMPSGIPVGTLAIGKAGAINAAYLAMQILAIYDVDLAQKLKEDRLEKEKKLVSDSKEVEVLL

SEQ ID NO: 52089 - DNA, 486 bp, Neisseria meningitidis Z2491
  CDS (1)..(486): transl_table=11
atgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgagtatggaattggaacagatttaa

SEQ ID NO: 52090 - protein, 161 aa, Neisseria meningitidis Z2491
MIQIGIIMGSNSDWPVMRQAAQFLEEFGVEYEARVVSAHRTPDLMFQYAETARARGIKAIIAGAGGAAHLPGMVAAKTTVPVLGVPVPSKYLRGEDSLLSIVQMPKGVPVATFAIGEAGAANAALFAVSMLANETPELAQKLADFRAKQEQAVLSMELEQI

SEQ ID NO: 52091 - DNA, 534 bp, Deinococcus radiodurans R1
  CDS (1)..(534): transl_table=11
atgagtgatctttctgctgactcggcgtccccccgcgtcggcgtggtgatgggcagccgcagcgactccgagacgatgcagggcgccttggacctcctgtcgcagcttgagattccctacgaggtgcgcgtgctctcggcccaccgtacgccggggctactgtcgacctacgcggcccgcgccgagcggctgggactcgcctgcatcattgccggggcggggggggccgcgcacctgccagggatgctggcggcctttacgcgggtgccggtgctcggcgtgccggtgcagtcgcgggccctcagcggtcaggacagcttgctgagcatcgtgcagatgcctgccggtgtccccgtcgccaccttcgccatcggacaggcgggggccaaaaacgctgcgctctttgccgccgccctgctcgccaccactgatgcgggggtgcggacccggctggaggccttccgcgctgctcaaactcaagccgtgctggatgacccctatttcgacggtcatccccaggcgggcaccgaatga

SEQ ID NO: 52092 - protein, 177 aa, Deinococcus radiodurans R1
MSDLSADSASPRVGVVMGSRSDSETMQGALDLLSQLEIPYEVRVLSAHRTPGLLSTYAARAERLGLACIIAGAGGAAHLPGMLAAFTRVPVLGVPVQSRALSGQDSLLSIVQMPAGVPVATFAIGQAGAKNAALFAAALLATTDAGVRTRLEAFRAAQTQAVLDDPYFDGHPQAGTE

SEQ ID NO: 52093 - DNA, 504 bp, Xylella fastidiosa 9a5c
  CDS (1)..(504): transl_table=11
atgatctccaatcaatcccccctgctggtcggtattgtcatgggttcctcttcggattggggagcgatgcagcacgccgcacaaaagcttgatgctctcggcgttgcgtatgaagtgaaggtcgtttcggcgcatcgtactccggataaattgtttgcttatgcggagcaggctgaagggcgtggtttgcgtgccatcattgctggggccggtggcgcagcgcaccttccaggtatgttggctgctaagacgatggtgccagtgttgggggtaccaatgcagtccaaggctctgaatggtttggattcgctgttatcgatcgtacagatgccggcgggtattccagtagccacgttcgcgattggggaagctggtgcagtcaatgccgccctgtttgccgcagcgctgttggtacccgaaaatccagcaatgcgtcggatgctgactgagttccgccaacgtcagacggatgaggtgaatgctgcggacgatccacgccaatga

SEQ ID NO: 52094 - protein, 167 aa, Xylella fastidiosa 9a5c
MISNQSPLLVGIVMGSSSDWGAMQHAAQKLDALGVAYEVKVVSAHRTPDKLFAYAEQAEGRGLRAIIAGAGGAAHLPGMLAAKTMVPVLGVPMQSKALNGLDSLLSIVQMPAGIPVATFAIGEAGAVNAALFAAALLVPENPAMRRMLTEFRQRQTDEVNAADDPRQ

SEQ ID NO: 52095 - DNA, 489 bp, Streptococcus pneumoniae TIGR4
  CDS (1)..(489): transl_table=11
atgaaaccagtaatttccatcatcatgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaaaacaacccttccagtcattggtgtgccagtcaagtctcgtgctcttagtggagtggattcactctattctatcgttcagatgccgggtggggtgcctgttgcgaccatggctatcggtgaagctggagcgactaacgcagctctctttgccctccgtctcctctctgtagaagataagtccattgcggatgcacttgccaactttgctgaagaacaaggaaaaatcgcagaggagtcgtcaaatgagctcatctaa

SEQ ID NO: 52096 - protein, 162 aa, Streptococcus pneumoniae TIGR4
MKPVISIIMGSKSDWATMQKTAEVLDRFGVAYEKKVVSAHRTPDLMFKHAEEARSRGIKIIIAGAGGAAHLPGMVAAKTTLPVIGVPVKSRALSGVDSLYSIVQMPGGVPVATMAIGEAGATNAALFALRLLSVEDKSIADALANFAEEQGKIAEESSNELI

SEQ ID NO: 52097 - DNA, 480 bp, Clostridium acetobutylicum ATCC 824
  CDS (1)..(480): transl_table=11
atgaaagttgctattatatttggaagcaaatcagacactgaaaaaatgaagggtgcagctactgcgcttaaagaatttggagttgaatacaaagcttatgtattatcggctcacagagtaccagaaaaattaagtgaagttattaagagccttgaaaatgatggatttgaatgcataattgcaggtgctggtctagcagctcaccttccaggagttatagcttctcaaactacacttccagttataggagttcctataaatgcggcaattgacggacttgattctttgttttcaatagttcaaatgcccaaaaacataccggttgcaaccgtaggtatcaacaatagttataatgcaggaatgcttgcagcccaaatactttcgattaaatatcctgaaattaaagaaaagcttgttaaattcagacaagaaatgaaagagaattttataaaggataatgaagaaggagtgcaattataa

SEQ ID NO: 52098 - protein, 159 aa, Clostridium acetobutylicum ATCC 824
MKVAIIFGSKSDTEKMKGAATALKEFGVEYKAYVLSAHRVPEKLSEVIKSLENDGFECIIAGAGLAAHLPGVIASQTTLPVIGVPINAAIDGLDSLFSIVQMPKNIPVATVGINNSYNAGMLAAQILSIKYPEIKEKLVKFRQEMKENFIKDNEEGVQL

SEQ ID NO: 52099 - DNA, 522 bp, Streptococcus pneumoniae R6
  CDS (1)..(522): transl_table=11
gtgattgttgaaaaagaggaaaaaggagaagaaatgaaaccagtaatttccatcatcatgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaaaacaacccttccagtcattggtgtgccagtcaagtctcgtgctcttagtggagtggattcactctattctatcgttcagatgccgggtggggtgcctgttgcgaccatggctatcggtgaagctggagcgactaacgcagctctctttgccctccgtctcctctctgtagaagataagtccattgcggatgcacttgccaactttgctgaagaacaaggaaaaatcgcagaggagtcgtcaaatgagctcatctaa

SEQ ID NO: 52100 - protein, 173 aa, Streptococcus pneumoniae R6
MIVEKEEKGEEMKPVISIIMGSKSDWATMQKTAEVLDRFGVAYEKKVVSAHRTPDLMFKHAEEARSRGIKIIIAGAGGAAHLPGMVAAKTTLPVIGVPVKSRALSGVDSLYSIVQMPGGVPVATMAIGEAGATNAALFALRLLSVEDKSIADALANFAEEQGKIAEESSNELI

SEQ ID NO: 52101 - DNA, 474 bp, Sulfolobus tokodaii str. 7
  CDS (1)..(474): transl_table=11
atgcctaaagtagctgttattatgggtagtaaatcagactgggaatatatgaaagaagcagtagaacttttaaaacaatttggtgttgaagttgaggctagagtagtttcagcccacagaacaccagaatttatgatggaatttgctaaaaccgcatcagagaagggaatagaagttattatagctggtgcaggtggtgcggctcatttacctggtatgacagcatcattaactcatttgccagtaattggtgttccgattccttcaaagaatttgaatggcttagattctctcctctctattgttcaaatgccttatggtgtaccagtcgcgacagttgctattggtggggctaaaaatgctgcacttttggcattaagaattttaggactaaaatacccagatatagctgaaaaagttaaaaagtttatggaggatgtgaaaaatgaagtccttaacacaaaactcgattaa

SEQ ID NO: 52102 - protein, 157 aa, Sulfolobus tokodaii str. 7
MPKVAVIMGSKSDWEYMKEAVELLKQFGVEVEARVVSAHRTPEFMMEFAKTASEKGIEVIIAGAGGAAHLPGMTASLTHLPVIGVPIPSKNLNGLDSLLSIVQMPYGVPVATVAIGGAKNAALLALRILGLKYPDIAEKVKKFMEDVKNEVLNTKLD

SEQ ID NO: 52103 - DNA, 501 bp, Sinorhizobium meliloti 1021
  CDS (1)..(501): transl_table=11
gtgaccgatactacgcccccgcccgttgccatcatcatgggaagccagtcggactgggagacgatgaagaacgcggcagacacgctcgaggcgctcgacatcgcctacgaagcccggatcgtttccgcccatcgcacgcccgaccgcctggtccgcttcgccaagggcgcgcgcgacgaggggttccaggtgatcatcgccggcgcaggcggtgctgcgcatcttcccggcatgtgcgcggccatgacgccgcttccggtcttcggcgttccggtccagtcgaaagcgctttccggccaggacagcctgctgtcgatcgtgcagatgccggccggcattccggtcggcacgcttgcgatcggcaaggcgggggccatcaatgcggcacttctggccgccgccgtgctcgcgctcggtgacgaggatcttgccgaccgtctcgacgactggcgcgaacagcagaccgtatcggtcgcggaatatccggtagacgaggcatga

SEQ ID NO: 52104 - protein, 166 aa, Sinorhizobium meliloti 1021
MTDTTPPPVAIIMGSQSDWETMKNAADTLEALDIAYEARIVSAHRTPDRLVRFAKGARDEGFQVIIAGAGGAAHLPGMCAAMTPLPVFGVPVQSKALSGQDSLLSIVQMPAGIPVGTLAIGKAGAINAALLAAAVLALGDEDLADRLDDWREQQTVSVAEYPVDEA

SEQ ID NO: 52105 - DNA, 474 bp, Thermoplasma acidophilum DSM 1728
  CDS (1)..(474): transl_table=11
atgcctagggttgcggttataatgggcagttcaagcgactacgagaccatgaagcccgctgtggatttcctcagatccatgcacatagatgttgtgctcaagattgtctcagcgcacaggacacctgaatatatgtttcagttcgcgtccagcgccagagatcaaggcatagaggttataattgctggggcaggcggtgcagcgcatcttccgggtatggttgcatcgatgacaacgctgcctgttataggcgtccctgttccgagcaggaatttaaatgggctggattcgcttctttccatagtgcagatgccatccggaatacctgttgccacggtcgcgatagggaattcgaaaaatgccgccatactggcatgcaggatactctccataaagtatcctgagatcgagaaagccattaagaagtacatggatgacgagcgagacagggtgcttaacgaaaagcttgaatga

SEQ ID NO: 52106 - protein, 157 aa, Thermoplasma acidophilum DSM 1728
MPRVAVIMGSSSDYETMKPAVDFLRSMHIDVVLKIVSAHRTPEYMFQFASSARDQGIEVIIAGAGGAAHLPGMVASMTTLPVIGVPVPSRNLNGLDSLLSIVQMPSGIPVATVAIGNSKNAAILACRILSIKYPEIEKAIKKYMDDERDRVLNEKLE

SEQ ID NO: 52107 - DNA, 492 bp, Caulobacter crescentus CB15
  CDS (1)..(492): transl_table=11
atgccttcgaccacgcctcccgtcgctatcatcatgggcagccgctcggactggccgaccatgaagggcgccgccgacgcgctggacaatctgggcgtcgcctgggaggccaaggtggtctcggcgcaccggacgccccagcgcctgttcgacttcgcgacgggcgccgagaaggccggttacaaggtgatcatcgccggcgccggcggcgcggcgcacttgccgggcatggccgcctcgatgaccaacctgccggtgctgggcgtgccggtgcagtccaaggccctgtcgggcctcgatagcctgctttcgatcgtgcagatgccggggggcgttcctgtcgccaccctggcgatcggcgaggccggcgccaagaacgccggactgctcgcggcccagatcctggccctttccgatacagcgctggctggacgcctggcggccttccgcgccgcccaaaccgaaagcgtcgccgaaagcgtcgaggactga

SEQ ID NO: 52108 - protein, 163 aa, Caulobacter crescentus CB15
MPSTTPPVAIIMGSRSDWPTMKGAADALDNLGVAWEAKVVSAHRTPQRLFDFATGAEKAGYKVIIAGAGGAAHLPGMAASMTNLPVLGVPVQSKALSGLDSLLSIVQMPGGVPVATLAIGEAGAKNAGLLAAQILALSDTALAGRLAAFRAAQTESVAESVED

SEQ ID NO: 52109 - DNA, 489 bp, Listeria monocytogenes EGD-e
  CDS (1)..(489): transl_table=11
atgcctgctgtaattggtgtcattatggggagtacctcagattgggatacaatgaaaaaagcatgtgatgtattagatgaattagaaatagcttatgagaaaaaagtggtttctgctcatcgtacaccagatttaatgtttcaatatgcagaacaagcgcgggaacgtggtttgaaaattattattgctggtgctgggggcgcggcgcatttgccaggtatggttgcggcaaagacgactttgcctgttattggtgtgccaattaaatcaaaagcgttgaatggaatggattcattactttctattgtgcagatgcctggaggtgttccggtagcgacagttgctattggagaaagtggtgctgtaaatgctggacttctagccgcacaaattttatccataacagacgatgcaattactaacagattacaaaaaagacgtgctacactagaagaaacagttctagaaagtagtgattatcttggataa

SEQ ID NO: 52110 - protein, 162 aa, Listeria monocytogenes EGD-e
MPAVIGVIMGSTSDWDTMKKACDVLDELEIAYEKKVVSAHRTPDLMFQYAEQARERGLKIIIAGAGGAAHLPGMVAAKTTLPVIGVPIKSKALNGMDSLLSIVQMPGGVPVATVAIGESGAVNAGLLAAQILSITDDAITNRLQKRRATLEETVLESSDYLG

SEQ ID NO: 52111 - DNA, 489 bp, Listeria innocua Clip11262
  CDS (1)..(489): transl_table=11
atgcctgcggaaattggtgtcattatggggagtacctcagattgggatacaatgaaaaaagcatgtgatgtattggatgaacttgaaattgcttatgaaaaaaaagtcgtttctgctcatcgtacaccagatttaatgtttcaatatgcagaacaagcgcgggaacgtggtttgaaaattattattgcgggcgctggaggagcggcgcatttgccaggtatggttgctgctaaaacaactttgcctgttattggtgtgccaattaagtcaaaagcgttaagcggaatggattctctactgtccattgtacaaatgcctggtggtgttcctgttgctactgttgcaatcggtgaaagtggagcagtcaatgcgggtcttttagcggcgcaaattttatctattacaaacgatgcaattactaacagattacaaaaaagacgtgctacactagaagaaacagttctagaaagtagtgattctcttggataa

SEQ ID NO: 52112 - protein, 162 aa, Listeria innocua Clip11262
MPAEIGVIMGSTSDWDTMKKACDVLDELEIAYEKKVVSAHRTPDLMFQYAEQARERGLKIIIAGAGGAAHLPGMVAAKTTLPVIGVPIKSKALSGMDSLLSIVQMPGGVPVATVAIGESGAVNAGLLAAQILSITNDAITNRLQKRRATLEETVLESSDSLG

SEQ ID NO: 52113 - DNA, 528 bp, Nostoc sp. PCC 7120
  CDS (1)..(528): transl_table=11
atggctcccttggttggcattattatgggcagcgattcagatttgcccacaatgaaagaggcgatcgctatttgtgaggaatttggtgtagaaaatgaagtggcgatcgtttcagcccatcgcaccccagaacggatggtggaatatgcccaaacagcccatcatcggggtattaaggtgattattgctggtgctggtggtgccgcccatcttcccggcatggtagcatctttaactcctctaccagtgattggtgtgccagtcgctacacgaaacttacaaggtgtggattctttatattcaattgtacaaatgcctgggggtattcctgtggctacggtggcgatcggtaacgccaaaaatgctggactattagctgtgcaaatcctcgctactcaacagccagaattattaactaaagtccaagcataccgtcaaaacctatctgaatcagtaataacaaagcaagcaaagttagaacaactaggttacaagcagtatttggaacaggaaatatctggaaaatag

SEQ ID NO: 52114 - protein, 175 aa, Nostoc sp. PCC 7120
MAPLVGIIMGSDSDLPTMKEAIAICEEFGVENEVAIVSAHRTPERMVEYAQTAHHRGIKVIIAGAGGAAHLPGMVASLTPLPVIGVPVATRNLQGVDSLYSIVQMPGGIPVATVAIGNAKNAGLLAVQILATQQPELLTKVQAYRQNLSESVITKQAKLEQLGYKQYLEQEISGK

SEQ ID NO: 52115 - DNA, 510 bp, Ralstonia solanacearum GMI1000
  CDS (1)..(510): transl_table=11
atgaccgcatcgcaatccgcgccgctcgtcggcgtcgtcatgggttccagctccgactgggacgtcatgcagcacgccgtggtcctgctcaaggaattcgacattccgttcgaggcgcaggtggtctcggcgcaccgcatgccggacgacatgttccgctacgccgaggccgcacgcggccggggcctgcgcgccatcatcgccggtgccggcggcgcggcgcacctgccgggcatgatcgccgccaagaccatcgtgccggtgttcggcgtgccggtgccgtccaagtacctgcgcggcgaagactcgctgctgtccatcgtgcagatgcccaagggcattccggtggcgacctttgccatcggcgaggcgggcgcggccaacgcggcgctgtcggccatcgccatgctggcgaccaccgacgatgcgctggcggccaagctcgaagccttccgcgcccggcagaccgaagtggcgcgcggcatgacgctgcccgtgcacagtgcttaa

SEQ ID NO: 52116 - protein, 169 aa, Ralstonia solanacearum GMI1000
MTASQSAPLVGVVMGSSSDWDVMQHAVVLLKEFDIPFEAQVVSAHRMPDDMFRYAEAARGRGLRAIIAGAGGAAHLPGMIAAKTIVPVFGVPVPSKYLRGEDSLLSIVQMPKGIPVATFAIGEAGAANAALSAIAMLATTDDALAAKLEAFRARQTEVARGMTLPVHSA

SEQ ID NO: 52117 - DNA, 501 bp, Agrobacterium tumefaciens str. C58
  CDS (1)..(501): transl_table=11
gtgacagcagaaacgccccccgtcgccatcatcatgggcagccagtccgactgggaaaccatgaagaacgccgccgatacgctggatgcgctcgacgtggaatatgaagcccgcatcatttccgcccaccgcaccccggaccggctttatgactttgccaatggcgcaaaggacgagggtttcaaggtcattatcgccggtgcgggcggggccgcccacctgcccggcatgacggccgccatgacgccgcttccggtcttcggggttcctgtgcagtcgaagaccatgtccggtcaggacagcctctattccatcgtgcagatgcccgccggcattcccgtcggcacgcttgccatcggcaaggccggtgccatcaatgccgcccttctggccgctgcggtcctggcgctcagcgacgaggacctggccgaccggctggatgcctggcgtgcccgccagtcggctgccgtcgcggaatatccgatggacagcgcccagtga

SEQ ID NO: 52118 - protein, 166 aa, Agrobacterium tumefaciens str. C58
MTAETPPVAIIMGSQSDWETMKNAADTLDALDVEYEARIISAHRTPDRLYDFANGAKDEGFKVIIAGAGGAAHLPGMTAAMTPLPVFGVPVQSKTMSGQDSLYSIVQMPAGIPVGTLAIGKAGAINAALLAAAVLALSDEDLADRLDAWRARQSAAVAEYPMDSAQ

SEQ ID NO: 52119 - DNA, 543 bp, Brucella melitensis 16M
  CDS (1)..(543): transl_table=11
ttgtcttttcaagaccttcctcatgccaaccgaaaagccaagcaggaaagaccgatgagcgttgatgtcgccattatcatgggaagccagtccgattgggaaaccatgcaccatgcagccgacacattggaggcgctcggcatctccttcgacgcacggatcgtttccgcccatcgcacccctgacaggctggtcgccttcgccaagggggcgaaagcggaaggcttcaaggtcatcatcgcaggcgccggcggcgcggcccacctgcccggcatggccgctgccatgacaccgcttcccgtctttggcgttccagttcaatccaaggcgctttcgggccaggattcgctactctccatcgtacagatgccagcgggtattcccgtcggcactctcgccatcggccgtgcaggcgcggtcaatgccgcccttctcgccgccgccgttctggcgctatatgatgaagcacttgccgcccgtcttgatgaatggcgcaaggcgcagaccgaaagcgttgcagaacgcccctcgaacgaagcctga

SEQ ID NO: 52120 - protein, 180 aa, Brucella melitensis 16M
MSFQDLPHANRKAKQERPMSVDVAIIMGSQSDWETMHHAADTLEALGISFDARIVSAHRTPDRLVAFAKGAKAEGFKVIIAGAGGAAHLPGMAAAMTPLPVFGVPVQSKALSGQDSLLSIVQMPAGIPVGTLAIGRAGAVNAALLAAAVLALYDEALAARLDEWRKAQTESVAERPSNEA

SEQ ID NO: 52121 - DNA, 1278 bp, Rattus norvegicus
  CDS (1)..(1278)
atggcgacagctgaagtactgaacatcgggagaaagctgtatgagggtaaaacaaaggaagtctatgaattgttagacagtccaggaagagtcctcctgcagtccaaggaccagattacagcaggaaatgcagctagaaagaaccacctggaaggcaaagccgccatctccaataagatcaccagctgcatatttcagttgttacaggaagctggtataaaaactgctttcaccaagaaatgtggggagactgctttcattgcaccccagtgtgaaatgattccaattgagtgggtatgccgaagaatcgccactggatcttttctcaaaaggaaccctggtgtgaaggaggggtataggttttatccaccaaaagtagagatgttcttcaaggatgatgccaataacgacccacaatggtctgaggagcaactcatcgctgcaaaattttgttttgctggactcgttatagggcaaactgaagtggatatcatgagtcatgccacacaagctatttttgaaattctggagaaatcctggctgccccaaaactgtacgctggttgatatgaagattgagtttggcgttgatgtaaccaccaaagagattgttcttgctgatgtcatagataatgattcctggagactatggccatcaggagatcggagccagcagaaagacaaacagtcttatcgggatctcaaagaagtaactccggaaggactccagatggtaaagaagaactttgagtgggttgcagaccgagtggagttgcttctcaagtcaaacagtcagtgcagggtggtagtgctgatggggtcgacctctgaccttggtcactgtgaaaaaattaagaaggcttgtggaaactttgggattccatgtgaacttagagtaacatctgcacataaaggaccagatgaaactttgaggattaaagcagaatatgaaggggatggcatacctactgtatttgtcgcagtggcgggcaggagcaatggactgggcccagtgatgtctggtaatactgcatacccggttatcagctgtcccccaatcacagcagactggggtgctcaggatgtgtggtcatctctgcgactgcccagtggtattggctgttcaactatactttctccagaaggatcagcccagtttgctgctcagatatttgggttaaacaaccatttggtgtgggccaaacttcgagcgagcaaactgaacacgtggatatccttaaagcaggctgataagaaaatcagagagtgcaatttgtaa

SEQ ID NO: 52122 - protein, 425 aa, Rattus norvegicus
MATAEVLNIGRKLYEGKTKEVYELLDSPGRVLLQSKDQITAGNAARKNHLEGKAAISNKITSCIFQLLQEAGIKTAFTKKCGETAFIAPQCEMIPIEWVCRRIATGSFLKRNPGVKEGYRFYPPKVEMFFKDDANNDPQWSEEQLIAAKFCFAGLVIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVADRVELLLKSNSQCRVVVLMGSTSDLGHCEKIKKACGNFGIPCELRVTSAHKGPDETLRIKAEYEGDGIPTVFVAVAGRSNGLGPVMSGNTAYPVISCPPITADWGAQDVWSSLRLPSGIGCSTILSPEGSAQFAAQIFGLNNHLVWAKLRASKLNTWISLKQADKKIRECNL

SEQ ID NO: 52123 - DNA, 489 bp, Pyrobaculum aerophilum str. IM2
  CDS (1)..(489): transl_table=11
atgaaggttgcggttataatggggtcgataaacgaccttgaggtcatgaaagaggcgcttgaggtcttggagcagctgggcattccctacgaggcgcgggtcgtcagcgcccacaggacgccggatttcatgtaccaattcgccaaggaggccgaggggaaattcgacgtgataatagccggcgccggcggggcggcccacctccccggcatgaccgcctccctaacgccgctgccggtcataggggtccccatccccacaaaacacttaggcgggctggactccctgttgtcaattgtacaaatgccccggggcactcccgtcgccacagtggccataggcaacgccgccaacgccgcctatctcgccgccaggatactgggcataaaatacccagaggtgaggcagaaggttaaagaacacatggaaaagatgagagaagaggtactgtccaagtccttcataaagtccttttcactagacgtttaa

SEQ ID NO: 52124 - protein, 162 aa, Pyrobaculum aerophilum str. IM2
MKVAVIMGSINDLEVMKEALEVLEQLGIPYEARVVSAHRTPDFMYQFAKEAEGKFDVIIAGAGGAAHLPGMTASLTPLPVIGVPIPTKHLGGLDSLLSIVQMPRGTPVATVAIGNAANAAYLAARILGIKYPEVRQKVKEHMEKMREEVLSKSFIKSFSLDV

SEQ ID NO: 52125 - DNA, 480 bp, Clostridium perfringens str. 13
  CDS (1)..(480): transl_table=11
atgaaggtagcaatattttttggaagtaaatcagatatagatgttatgaagggagcaggaaatgctcttaaagagtttggaattccttataatgcttatattttatcagctcatagggttccagaaaaacttattgaaactttagaaaaaattgagaaagaaggctgtgaagtaataatagctggagcaggattagctgctcatcttcctggagttatagcttctcatactatacttcctgtaataggagttccagtgagagcagcagtagagggaatggatgcattactatcaatagttcagatgccaaaatcaattcctgtagccactgttggaataaataatagttataatgcaggaatgttagcagtccaaatgctttcattaaaatatccagaactaagagaaaaattaattcaatttagaatcgacatgaaacataaattcatagcagaaaatggagaaggagtggaattataa

SEQ ID NO: 52126 - protein, 159 aa, Clostridium perfringens str. 13
MKVAIFFGSKSDIDVMKGAGNALKEFGIPYNAYILSAHRVPEKLIETLEKIEKEGCEVIIAGAGLAAHLPGVIASHTILPVIGVPVRAAVEGMDALLSIVQMPKSIPVATVGINNSYNAGMLAVQMLSLKYPELREKLIQFRIDMKHKFIAENGEGVEL

SEQ ID NO: 52127 - DNA, 513 bp, Pyrococcus furiosus DSM 3638
  CDS (1)..(513): transl_table=11
atgcctaaagttggaatcataatgggtagtgattcagatttgcccgtaatgaaggaagcagctaaagttctggaagagtttggagtagattatgaaataacaatagtctcggcacacagaacaccagagagaatgtacgagtatgcaaaaactgccagagagaggggaattgaagttattattgcaggtgctggaggtgcagcccatcttcctggaatgacggcctcgataacaactcttcctgtaataggagttccagttaaaagtagggccttgaatggactagattctctgctttccatagttcaaatgccagcaggtgttcctgttgctactgtagccataaacaatgctaagaatgctgctttacttgctctcagaattctttctataaagtatccagagattgccgaaaaactagaaaagtacaaagaagagatgagaaaaacagttgaggaaaaagctaaaaagctcgaagaggttggttggaaagaatatctgggagaggaatga

SEQ ID NO: 52128 - protein, 170 aa, Pyrococcus furiosus DSM 3638
MPKVGIIMGSDSDLPVMKEAAKVLEEFGVDYEITIVSAHRTPERMYEYAKTARERGIEVIIAGAGGAAHLPGMTASITTLPVIGVPVKSRALNGLDSLLSIVQMPAGVPVATVAINNAKNAALLALRILSIKYPEIAEKLEKYKEEMRKTVEEKAKKLEEVGWKEYLGEE

SEQ ID NO: 52129 - DNA, 498 bp, Corynebacterium glutamicum ATCC 13032
  CDS (1)..(498): transl_table=11
gtgggtcctctagttggtttgatcatgggttcggattcggattgggacactgtagcgccagctgcagaggtactcgctgagtttggcattccttttgaagtcggagttgtctctgcacaccgcaccccagagaagatgctcaactacgcaaagactgcacatgagcgcggcatcaagacgatcatcgcgtgtgctggcggcgctgcacacctgccaggcatggtggctgcagcaactccacttccagtcatcggtgttccacgcgcattgaaggatctcgacggtttggattccttgctgtccatcgtccagatgccaggcggcgttccagtcgccactgtctccatcggtggcgcgaagaatgcaggcctacttgccgttcgtattctcggtgctggtgatccttctttggtcacgaagatggccgattaccaagagaatatggcgaaggaagttgaagccaaggacgaagcactgaagaagcgcttgctcggctaa

SEQ ID NO: 52130 - protein, 165 aa, Corynebacterium glutamicum ATCC 13032
MGPLVGLIMGSDSDWDTVAPAAEVLAEFGIPFEVGVVSAHRTPEKMLNYAKTAHERGIKTIIACAGGAAHLPGMVAAATPLPVIGVPRALKDLDGLDSLLSIVQMPGGVPVATVSIGGAKNAGLLAVRILGAGDPSLVTKMADYQENMAKEVEAKDEALKKRLLG

SEQ ID NO: 52131 - DNA, 474 bp, Fusobacterium nucleatum subsp. nucleatum ATCC 25586
  CDS (1)..(474): transl_table=11
atgaaagtaggaattatatttggtagtaaatcagatgttgatgtaatgaagggagcagcagactgtttaaaaaagtttgggatagagtattctgcacatgttttatctgcacatagagttccagaacttttagaagaaactttggaaaaatttgaaaaagaagactatggagttatcattgctggagcaggacttgcagcacatttaccaggagttattgcttcaaaaactgttttacctgtgattggagtacctataaaagcagcagtagaaggtttagatgcactattttcaatagtacaaatgcctaaatcaattcctgttgcaactgtggcaattaataattcatataatgcaggaatgttagcagtagaaatattagcagttggaaataaagaattaagagcaaaacttttagagtttagaaaagaaatgaaagaagatttcaaaaaaaatatatatatggaattgtaa

SEQ ID NO: 52132 - protein, 157 aa, Fusobacterium nucleatum subsp. nucleatum ATCC 25586
MKVGIIFGSKSDVDVMKGAADCLKKFGIEYSAHVLSAHRVPELLEETLEKFEKEDYGVIIAGAGLAAHLPGVIASKTVLPVIGVPIKAAVEGLDALFSIVQMPKSIPVATVAINNSYNAGMLAVEILAVGNKELRAKLLEFRKEMKEDFKKNIYMEL

SEQ ID NO: 52133 - DNA, 612 bp, Streptococcus pyogenes MGAS8232
  CDS (1)..(612): transl_table=11
atgctaaagcacctagtcgccctgacgtgggttcatcttcgaaatcaaagatttcggacttaccgcatatttttctacggaaagtttcgacaagtcgaaacgcccctttatatcttaattatgaaaactccaattatttctattatcatgggctccaaatctgactgggcaaccatgcaaaaaacggctgaagttctagacaactttggcattgcttacgagaagaaagtcgtctctgctcaccgcacgcccgacctcatgttcaagcatgctgaggaagcacgtggtcgtggcatcaaaatcatcatcgcaggagcaggtggagcagctcacttgcctggtatggtagcagctaaaacaacgctgcctgttatcggtgtgcctgtcaaatcacgtgcccttttaggtttggattcactctattcgattgtgcagatgcctggcggtgtgcctgtggcaaccatggctatcggagaagcgggagcgactaacgctgccctgacggccctccgtattctctccatcgaggatcaaaatctggctgatgcgctagctcatttccatgaggaacaaggaaaaatcgcagaggagtcaagtggtgaactcatttaa

SEQ ID NO: 52134 - protein, 203 aa, Streptococcus pyogenes MGAS8232
MLKHLVALTWVHLRNQRFRTYRIFFYGKFRQVETPLYILIMKTPIISIIMGSKSDWATMQKTAEVLDNFGIAYEKKVVSAHRTPDLMFKHAEEARGRGIKIIIAGAGGAAHLPGMVAAKTTLPVIGVPVKSRALLGLDSLYSIVQMPGGVPVATMAIGEAGATNAALTALRILSIEDQNLADALAHFHEEQGKIAEESSGELI

SEQ ID NO: 52135 - DNA, 486 bp, Methanopyrus kandleri AV19
  CDS (1)..(486): transl_table=11
atggtcgacgttctgatcgttctgggaagtaggagcgatcgagacgtcgccgagaaggccgcgaaggtgctcgaccgagccggcgtcgactacaacgtgcgggtggcctccgcccaccggacgccggagcgtatcgacgagctgatcgaggagtacgagcccgacgtgaaggtgtacatcgcgatcgcgggtctggccgctcacctcccgggtgtgatcgccgccaagaccctgaagcccgtgatcgccgtgccggtggaggcgaagctgtgtggtctggacgcgctcctctcgaccgtgcagatgcccccgggtgtaccggtggcggttgtcggcgtggatcgcggggagaacgcggcgctcttggccttgcagatcctggcactggaggacgaggacgtccggtccttcctggaggagtaccgggaggagatgaagaagcaggtggcccgggacgacgacacgatcaaggagcgtttccggtga

SEQ ID NO: 52136 - protein, 161 aa, Methanopyrus kandleri AV19
MVDVLIVLGSRSDRDVAEKAAKVLDRAGVDYNVRVASAHRTPERIDELIEEYEPDVKVYIAIAGLAAHLPGVIAAKTLKPVIAVPVEAKLCGLDALLSTVQMPPGVPVAVVGVDRGENAALLALQILALEDEDVRSFLEEYREEMKKQVARDDDTIKERFR

SEQ ID NO: 52137 - DNA, 396 bp, Methanosarcina acetivorans C2A
  CDS (1)..(396): transl_table=11
atggtcgacatctcactgattatgggctctgagtccgacagatcaatcgccaaccgcgcggtagctgtacttgaaaagagcaaatatacttacgaagtaatggttatctctgcccacagaaaccccgaagaacttgatagctatatttcaggctcggatgcaaaagtctttatcactatagccggtctatcggcagctctcccgggggttgttgcttccagaacaaaaaaacctgtaataggtgtacccgtaagcgcaaaactcggcgggcttgatgcccttctctccatagcccagatgcccccgggagtacctgttggaagcgtggggatcgacaatggagcaaacggcgcatatcttgccctgagaattctggatttaatcgaaaacccttaa

SEQ ID NO: 52138 - protein, 131 aa, Methanosarcina acetivorans C2A
MVDISLIMGSESDRSIANRAVAVLEKSKYTYEVMVISAHRNPEELDSYISGSDAKVFITIAGLSAALPGVVASRTKKPVIGVPVSAKLGGLDALLSIAQMPPGVPVGSVGIDNGANGAYLALRILDLIENP

SEQ ID NO: 52139 - DNA, 468 bp, Thermoanaerobacter tengcongensis MB4
  CDS (1)..(468): transl_table=11
ttgaaaatgccaaaaattgctgtggtagtgggtagcaagtcagacctccctgtaattgaaaggtgtacagatattttagatgaatttggaatttcatatgacgtaaaagttctgtctgcccatcgaactccttttgagacgcaggaatttgcagtagaagcagagaaatattacgaccttataatagcggcggcaggaaaagctgctcatctcccaggggtcattgcttcttacactttacttcctgtcattgggcttcccatcaagtcttccactctagatggactggattctctcctttcaattgtgcagatgccaaaaggagttccagtagctacggttgctatagatggagctgagaatgctgctcttttagcctgtcatattctctctttgaagtatccccatctaaaagaaaagcttgctaattacagggagaaaatggcggaggaagtgttaaataattaa

SEQ ID NO: 52140 - protein, 155 aa, Thermoanaerobacter tengcongensis MB4
MKMPKIAVVVGSKSDLPVIERCTDILDEFGISYDVKVLSAHRTPFETQEFAVEAEKYYDLIIAAAGKAAHLPGVIASYTLLPVIGLPIKSSTLDGLDSLLSIVQMPKGVPVATVAIDGAENAALLACHILSLKYPHLKEKLANYREKMAEEVLNN

SEQ ID NO: 52141 - DNA, 543 bp, Streptomyces coelicolor A3(2)
  CDS (1)..(543): transl_table=11
atgagccaggccagcccggtgaccccggtcgtgggcatcgtcatggggtcggactccgactggcccgtcatggaggccgccgccaaggccctcgacgagttcgaggtcccctacgaggtcgacgtcgtctccgcgcaccgcatgccgcacgagatgatcgcgtacggcgagcaggccgccggacgcggcctcaaggcgatcatcgcgggggccgggggcgccgcccacctgcccggcatgctcgcctcggtcacgccgctgccggtcatcggcgtcccggtgccgctgaagtacctggacggcatggacagcctgctgtccatcgtgcagatgccggccggcgtcccggtggccacggtctccgtcggcggcgcccgcaacgccggtctgctggccgcccgcatcctcgccgcccacgacgaggaactgctcggccggatgcgcgagttccagcaggacctcaacgaccaggccaccgagaagggcaagcggctgcgcaccaaggtcgagggctcagcggccggcttcggattcggaaagtga

SEQ ID NO: 52142 - protein, 180 aa, Streptomyces coelicolor A3(2)
MSQASPVTPVVGIVMGSDSDWPVMEAAAKALDEFEVPYEVDVVSAHRMPHEMIAYGEQAAGRGLKAIIAGAGGAAHLPGMLASVTPLPVIGVPVPLKYLDGMDSLLSIVQMPAGVPVATVSVGGARNAGLLAARILAAHDEELLGRMREFQQDLNDQATEKGKRLRTKVEGSAAGFGFGK

SEQ ID NO: 52143 - DNA, 510 bp, Methanosarcina mazei Go1
  CDS (1)..(510): transl_table=11
atgactgatgttgtaataatccttggcagcaaatccgataaagaagtagcaagaaaggcaaccgaagtctttgacaggtttggtattgaatataccatcactgttgcatccgcacacaggacccctgcgaggcttgctgaaataattgaaactgcgcataaaaccgacgtaaaggcatttattgctattgccgggctctcagcccatcttccaggagttgtggcttcaagcactataaaacctgtaatcggagtccctgtaaactcagcacttgatgggattgacgccctcctgtctattgcccagatgcctacgggaattccggttgcctgtgtgggaatcggaagaggggataatgctgcaattcttgccgttcagctgctggcagtggaaaacggggagcttgcggaaaagctttcgaattatcgaaaagagcttgtcgagatgattgagaaggacgcagaaagcttgatggatgagcttgtcactgaaggcagggcagcaagctga

SEQ ID NO: 52144 - protein, 169 aa, Methanosarcina mazei Go1
MTDVVIILGSKSDKEVARKATEVFDRFGIEYTITVASAHRTPARLAEIIETAHKTDVKAFIAIAGLSAHLPGVVASSTIKPVIGVPVNSALDGIDALLSIAQMPTGIPVACVGIGRGDNAAILAVQLLAVENGELAEKLSNYRKELVEMIEKDAESLMDELVTEGRAAS

SEQ ID NO: 52145 - DNA, 396 bp, Methanosarcina mazei Go1
  CDS (1)..(396): transl_table=11
atggttgatatttcactgattatgggttctgagtccgacagggcaatcgccaaccgtgcggtttcagtaattgaaaaaaccaggtacacttacgaagtaatggtcatttctgcccacagaaaccctgacgagcttgatatctatatatcaaatacggacgcaaaagtctttattaccatagcgggtttgtcagcagctcttcccggagtcgtggcctccaagactaaaaaacctgtcataggcgtgcctgtaagtgcaaaactcggcgggcttgacgcccttctttccatagcccagatgcctccgggagtgcctgtcggaagtgtaggaattgacaacggggcaaatggggcgtaccttgcccttaggatcctggatttaattgaaaatccctga

SEQ ID NO: 52146 - protein, 131 aa, Methanosarcina mazei Go1
MVDISLIMGSESDRAIANRAVSVIEKTRYTYEVMVISAHRNPDELDIYISNTDAKVFITIAGLSAALPGVVASKTKKPVIGVPVSAKLGGLDALLSIAQMPPGVPVGSVGIDNGANGAYLALRILDLIENP

SEQ ID NO: 52147 - DNA, 504 bp, Xanthomonas axonopodis pv. citri str. 306
  CDS (1)..(504): transl_table=11
atgacctccaaccactccgcgccgctggtcggcatcgtgatgggttcccgttcggattgggagaccatgcaacacgcagctcagaagctcgacgcgctgggcgtgccgtacgaagtcaaggtggtctcggcgcaccgcaccccggacgtcttgttcgcctacgccgaacaggcgggcgcccgtggactgcgcgcgatcatcgccggcgccggcggcgcggcgcatctgccgggcatgctggctgccaagactgcagtgccggtgcttggtgtgccggtgcagtccaaggcgcttaacggcatggattcgctgctgtcgatcgtgcagatgccggccggcattccggtggccaccttcgccatcggcaatgcgggtgcggccaatgcggcgttgtttgcggcggccatgctggcgccggagcagacgcagatcggtcaggcgctggcgcagttccgcgccaagcagaccgacgatgtcatggccagcgacgacccgcgccaatga

SEQ ID NO: 52148 - protein, 167 aa, Xanthomonas axonopodis pv. citri str. 306
MTSNHSAPLVGIVMGSRSDWETMQHAAQKLDALGVPYEVKVVSAHRTPDVLFAYAEQAGARGLRAIIAGAGGAAHLPGMLAAKTAVPVLGVPVQSKALNGMDSLLSIVQMPAGIPVATFAIGNAGAANAALFAAAMLAPEQTQIGQALAQFRAKQTDDVMASDDPRQ

SEQ ID NO: 52149 - DNA, 528 bp, Chlorobium tepidum TLS
  CDS (1)..(528): transl_table=11
atgacacaagtttcctttgacgcacaggcgccgctggtcggcatcctgatgggttccgattccgatttcgacatcatgaaagaggccgccacggtgctcaacgagttcggcattccgtttgaaatatcggtcatctcggcgcaccgaacgccgggcgatctcgaagcctacgcctcctcggcagaggagcgcggcctgaaagcgatcatcgccggagctggcggtgcggcacatctgccgggcgtcacggcggccatgactcccctgccggtcatcggcgtgccgatctacagcaaaaagctcagcggccaggattcgctctacgccatcgtgcagatgcccgccggaattcccgtagccaccgtcggcatcgacaacgcccgcaacgccgcgctgctcgccgtgcagatgctcgccctgtgcgacgccagtctgatgcagaagctcagggagttccgacagaagcttgccgaagcctcgcgccagaagaccgccaaaatccgggaaaaactgcgtgcgaacggctga

SEQ ID NO: 52150 - protein, 175 aa, Chlorobium tepidum TLS
MTQVSFDAQAPLVGILMGSDSDFDIMKEAATVLNEFGIPFEISVISAHRTPGDLEAYASSAEERGLKAIIAGAGGAAHLPGVTAAMTPLPVIGVPIYSKKLSGQDSLYAIVQMPAGIPVATVGIDNARNAALLAVQMLALCDASLMQKLREFRQKLAEASRQKTAKIREKLRANG

SEQ ID NO: 52151 - DNA, 492 bp, Thermosynechococcus elongatus BP-1
  CDS (1)..(492): transl_table=11
atgggcagtgattccgatttgcccaccatgcagggggcgatcgccatctgtgaacgctttcgcattccccatgaagtcgctatcctctcagctcaccgcactcccctggcaatggcagaatttgctcagcatgcccatcagcggggcctaaaagtcattattgccggtgccggcggtgctgctcacttgccgggcatgatagcttccctgacccccctacccgtgattggcgtccccgtgccgagccgccatttgcagggggtggactccctctactcaattgtgcagatgccggctgggattcctgtcgcaacggttgccattggcaatgcccaaaatgcaggtctattggccgtccaactgttggccagtcatgatccaaccttgctggagcaagtgattgcctatcgtcaagaattagcagccaccgtgagcgccaagaatcaaaaactgcaaacactgggggctagcgcttatctgcaacagcagtaa

SEQ ID NO: 52152 - protein, 163 aa, Thermosynechococcus elongatus BP-1
MGSDSDLPTMQGAIAICERFRIPHEVAILSAHRTPLAMAEFAQHAHQRGLKVIIAGAGGAAHLPGMIASLTPLPVIGVPVPSRHLQGVDSLYSIVQMPAGIPVATVAIGNAQNAGLLAVQLLASHDPTLLEQVIAYRQELAATVSAKNQKLQTLGASAYLQQQ

SEQ ID NO: 52153 - DNA, 489 bp, Streptococcus agalactiae 2603V/R
  CDS (1)..(489): transl_table=11
atgcaaccaattatttctattatcatgggttccaaatccgactggacaaccatgcaaaaaacggctgaagttctagataactttggcattgcttacgagaagaaagtcgtctctgcccaccgtacgccagacctcatgttcaagcatgctgaggaggcgcgtggtcgtggtatcaagattatcatcgctggagcaggtggagcagcccacttgccgggtatggtagcagctaaaacaaccctgcctgttatcggtgtgcctgtcaaatcacgtgccctctcaggtttggattcgctctactctattgtgcagatgcctggtggtgtgcctgtggcgaccatggctatcggagaagcaggagcgactaacgctgccctgacagccctccgtatcctctctatcgaggatcaaaatctggctgatgcgctagctcatttccatgaggaacaaggaaaaatcgcagaggagtcaagcaatgaactcatttaa

SEQ ID NO: 52154 - protein, 162 aa, Streptococcus agalactiae 2603V/R
MQPIISIIMGSKSDWTTMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSNELI

SEQ ID NO: 52155 - DNA, 492 bp, Oceanobacillus iheyensis HTE831
  CDS (1)..(492): transl_table=11
atggctcaagtaggggttattatgggaagtatttccgactgggaaacgatgcagtatacttgtaatgtgcttgatgaattacagatctcttatgagaaagaagtgatatccgcacatcgtactccggatgacatgtttgcttactcgaaacaagctcgtagtaaagggctaaaggttattattgctggggcagggggagcagcacacttaccaggaatggtagcttcacaaacaacgttacccgttataggtgtaccagttgaaagtaaatcattacaaggcttagattccctgttatctattgtgcaaatgcctggtggagtaccaaccgctacagttgcaattgggaaagccggagccaaaaatgctggtattcttgcggcacagattattagcacttttgatgaaggtgcagagaaatctctagagaaatatcgggaagaaatgcgagaatctgtaaaagaaatgagggaaaatcttgcagactactaa

SEQ ID NO: 52156 - protein, 163 aa, Oceanobacillus iheyensis HTE831
MAQVGVIMGSISDWETMQYTCNVLDELQISYEKEVISAHRTPDDMFAYSKQARSKGLKVIIAGAGGAAHLPGMVASQTTLPVIGVPVESKSLQGLDSLLSIVQMPGGVPTATVAIGKAGAKNAGILAAQIISTFDEGAEKSLEKYREEMRESVKEMRENLADY

SEQ ID NO: 52157 - DNA, 507 bp, Bifidobacterium longum NCC2705
  CDS (1)..(507): transl_table=11
atgataatggcaaatgaatccaagcccgaagtcgcggtggtcatgggatcctccagcgactgggagaccatgaagcgtgcctgcgatattctcgaccagttcggtgtcgtctaccacaagcaggtcatttccgcgcaccgcacgcccgagctcatggccgagttcgcgcacaatgcccgcgccaatggcctgaaggccattatcgccggtgccggcggtgccgcccacctgccgggcatgatcgccgcgcagaccacgctgcccgtaatcggcgtgcccgtgcgctcccacgccctgtccggctgggattcgctgctgtccatcgtgcagatgcctggcggcatcccggtggccaccaccgccgtcggcaactccggtgccaccaacgccggcctgctcgccgtgcagatgctctccgccttcgagccggaactggccgacaagcttgaggattaccgtaacgaactgaaggaaaaggtggccgaatccaatgcccagcttgtctga

SEQ ID NO: 52158 - protein, 168 aa, Bifidobacterium longum NCC2705
MIMANESKPEVAVVMGSSSDWETMKRACDILDQFGVVYHKQVISAHRTPELMAEFAHNARANGLKAIIAGAGGAAHLPGMIAAQTTLPVIGVPVRSHALSGWDSLLSIVQMPGGIPVATTAVGNSGATNAGLLAVQMLSAFEPELADKLEDYRNELKEKVAESNAQLV

SEQ ID NO: 52159 - DNA, 492 bp, Shewanella oneidensis MR-1
  CDS (1)..(492): transl_table=11
atgcaagcccttgttgctgttgttatgggttctaagagtgattggcccacaatggaagccgccgctgagatcatggataaactgcaagtgccttaccatgttgaagttgtatcagcccatagaacgccagataaactgatggagtttgcagccggtgccgctgaccgtggttttaaaattattatcggtggtgcgggcggtgccgcgcacttacccggtatgatcgcctctaaaactcgcttacccgtattaggtgtacccgtgcaaagtaaagcactctcaggcatggatagcttactgtctatcgtgcaaatgcccaaagggatcgctgtaggcaccttagcaattggtactgctggtgcctttaacgccggtttactcgcctgccaaattttagccaataacgatgtagcgcttgctgctcgtttagacgccttcagagaagaacaaactcgtgctgtgctggataatcccgatccgagggaagtctaa

SEQ ID NO: 52160 - protein, 163 aa, Shewanella oneidensis MR-1
MQALVAVVMGSKSDWPTMEAAAEIMDKLQVPYHVEVVSAHRTPDKLMEFAAGAADRGFKIIIGGAGGAAHLPGMIASKTRLPVLGVPVQSKALSGMDSLLSIVQMPKGIAVGTLAIGTAGAFNAGLLACQILANNDVALAARLDAFREEQTRAVLDNPDPREV

SEQ ID NO: 52161 - DNA, 489 bp, Streptococcus mutans UA159
  CDS (1)..(489): transl_table=11
atgaaaccacttatttccattatcatgggctccaaatccgactggagcactatgcaaaaaaccgctcaagttttggataacttcggcgtggcttatgaaaagaaagtcgtctcagcccaccgcacaccagacctcatgttcaaacatgcagaaaaagcccgcagccgcggcatcaaggtcatcattgcaggtgcaggcggtgccgcgcatttaccgggtatggtggcagctaaaacaacactgcctgttatcggtgtacctgttaaatcacgcgccctcagcggcttggattcgctctattccattgtgcagatgccgggtggtgtgcctgtggcaactatggccattggtgaagcgggagcgaccaacgctgccctgacagccctgcgtatcttggccattgaagaccaagacttggcagccgcgttagcagatttcgcagaggaacagggaaaaatcgcagaggagtcaacgaatgaactcaactaa

SEQ ID NO: 52162 - protein, 162 aa, Streptococcus mutans UA159
MKPLISIIMGSKSDWSTMQKTAQVLDNFGVAYEKKVVSAHRTPDLMFKHAEKARSRGIKVIIAGAGGAAHLPGMVAAKTTLPVIGVPVKSRALSGLDSLYSIVQMPGGVPVATMAIGEAGATNAALTALRILAIEDQDLAAALADFAEEQGKIAEESTNELN

SEQ ID NO: 52163 - DNA, 492 bp, Streptococcus agalactiae NEM316
  CDS (1)..(492): transl_table=11
atgaaaactccaattatttctattatcatgggctccaaatccgactggggaaccatgcaaaaaacggctgaagttctagataactttggcattgcttacgagaagaaagtcgtctctgcccaccgtgcgccagacctcatgttcaagcatgctgaggaagcacgtggccgtggtatcaaaatcatcatcgctggagcaggtggggcagctcacttgcctggtatggtggcagctaagacaacactacctgttattggtgtgccggtcaaaacacgtgccctttcaggtttggattcgctctactctattgtgcagatgcctggtggtgtgcctgtggcgaccatggctatcggagaagcgggagcgactaacgctgccttgacagccctccgtatcctctctattgaggaccaaaatctggctgatgcgctagctcatttccatgaggaacaaggaaaaatcgcggaggagtcaagcaatgaacttatttaa

SEQ ID NO: 52164 - protein, 163 aa, Streptococcus agalactiae NEM316
MKTPIISIIMGSKSDWGTMQKTAEVLDNFGIAYEKKVVSAHRAPDLMFKHAEEARGRGIKIIIAGAGGAAHLPGMVAAKTTLPVIGVPVKTRALSGLDSLYSIVQMPGGVPVATMAIGEAGATNAALTALRILSIEDQNLADALAHFHEEQGKIAEESSNELI

SEQ ID NO: 52165 - DNA, 501 bp, Corynebacterium efficiens YS-314
  CDS (1)..(501): transl_table=11
atgacaccactcgtcgggctcatcatgggatctgattcggactgggacaccgtcgccccggccgccgaggccctcgccgaattcggcatccccttcgaggtcggcgtgctctccgcccaccgcaccccggaacgcatgctggcctacgccaagtcagcccacgagcgtggcctcaaggtcatcatcgcctgcgccggcggggccgcccacctgcccggcatggtcgctgccgccaccccgctgcccgtcatcggcatcccgcgggcactgaaggacctcgacggcatggactccctgctgtccatcgtgcagatgcccgccggtgtgcccgtggcgaccgtctccatcggtggtgccaagaacgccggcctgctcgccgtgcggatcctcggtgcgggtgaccccgcactggtgcagaagatggccgactaccaggctgacatggcagcccaggtggaggccaaggacgaggcgctcaaacagcgcctcatgggcgaatag

SEQ ID NO: 52166 - protein, 166 aa, Corynebacterium efficiens YS-314
MTPLVGLIMGSDSDWDTVAPAAEALAEFGIPFEVGVLSAHRTPERMLAYAKSAHERGLKVIIACAGGAAHLPGMVAAATPLPVIGIPRALKDLDGMDSLLSIVQMPAGVPVATVSIGGAKNAGLLAVRILGAGDPALVQKMADYQADMAAQVEAKDEALKQRLMGE

SEQ ID NO: 52167 - DNA, 492 bp, Pseudomonas putida KT2440
  CDS (1)..(492): transl_table=11
atgagtgcactggttggcgtgatcatgggctccaagtccgattggtccacccttagccacaccgccgatatgctggaaaaactcggcattccctacgaagtgaaggtggtttccgcccaccgcaccccggatctgctgttccagtatgccgaggaggctgagggccgtggcatcgaggtgatcatcgccggtgccggtggcgcagcccacctgccaggcatgtgcgccgccaagacccacctgccggtgctgggcgtgccggtgcagtcgtcgatgctgtcgggcgtcgattcgctgctgtcgatcgtgcagatgccagccggtgtgccggttgccaccctggccatcggccgtgccggtgcggtcaacgctgccctgctgtcggccagcattctgggcgccaagtacccgcagtaccacgcggcgttgaagcagttccgcacggaacagaccgacaccgtgctggacaacccagacccgcgccaggcttga

SEQ ID NO: 52168 - protein, 163 aa, Pseudomonas putida KT2440
MSALVGVIMGSKSDWSTLSHTADMLEKLGIPYEVKVVSAHRTPDLLFQYAEEAEGRGIEVIIAGAGGAAHLPGMCAAKTHLPVLGVPVQSSMLSGVDSLLSIVQMPAGVPVATLAIGRAGAVNAALLSASILGAKYPQYHAALKQFRTEQTDTVLDNPDPRQA

SEQ ID NO: 52169 - DNA, 483 bp, Staphylococcus epidermidis ATCC 12228
  CDS (1)..(483): transl_table=11
gtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatctttagtcgcaaaagtggaggaaatgcaaaatgaacttcagtaa

SEQ ID NO: 52170 - protein, 160 aa, Staphylococcus epidermidis ATCC 12228
MKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKSLVAKVEEMQNELQ

SEQ ID NO: 52171 - DNA, 489 bp, Bradyrhizobium japonicum USDA 110
  CDS (1)..(489): transl_table=11
atgaccgcgccgatcgccatcatcatgggaagccagtcggactgggacacgatgcggcatgccgccgacacgctcgaggcgctcggcgttgccgccgagacccgcatcgtttcggcacaccgcacccccgaccggctggtcgctttcgccaagggcgccaaggcggcgggttacaagatcatcatcgccggcgcgggcggcgctgcacatttgccgggcatggcggcggcactgacggagctcccggtcttcggtgttcccgtcgaatcgaagacgctcaagggcgtcgattcgctctattcgatcgtgcagatgcccgcgggcatcccggtcggcacccttgccatcggcaaggccggcgcgatcaatgcggcgctgcttgctgccgccgtgctggcgctgtccgacccagccttgtccgaccgcctcgccgcctggcgcaaggcacagaccgaggcggtcgctgagcgcccggaggacaaggcgtga

SEQ ID NO: 52172 - protein, 162 aa, Bradyrhizobium japonicum USDA 110
MTAPIAIIMGSQSDWDTMRHAADTLEALGVAAETRIVSAHRTPDRLVAFAKGAKAAGYKIIIAGAGGAAHLPGMAAALTELPVFGVPVESKTLKGVDSLYSIVQMPAGIPVGTLAIGKAGAINAALLAAAVLALSDPALSDRLAAWRKAQTEAVAERPEDKA

SEQ ID NO: 52173 - DNA, 504 bp, Xylella fastidiosa Temecula1
  CDS (1)..(504): transl_table=11
atgatctccaatcaatcccccccgctggtcggtattgtcatgggttcctcttcggattggggggcgatgcagcacgccgcacaaaagctcgatgctctcagcgtcgcgtatgaagtgaaggtcgtttcggcgcatcgtactccggataaattgtttgcttatgctgagcaggctgaaggacgtggtttgcgtgccatcattgccggggccggtggcgcagcgcaccttccaggtatgttggctgctaagacgatagttccagtgttgggggtgccaatgcagtccagggctctgaatggtttggattcgctgttatcaatcgtacagatgccggcgggtattccagtagccacattcgcgattggggaagctggtgcagtcaatgccgccctgtttgccgccgcgctgttggtacccgaaaatccagcaatgcgtcggatgctgactgagttccgccaacgtcagacggatcaggtgaatgctgcggacgatccacgccaatga

SEQ ID NO: 52174 - protein, 167 aa, Xylella fastidiosa Temecula1
MISNQSPPLVGIVMGSSSDWGAMQHAAQKLDALSVAYEVKVVSAHRTPDKLFAYAEQAEGRGLRAIIAGAGGAAHLPGMLAAKTIVPVLGVPMQSRALNGLDSLLSIVQMPAGIPVATFAIGEAGAVNAALFAAALLVPENPAMRRMLTEFRQRQTDQVNAADDPRQ

SEQ ID NO: 52175 - DNA, 480 bp, Clostridium tetani E88
  CDS (1)..(480): transl_table=11
atgaaagttgctataatatttggaagtaaatctgataaagaagtcatgagcggagctgcaaaagcactaaaagaatttgatattgaatataaggcatatatactttcagcccatagagtaccagaaaagttagaagaaactttaaaaaaattagaagaggataattatgaatgtataatagcaggtgcaggacttgctgcccatcttccaggagttatagcttctaaaactatagttccagtcataggagttcctattaatgcttcattaagtggtatggatgcattactttctatagttcagatgccaaaatctataccagttgctactgtaggtataaataatagttacaatgcaggtatgttagcagctcagattttatcactaaaatatgaggatttaaaaattaaaatgattgattatagaataaatataaaagaaaaatttattaatgaaaatgaacaaggtgtaatattatag

SEQ ID NO: 52176 - protein, 159 aa, Clostridium tetani E88
MKVAIIFGSKSDKEVMSGAAKALKEFDIEYKAYILSAHRVPEKLEETLKKLEEDNYECIIAGAGLAAHLPGVIASKTIVPVIGVPINASLSGMDALLSIVQMPKSIPVATVGINNSYNAGMLAAQILSLKYEDLKIKMIDYRINIKEKFINENEQGVIL

SEQ ID NO: 52177 - DNA, 486 bp, Lactobacillus plantarum WCFS1
  CDS (1)..(486): transl_table=11
atgatggcgaaagttggtttgattatggggtcaatttctgattggccaaccatgcaattagcggcagaacagttaacggcactgggagtctcttatgagcgtcacgttatttcggcccaccgaatgccccagacattacaatcctatggtgaagaagcagcgtcacggggaattcaagttattattgcgggtgcggggggcgctgcccatttacccgggatgctagctgccaatacactactcccggtaattggggtgcccattaagacccatacgttgaacggagttgattcgttattgtcaatcgtacagatgccagctggcgtacccgtggcgacgatggcgattggtgatgcgggggctaagaatggtgcgctaatggccgcccaaattatcggtttacgggaaccacaagtacaacatgcaattggagaatttcgtgctcgtcaacgtcaggaggctgaacaaagtgaacgccaattttaa

SEQ ID NO: 52178 - protein, 161 aa, Lactobacillus plantarum WCFS1
MMAKVGLIMGSISDWPTMQLAAEQLTALGVSYERHVISAHRMPQTLQSYGEEAASRGIQVIIAGAGGAAHLPGMLAANTLLPVIGVPIKTHTLNGVDSLLSIVQMPAGVPVATMAIGDAGAKNGALMAAQIIGLREPQVQHAIGEFRARQRQEAEQSERQF

SEQ ID NO: 52179 - DNA, 543 bp, Tropheryma whipplei str. Twist
  CDS (1)..(543): transl_table=11
atgactggtaaaaacatcaacgatgaaggtagcaaatgccccgctcttgtttggctcctaatgggttctgattcggattggcccgttatgtcaggcgccgcagatatcctgcagcagatgaatatatctttcagagtaaatgttgtttctgcccatcgccagccggaaaagatgattagctgcgccaaacgcgctcgtgacatgggattcaaagttctgatagctgctgccggtggagccgcacacttgcccggaatgcttgcaagtgtcacaactctccctgttatcggagttccggttgggcagaaaaatctgtcaggcctcgattctcttttatcgattgttcaaatgccctctggtgttccggtggcctgtgtcggcatagattctgctaaaaacgctgcccttctggccgcaaggattttgggggttcaatcagccgacatagaagcatccagaatagcagatagtttgtctgcatatcagcaaagcctgtttgatcaatcaaatgaaaaggacagaatgataaatgagccgaaatag

SEQ ID NO: 52180 - protein, 180 aa, Tropheryma whipplei str. Twist
MTGKNINDEGSKCPALVWLLMGSDSDWPVMSGAADILQQMNISFRVNVVSAHRQPEKMISCAKRARDMGFKVLIAAAGGAAHLPGMLASVTTLPVIGVPVGQKNLSGLDSLLSIVQMPSGVPVACVGIDSAKNAALLAARILGVQSADIEASRIADSLSAYQQSLFDQSNEKDRMINEPK

SEQ ID NO: 52181 - DNA, 507 bp, Pseudomonas syringae pv. tomato str. DC3000
  CDS (1)..(507): transl_table=11
atgagaggcacgacgatgagcgcactggttggcgtgatcatgggctccaagtccgattggtccacccttagccacaccgccgacatgctggaaaagctcggcattccttttgaagtcaaagtggtgtcagctcaccgcacgccggacctgctgttccagtacgccgacgaagccgaaggccgtggcattgaagtgatcatcgccggtgccggtggtgccgctcacttgccgggtatgtgcgctgccaagactcacctgcctgtattgggcgttccggtgcagtcctccatgctctcgggtgtcgactccctgctgtcgatcgtgcagatgcccgctggcattccggtcgcgacgctggccatcggcaaggccggtgcgatcaacgcagcgctgctgtcggcaagcattctcggcgccaagcacccgcaatttcacgcagcgctgaagaaatttcgcactgagcagacagacagcgtcctggacaatccagacccacgccacgcctga

SEQ ID NO: 52182 - protein, 168 aa, Pseudomonas syringae pv. tomato str. DC3000
MRGTTMSALVGVIMGSKSDWSTLSHTADMLEKLGIPFEVKVVSAHRTPDLLFQYADEAEGRGIEVIIAGAGGAAHLPGMCAAKTHLPVLGVPVQSSMLSGVDSLLSIVQMPAGIPVATLAIGKAGAINAALLSASILGAKHPQFHAALKKFRTEQTDSVLDNPDPRHA

SEQ ID NO: 52183 - DNA, 612 bp, Streptococcus pyogenes SSI-1
  CDS (1)..(612): transl_table=11
atgctaaagcacctagtcgccctgacgtgggttcgtcttcgaaatcaaagatttcggacttaccgcatatttttctacggaaggtttcgacaagtcgaaacgcccctttatatcttaattatgaaaactccaattatttctattatcatgggctccaaatctgactgggcaaccatgcaaaaaacggctgaagttctagacaactttggcattgcttacgagaagaaagtcgtctctgctcaccgcacgcccgacctcatgttcaagcatgctgaggaagcacgtggtcgtggcatcaaaatcatcatcgcaggagcaggtggggcagctcacttgcctggtatagtggcagctaaaacaacgctgcctgttatcggtgtgcctgtcaaatcacgtgccctttcaggtttggattcactctattcgattgtgcagatgcctggcggtgtgcctgtggcaaccatggctatcggagaagcgggagcgactaacgctgccctgacagccctccgtattctctccatcgaggatcaaaatctggctgatgcgctagctcatttccatgaggaacaaggaaaaatcgcagaggagtcaagtggtgaactcatttaa

SEQ ID NO: 52184 - protein, 203 aa, Streptococcus pyogenes SSI-1
MLKHLVALTWVRLRNQRFRTYRIFFYGRFRQVETPLYILIMKTPIISIIMGSKSDWATMQKTAEVLDNFGIAYEKKVVSAHRTPDLMFKHAEEARGRGIKIIIAGAGGAAHLPGIVAAKTTLPVIGVPVKSRALSGLDSLYSIVQMPGGVPVATMAIGEAGATNAALTALRILSIEDQNLADALAHFHEEQGKIAEESSGELI

SEQ ID NO: 52185 - DNA, 510 bp, Salmonella enterica subsp. enterica serovar Typhi Ty2
  CDS (1)..(510): transl_table=11
atgtcttcccgcaataatccggcgcgtgtcgccatcgtgatggggtccaaaagcgactgggctaccatgcaattcgccgccgaaatttttgaaattctggatgtcccgcaccatgtagaagtggtttccgcccatcgcacccccgataaactgttcagcttcgccgaaacggcggaagagaacggatatcaagtgattattgccggcgcgggcggcgcggcacacctgccgggaatgattgcggcaaaaacgctggtcccggtactcggcgtgccggtacaaagcgctgcgctcagcggcgtggatagcctctactccatcgtgcagatgccgcgcggcattccggtgggtacgctggcgatcggtaaagccggggcggcgaacgccgcactgctggcagcgcaaattttggctacgcatgatagcgcgctgcatcggcgcatcgccgactggcgcaaagcacaaaccgatgaggttctggaaaatcccgatccgcgggggacgctatga

SEQ ID NO: 52186 - protein, 169 aa, Salmonella enterica subsp. enterica serovar Typhi Ty2
MSSRNNPARVAIVMGSKSDWATMQFAAEIFEILDVPHHVEVVSAHRTPDKLFSFAETAEENGYQVIIAGAGGAAHLPGMIAAKTLVPVLGVPVQSAALSGVDSLYSIVQMPRGIPVGTLAIGKAGAANAALLAAQILATHDSALHRRIADWRKAQTDEVLENPDPRGTL

SEQ ID NO: 52187 - DNA, 516 bp, Bacteroides thetaiotaomicron VPI-5482
  CDS (1)..(516): transl_table=11
atgaaaatgactccaattgtaagtatcatcatgggtagcacgtccgaccttcctgttatggagaaggctgcgcaactgctgaatgatatgcatgtaccgttcgaaatgaacgccctttctgctcaccgcacgccggaggctgtggaagagtttgccaaaaatgcccgtagccgtggcattaaagtaatcatcgctgctgccggaatggctgccgcccttccgggtgtcatcgcagccaacacaacacttccggtgatcggagtacctgtaaaaggctctgtgctcgacggtgtagacgctctgtactccatcattcagatgcctccgggcattcctgtggctacggttgctatcaatggagcgatgaatgcggctatccttgccattcagatgcttgcattgagcgatgccgcattggctgaggcttttgctgcttacaaagaaggactgaaaaagaaaatcgtaaaggcaaacgaagaactgaaagaagtgaagttcgaatataaaaccaattaa

SEQ ID NO: 52188 - protein, 171 aa, Bacteroides thetaiotaomicron VPI-5482
MKMTPIVSIIMGSTSDLPVMEKAAQLLNDMHVPFEMNALSAHRTPEAVEEFAKNARSRGIKVIIAAAGMAAALPGVIAANTTLPVIGVPVKGSVLDGVDALYSIIQMPPGIPVATVAINGAMNAAILAIQMLALSDAALAEAFAAYKEGLKKKIVKANEELKEVKFEYKTN

SEQ ID NO: 52189 - DNA, 489 bp, Enterococcus faecalis V583
  CDS (1)..(489): transl_table=11
atgaaaccattagtcgctgtgattatgggaagtacctcagactgggcaacgatgaaagctgcttgtcttgtgttggaagagttgaaaattccttatgaaaaacgagtgatatcagcacataggacccctgacttgatgtttcgttttgcagaggaatcacgaacaaaaggattgaaggttattatcgctggcgctggtggagcggcccatttaccagggatggtagctgcaaagacaaccttacctgtcattggtgttccagttaaaacacgaacgttaaacggtattgattcactgttgtctattgtgcagatgccagggggagttcctgtagcaacaactgcgattggctcagcaggtgctaccaatgctgggttattagctgcagaaatactaagtattgatgatttacagttagcagaaagaatccaagcaagacgacaatcattggaaaaagcggttatggaaagtggggaacaacttgaataa

SEQ ID NO: 52190 - protein, 162 aa, Enterococcus faecalis V583
MKPLVAVIMGSTSDWATMKAACLVLEELKIPYEKRVISAHRTPDLMFRFAEESRTKGLKVIIAGAGGAAHLPGMVAAKTTLPVIGVPVKTRTLNGIDSLLSIVQMPGGVPVATTAIGSAGATNAGLLAAEILSIDDLQLAERIQARRQSLEKAVMESGEQLE

SEQ ID NO: 52191 - DNA, 501 bp, Coxiella burnetii RSA 493
  CDS (1)..(501): transl_table=11
atgaacaaaatttttgtggctattttaatgggctccgacagcgatctaagcaccatggaaactgcttttactgaattaaaatcgttgggtattccgtttgaagctcatattctttctgctcatcgcactcccaaggaaactgtcgaatttgtagaaaatgctgacaaccgcggctgcgccgtcttcatcgcagccgccggcctcgccgcccatctcgctggcaccattgctgcacataccctcaagccagtaatcggcgtgccaatggccggtggcagtcttggcggattagatgcattattatcaacagtacaaatgccaggcggcgttcccgttgcttgcacagcgattggaaaagcgggtgcgaaaaatgcagccatcttagcagcgcaaattattgccctccaggataaaagcatcgcacaaaagttagtgcaacaacggacggcaaaacgtgaaacgctaaaaaaggcggatgaaaatctacaaactcagttataa

SEQ ID NO: 52192 - protein, 166 aa, Coxiella burnetii RSA 493
MNKIFVAILMGSDSDLSTMETAFTELKSLGIPFEAHILSAHRTPKETVEFVENADNRGCAVFIAAAGLAAHLAGTIAAHTLKPVIGVPMAGGSLGGLDALLSTVQMPGGVPVACTAIGKAGAKNAAILAAQIIALQDKSIAQKLVQQRTAKRETLKKADENLQTQL

SEQ ID NO: 52193 - DNA, 534 bp, Streptomyces avermitilis MA-4680
  CDS (1)..(534): transl_table=11
atgaccgcacccgtagttggcatcgtcatggggtcggactccgactggcccgtcatggaggccgcagcgcaggccctcgacgagttcgagatcccgtacgaggtggacgtcgtctccgcgcaccggatgccgcacgagatgatcgcgtacggcgagcaggcggcggagcgcgggctgaaggcgatcatcgcgggtgcgggcggcgccgcccatctgcccggcatgctggcgtccgtgaccccgctgcccgtcatcggcgtgcccgtcccgctgaagtacctcgacggcatggactcgctgctgtcgatcgtgcagatgccggccggtgtcccggtcgcgaccgtctccgtcggcggcgcgcgcaacgcgggcctgctggccgcgcggatgctggccgcgcacgacgcggaactcctcacccgcatgcgggagttccagcaggaactgaacgaccaggccaccgagaagggcaagcggctgcgcgccaaggtcgacggcgcgtcgggcggcttcggcttcggctcggggaagtga

SEQ ID NO: 52194 - protein, 177 aa, Streptomyces avermitilis MA-4680
MTAPVVGIVMGSDSDWPVMEAAAQALDEFEIPYEVDVVSAHRMPHEMIAYGEQAAERGLKAIIAGAGGAAHLPGMLASVTPLPVIGVPVPLKYLDGMDSLLSIVQMPAGVPVATVSVGGARNAGLLAARMLAAHDAELLTRMREFQQELNDQATEKGKRLRAKVDGASGGFGFGSGK

SEQ ID NO: 52195 - DNA, 486 bp, Bacillus cereus ATCC 14579
  CDS (1)..(486): transl_table=11
atgaaatcactagttggagtcataatgggaagtacgtcagactgggaaacaatgaaatatgcttgtgacattttagatgaattaaatataccgtatgagaaaaaagttgtatccgctcatcggactccggattatatgtttgaatatgcagagacggctcgtgaacgtggattgaaagttattattgctggagctggtggagcagcacatttaccaggaatggttgcagcgaagacaaatcttcctgtaattggagttccagttcaatcaaaagcattaaacggcttagattcattattatccatcgcccaaatgccaggaggtgttccagttgcaactgttgcaattggtaaagccggttcaacgaatgctggattacttgccgcacaaatacttggatcatttcatgatgatatacatgatgcattagaattgagacgagaagcgattgaaaaagatgtgcgtgaaggtagtgagctagtatga

SEQ ID NO: 52196 - protein, 161 aa, Bacillus cereus ATCC 14579
MKSLVGVIMGSTSDWETMKYACDILDELNIPYEKKVVSAHRTPDYMFEYAETARERGLKVIIAGAGGAAHLPGMVAAKTNLPVIGVPVQSKALNGLDSLLSIAQMPGGVPVATVAIGKAGSTNAGLLAAQILGSFHDDIHDALELRREAIEKDVREGSELV

SEQ ID NO: 52197 - DNA, 498 bp, Nitrosomonas europaea ATCC 19718
  CDS (1)..(498): transl_table=11
gtggatcatccggtagtcagcatcgtaatgggcagcagcagtgactggcaggtaatgcgacatgctgcaagcgttttgaaaaacttctgtattccgcatgaaaccatgattatctcggcacatcgcacgcctgacaggatgtttgaatatgccgaaacagctcatgaccgtggaatcaggtgtatcatcgccggtgcgggaggtgctgcccatctccccggcatgattgctgccaaaaccacactccccgttctgggggttccggttacatcaaaacatttacagggtgtggattcactgttatccatcgtacagatgcccaagggtgtgccagttgccacttttgccatcggagaagcaggtgcagccaacgccgcactgtttgctgctgccattctggccgggggagatatctcactggccgaaaaactcgatcaatttcgcaaggatcaggctgcctctgtcgctgcgatgacgctccccgaatcatgtacataa

SEQ ID NO: 52198 - protein, 165 aa, Nitrosomonas europaea ATCC 19718
MDHPVVSIVMGSSSDWQVMRHAASVLKNFCIPHETMIISAHRTPDRMFEYAETAHDRGIRCIIAGAGGAAHLPGMIAAKTTLPVLGVPVTSKHLQGVDSLLSIVQMPKGVPVATFAIGEAGAANAALFAAAILAGGDISLAEKLDQFRKDQAASVAAMTLPESCT

SEQ ID NO: 52199 - DNA, 525 bp, Mycobacterium bovis AF2122/97
  CDS (1)..(525): transl_table=11
atgactcctgccggcgagcggccccgggtcggggtgatcatgggcagcgacagcgactggccggtgatggccgacgctgcggcggcgctggccgagttcgacattccggccgaggttcgggttgtttcggcccatcgcacccctgaggcgatgttcagttatgcgcgcggcgcggccgagcgcggtctcgaggtgatcatcgccggagcgggcggggccgcgcacttgcccggtatggtcgccgccgcgacgccgctgccggtgatcggggtgccggtaccgctgggcaggctggacggccttgactccctgctgtcgatcgtgcaaatgccggccggggttccggtggccacggtgtccatcgggggcgcccgtaatgccggactgctggcggtgcggatgctgggagccgccaacccccagctgagggcccggatcgtcgcattccaggaccggctggccgacgtcgtggcggccaaggatgcggaactgcagcggcttgcgggtaagttaacccgcgactag

SEQ ID NO: 52200 - protein, 174 aa, Mycobacterium bovis AF2122/97
MTPAGERPRVGVIMGSDSDWPVMADAAAALAEFDIPAEVRVVSAHRTPEAMFSYARGAAERGLEVIIAGAGGAAHLPGMVAAATPLPVIGVPVPLGRLDGLDSLLSIVQMPAGVPVATVSIGGARNAGLLAVRMLGAANPQLRARIVAFQDRLADVVAAKDAELQRLAGKLTRD

SEQ ID NO: 52201 - DNA, 495 bp, Helicobacter hepaticus ATCC 51449
  CDS (1)..(495): transl_table=11
atggattttgtaagcgtcattatgggaagtaaaagtgattggaatgtgatgagcgagtgcatagaagtgttaaagaaatttgatgtagcctatgaggtaataatcagttcggctcatcgctcaccagagcgcacaaaatcatacattaaagatgcacaatctcgtggtgcgcaggttttcattggagcagcaggtatggcagcacacttagccggggctatcgcctctcaaacttgtaagcccgttattggtgtgccacttaatggaggtgcattagatggacttgatgctcttctctcaacagtgcaaatgccaagctcaatgcctgtggcaacgacaagtattggtaaagccggggcgattaatgcagcatatttagcaatgcaaattttaagccttaaaaatgatgaacttgcgggcaaattaatagaagatagagtgatgaaagcaaaaaaggtagaactagattcagcagagattgaagtgagaatttaa

SEQ ID NO: 52202 - protein, 164 aa, Helicobacter hepaticus ATCC 51449
MDFVSVIMGSKSDWNVMSECIEVLKKFDVAYEVIISSAHRSPERTKSYIKDAQSRGAQVFIGAAGMAAHLAGAIASQTCKPVIGVPLNGGALDGLDALLSTVQMPSSMPVATTSIGKAGAINAAYLAMQILSLKNDELAGKLIEDRVMKAKKVELDSAEIEVRI

SEQ ID NO: 52203 - DNA, 519 bp, Rhodopirellula baltica SH 1
  CDS (1)..(519): transl_table=11
atgactgaccaagacgattccgcgaccgattcgcttttgcctcgtgttggtgtgatcatgggcagccgcaatgactgggacaccatgtcagcggcctgcgagatgctggatcttctcggcgtagagcatgagcgatccgtcgtttccgctcaccgtacacccgaacgcatgttcgaatacgctcgatcggccgcgtcccgaggattgaaagtcatcattgcgggagccggtggcgccgcccatctgccgggaatggtcgcttcggaaacggttttgccagtgatcggcgtgcccattcaaagccgggctttgcagggattggattcgttgctttccatcgtccagatgccaggtggaattccggtagcgacgatgtcgatcggtgtggcgggagcgaagaacgcaggggtgatggcagctcgtattttggcgacccacgacgaggcactccgcggtcgtctcgaggcattcgttgcaaaacaacgtgacgacgtgatcgcatcggcagagcttccatga

SEQ ID NO: 52204 - protein, 172 aa, Rhodopirellula baltica SH 1
MTDQDDSATDSLLPRVGVIMGSRNDWDTMSAACEMLDLLGVEHERSVVSAHRTPERMFEYARSAASRGLKVIIAGAGGAAHLPGMVASETVLPVIGVPIQSRALQGLDSLLSIVQMPGGIPVATMSIGVAGAKNAGVMAARILATHDEALRGRLEAFVAKQRDDVIASAELP

SEQ ID NO: 52205 - DNA, 495 bp, Wigglesworthia glossinidia endosymbiont of Glossina brevipalpis
  CDS (1)..(495): transl_table=11
atgaataaaaacaataaagtagcaattattatgggctctaaaagcgattggaatacattgaaacatgcatctaatgctctaaaagatttaaaaattaaatttactacacatattatttctgctcataggactccagataaattatttgaatttgctgaacaagctaaaaaaaatggttactgtgtgattattgctggagctggtggagcagctcatttaccaggaatgttagcatctaaaacattaataccagttttaggagttcctgtagaaaatagtcctttgaatggattagatagtttatattctatagtacaaatgccatctgaagttccagtaggaactttagctattggaaaatctggtgctattaattccgctatactagcttctcaaattttatcattaaatgattacgaattatatattagattaaaattgagaagaaaagaaaaagaaaatcaaatattaaattatgagaactcaattttataa

SEQ ID NO: 52206 - protein, 164 aa, Wigglesworthia glossinidia endosymbiont of Glossina brevipalpis
MNKNNKVAIIMGSKSDWNTLKHASNALKDLKIKFTTHIISAHRTPDKLFEFAEQAKKNGYCVIIAGAGGAAHLPGMLASKTLIPVLGVPVENSPLNGLDSLYSIVQMPSEVPVGTLAIGKSGAINSAILASQILSLNDYELYIRLKLRRKEKENQILNYENSIL

SEQ ID NO: 52207 - DNA, 489 bp, Haemophilus ducreyi 35000HP
  CDS (1)..(489): transl_table=11
atgttacaacaaaaagcagaaattgcggtcgtaatgggttcaaaaagtgactgggcaacaatttcagaagcaacacaaatcttagaacaatttgatcttgcctatcatgtcgaagtagtatcggcacatcggacccccgataaactattttcgtttgctgaatctgccgaacaaaatggctataaagtaattattgcaggtgcaggtggcgcggcgcatttgccgggtatgattgctgcaaaaacaattgtaccggtattaggtgttccggttaaaagctcaatgttaaatggcatggatagcttatattctatcgttcaaatgccaaaaggtattccagttggaacattagcgataggtgctgcaaatgctgcactattagcggttcagattttagctgtttttcaacctgaattggctaaaaaacttcatgcctttcggcaacaacaaactcaactagtattagataaccccgattcacgtgattaa

SEQ ID NO: 52208 - protein, 162 aa, Haemophilus ducreyi 35000HP
MLQQKAEIAVVMGSKSDWATISEATQILEQFDLAYHVEVVSAHRTPDKLFSFAESAEQNGYKVIIAGAGGAAHLPGMIAAKTIVPVLGVPVKSSMLNGMDSLYSIVQMPKGIPVGTLAIGAANAALLAVQILAVFQPELAKKLHAFRQQQTQLVLDNPDSRD

SEQ ID NO: 52209 - DNA, 492 bp, Prochlorococcus marinus subsp. marinus str. CCMP1375
  CDS (1)..(492): transl_table=11
atgggaagtgattccgatttacctttccttgagccagctattaaagttttagaggggtttaacctccaagtagagacaagagtactttcagcacatcgaacaccactaaaaatggtctcgtttgctcgtgaagccgaagggaaaggtttaaaagtcattattgcaggagctggtggatcggcgcatcttccagggatggttgcttcacttacaagtcttccagtaattggggtccctatacaaagcaaatgcttaaaaggcattgactctttatattccattgttcagatgcctgcagggatcccagtagcaacagtagcgatcaatggtggattaaatgctggtctattagcagctcagatattaagcacgattcagccagaattaaaaattaaaatttcccaatatagaaaagaactacataatcaagttatacataaagacaaaaagctaatcgaattaggtgcatcaaagtatttagaagaaatgtaa

SEQ ID NO: 52210 - protein, 163 aa, Prochlorococcus marinus subsp. marinus str. CCMP1375
MGSDSDLPFLEPAIKVLEGFNLQVETRVLSAHRTPLKMVSFAREAEGKGLKVIIAGAGGSAHLPGMVASLTSLPVIGVPIQSKCLKGIDSLYSIVQMPAGIPVATVAINGGLNAGLLAAQILSTIQPELKIKISQYRKELHNQVIHKDKKLIELGASKYLEEM

SEQ ID NO: 52211 - DNA, 441 bp, Bordetella parapertussis 12822
  CDS (1)..(441): transl_table=11
atgaaacacgccgtggccatgctgcaggacttcggcgtggcgcacgaggcgcgcgtgatttcggcgcaccgcatgccgcaggacatggccgagtatggcgcggcggcgcgcgcgcgcggcttgcgcgccatcattgccggcgccggcggcgcggcccacctgcctggcatgatggccgcgctgaccgaggtgccggtattcggcgtgccggttccgtccaggtatctgcgcggcgaggactcgctgctttccatcgtgcagatgcccaagggcgtgccggtggccacctttgccatcggcgagtccggcgcggccaacgcggcgctgcatgccatcgccacgctggccaccaccgacgacgccctgcacgcccggctggtcgcgttccgcgcgcggcagaccgatgcggcgcgcgccatgaaagtgcctcccgaagcctga

SEQ ID NO: 52212 - protein, 146 aa, Bordetella parapertussis 12822
MKHAVAMLQDFGVAHEARVISAHRMPQDMAEYGAAARARGLRAIIAGAGGAAHLPGMMAALTEVPVFGVPVPSRYLRGEDSLLSIVQMPKGVPVATFAIGESGAANAALHAIATLATTDDALHARLVAFRARQTDAARAMKVPPEA

SEQ ID NO: 52213 - DNA, 480 bp, Bordetella bronchiseptica RB50
  CDS (1)..(480): transl_table=11
gtgggcgtgatcatgggatcttccagcgactgggaggtcatgaaacacgccgtggccatgctgcaggacttcggcgtggcgcacgaggcgcgcgtgatttcggcgcaccgcatgccgcaggacatggccgagtatggcgcggcggcgcgcgcgcgcggcttgcgcgccatcattgccggcgccggcggcgcggcccacctgcctggcatgatggccgcgctgaccgaggtgccggtattcggcgtgccggttccgtccaggtatctgcgcggcgaggactcgctgctttccatcgtgcagatgcccaagggcgtgccggtggccacctttgccatcggcgaggccggcgcggccaacgcggcgctgcatgccatcgccacgctggccaccaccgacgacgccctgcacgcccggctggtcgcgttccgcgcgcggcagaccgatgcggcgcgcgccatgaaagtgcctcccgaagcctga

SEQ ID NO: 52214 - protein, 159 aa, Bordetella bronchiseptica RB50
MGVIMGSSSDWEVMKHAVAMLQDFGVAHEARVISAHRMPQDMAEYGAAARARGLRAIIAGAGGAAHLPGMMAALTEVPVFGVPVPSRYLRGEDSLLSIVQMPKGVPVATFAIGEAGAANAALHAIATLATTDDALHARLVAFRARQTDAARAMKVPPEA

SEQ ID NO: 52215 - DNA, 492 bp, Prochlorococcus marinus subsp. pastoris str. CCMP1986
  CDS (1)..(492): transl_table=11
atgggaagtgattcagatctaaaaacattgaaacctgcaatagatatattgaacgaatttggaatagaaactgaggtttgtatactttctgcgcatagaacgccaatggaaatgatggaatatgcaaaaaaagcagaatcagaaaacataaaagttattatcgcaggagccggtggagctgctcacctgcctggcatgatagcttcgctaacatgcatacctgtcataggtgtaccggtggagagtaaaaccctgaaaggaattgactccctattatcaatagtgcaaatgcctgcgggtattcctgtagcaacagtagccataaacggtgcaaaaaatgctggtttattagcaattcaaatccttagtttatttgatgaagcattaagattaaaaatgaaaaaatttagagagaatctgcatacacaagtaagaactaaaaatagtaaattgtctgctctaggggctgataattatctgaaaactgactaa

SEQ ID NO: 52216 - protein, 163 aa, Prochlorococcus marinus subsp. pastoris str. CCMP1986
MGSDSDLKTLKPAIDILNEFGIETEVCILSAHRTPMEMMEYAKKAESENIKVIIAGAGGAAHLPGMIASLTCIPVIGVPVESKTLKGIDSLLSIVQMPAGIPVATVAINGAKNAGLLAIQILSLFDEALRLKMKKFRENLHTQVRTKNSKLSALGADNYLKTD

SEQ ID NO: 52217 - DNA, 492 bp, Prochlorococcus marinus str. MIT 9313
  CDS (1)..(492): transl_table=11
atgggtagtgattctgatttgccaaccctgcaaccggccgtcaccgtcttagaggagttcggtgtgaaggtggaggtgcgtgtgctttctgcgcaccgtacgccccttgagatggtggcctttgcaaaggaagctcatcagagaggtttgaaggtgatcgtggcaggtgccggcggtgctgctcatttgccgggcatggtggcgtcactcaccacgctgccagtgattggagtacctgtgcagagcagggctctttccggggtggattccttgcattcgattgtgcagatgcctgggggaatccctgtggcaacagtggcgattggtggagggcttaatgctggcttgctggcggctcagatcctggcgatctgtgatccacagcttgcagagcggttgagggcctaccgccaggatcttcacgatgctgtggtagccaaggatgctcgcttgttggagcttggcagtgaggcttatttggggcagatgtga

SEQ ID NO: 52218 - protein, 163 aa, Prochlorococcus marinus str. MIT 9313
MGSDSDLPTLQPAVTVLEEFGVKVEVRVLSAHRTPLEMVAFAKEAHQRGLKVIVAGAGGAAHLPGMVASLTTLPVIGVPVQSRALSGVDSLHSIVQMPGGIPVATVAIGGGLNAGLLAAQILAICDPQLAERLRAYRQDLHDAVVAKDARLLELGSEAYLGQM

SEQ ID NO: 52219 - DNA, 501 bp, Synechococcus sp. WH 8102
  CDS (1)..(501): transl_table=11
atgggcagtgattccgatctgccgaccatggaaccggccgcggcgatcctgcgggaactgggggttgaggtggaggtgcgggtgttgtcagcccaccgcacaccgctggaaatggtggcctttgcccaggcggcccgcactgagggattcggtgtgattgtggccggtgccggtggtgccgcccatctgccggggatggtggcggccctcaccaccctgccggtgatcggtgttcccgtccgaagccgttctctgtccggggtggattcgctgcactcgatcgtgcagatgcccggtggtattcccgttgccacggtggccatcggcggtggcctcaatgccggattgctggctgctcagatcctgtcggtggcagacgaggcactggcggcccgactggcggactaccgccgcaggttgcacgatgcagtggcagccaaggatgcccgtctgctcgatctcggcagtacggcctatctcgacggcatgtcgaccccttga

SEQ ID NO: 52220 - protein, 166 aa, Synechococcus sp. WH 8102
MGSDSDLPTMEPAAAILRELGVEVEVRVLSAHRTPLEMVAFAQAARTEGFGVIVAGAGGAAHLPGMVAALTTLPVIGVPVRSRSLSGVDSLHSIVQMPGGIPVATVAIGGGLNAGLLAAQILSVADEALAARLADYRRRLHDAVAAKDARLLDLGSTAYLDGMSTP

SEQ ID NO: 52221 - DNA, 489 bp, Chromobacterium violaceum ATCC 12472
  CDS (1)..(489): transl_table=11
atgattgaagtcggcatcgtgatgggtagcaacagcgactgggaagtgatgcagcacgccgcccgcgtgctgaaaaacttcggcgtcgcctgcgaaacccgcgtcgtctccgcccaccgcaccccggacctgctgttccagtacgccgaagaagccgcgccgcgcggcctgaaggccatcatcgccggcgccggcggggccgcccatctgccgggcatgctggccgccaagacccacgtgccggtgctgggcgtgccggtgccgtccaaatacctgcgcggcgaggattcgctgctgtccatcgtccagatgcccaagggcatcccggtggccaccttcgccatcggcgaggccggcgccgccaacgccgcgctgttcgcggtggcgatgctggcgaccacccggccggaactggccgagcaactgatcggcttccgcaagcaacaggaagcaaccgtgctggcgatgacattgccggaggtcgaataa

SEQ ID NO: 52222 - protein, 162 aa, Chromobacterium violaceum ATCC 12472
MIEVGIVMGSNSDWEVMQHAARVLKNFGVACETRVVSAHRTPDLLFQYAEEAAPRGLKAIIAGAGGAAHLPGMLAAKTHVPVLGVPVPSKYLRGEDSLLSIVQMPKGIPVATFAIGEAGAANAALFAVAMLATTRPELAEQLIGFRKQQEATVLAMTLPEVE

SEQ ID NO: 52223 - DNA, 507 bp, Porphyromonas gingivalis W83
  CDS (1)..(507): transl_table=11
atgcagcctttggtaagcatcatcatgggtagtacttccgatctgcccattatggagaaagccgccaaaatgctcgatgaaatgcagattccattcgagatgttggcgctttcggctcatcgtactccggctgaagtagagacttttgcacacgaggccagagctcgcggtatcaaggtaattatcgctgctgccggtatggcagctcatttgtgtggcgtaattgcttccatgacgtctattccggtaataggtgtacccatcaatgccactcttgacggaatggatgctctgttagccatcgttcaaatgcctccggggatccccgttgctactgtggggatcaatgctgcccagaatgcagcacttttggccgtccagatgatggctaccggcgacgaagctctctatgctcgactggaggcctataaggagtcgctcaaagaaaaagtcgttaaggccaatcgcgagctggcagaggtgaagtacaacttcaaaacgaattaa

SEQ ID NO: 52224 - protein, 168 aa, Porphyromonas gingivalis W83
MQPLVSIIMGSTSDLPIMEKAAKMLDEMQIPFEMLALSAHRTPAEVETFAHEARARGIKVIIAAAGMAAHLCGVIASMTSIPVIGVPINATLDGMDALLAIVQMPPGIPVATVGINAAQNAALLAVQMMATGDEALYARLEAYKESLKEKVVKANRELAEVKYNFKTN

SEQ ID NO: 52225 - DNA, 495 bp, Wolinella succinogenes DSM 1740
  CDS (1)..(495): transl_table=11
atgcagtttgtgtcgattctaatgggcagtaagtccgatgccgaggtgatgagagagtgtgcggagattttcaaaaaatttgatgttccctatgagatgatcatcagctccgcccaccgaagtcctgtgcgcaccaaagagtatgtgctggaagctgaggccaggggagcaaaagtctttatcgctgctgcgggcatggcggctcacttggcgggagccatctcctctatgaccaccaagcccgtgattggtgtgcccatgggcggagggacgcttggaggattggatgcgctactctccaccgtccaaatgccctcagggatgcccgtgggaacagtcgctattggaaagacaggagcagtgaatagtgcctatttggcgatgcagattttggcccttggcaatgatgagctagcgggcaaactcaaagaggatcgcgtgatgaaggccaaaaatgtggagcttgattccgcagagattgaggttttgctctag

SEQ ID NO: 52226 - protein, 164 aa, Wolinella succinogenes DSM 1740
MQFVSILMGSKSDAEVMRECAEIFKKFDVPYEMIISSAHRSPVRTKEYVLEAEARGAKVFIAAAGMAAHLAGAISSMTTKPVIGVPMGGGTLGGLDALLSTVQMPSGMPVGTVAIGKTGAVNSAYLAMQILALGNDELAGKLKEDRVMKAKNVELDSAEIEVLL

SEQ ID NO: 52227 - DNA, 1923 bp, Oryza sativa (japonica cultivar-group)
  CDS (1)..(1923)
atgcactccaggctcctcagcgccccctcccacgcctccgccgcctcctcctcccccctccccttcgccgccgcccacccttgccgcgcctcctggacgccgcggcccacctccccgctgccgcctctatcgctgctgcgcgccaccgcctccatgcatccttctcctcctcccgaggggcatagcgaccagcctgtgcatggcgtcaccaacacggtcgtcggcgtgctggggggaggccagctggggaagatgctgtgccaggcggccagccagatgggggtcaggatggccatacttgatcccctcgaggactgcccggcgagctcggtttgccacgagcatgtcgtcgggagcttcaatgatggcgccacggttagcgagttcgcaaagaggtgcggggttttgacggtggaaattgagcatgtcgacgctgtaacactcgagaagcttgagaaacagggcatcgattgtgagcccaaagcctccaccatcatgattattcaagacaagtacaggcagaaaactcatttctcaaaatttggaattccgttacctgactttgtggaagtagatactttaagtagcatagagaaagctggggaaatgtttggttatcctctaatggtcaaaagcaagagattagcatatgatggccgtggaaatgctgttgctcacgacaaaaaagagctatcttctgttgttgcttctcttggtgggtttgagcatggcttgtatgttgagaggtggacatcttttgtaaaggagctttctgtcattgtggcaaggagcagagacggttctacggtgtgctatcctgttgttgaaaccatccacaaggataacatctgccatgttgttgaggctcctgccgaggtgcctgataaaataaagaagttggctactaatgtagctgaaaaggctatcaaatcattggaaggtgctggtgttttcgctgtagaattatttttaacacaagataatcaggttttattgaatgaagtagctccaaggcctcacaacagtgggcatcacacaattgagtcatgttatacctcgcaatatgagcaacatttacgtgctattcttggccttcctcttggtgatccttcaatgaaagcgcctgcatcaataatgtacaacatcctgggtgaggatgagggtgaggcaggatttactcaagctcatcagttgattgagagagctttggacatttcaggtgcatctgtccattggtatgcaaaaccagaaatacggaagcagagaaagatgggccatattacaattgtggggccttcaaagtacagtgtaaaagcacgcttagataagttgctgcaaagagacgcatatgaccccaagaaagttaaacctcgtgctgcaataataatgggttctgattctgatcttcctgtcatgaaagatgctgcagtagtattgaagaaattcaacataccttttgagcttacaattgtttcggctcatcgtacaccagagaggatgtaccattatgcattatctactaaagaaagaggcttagaggtcataattgcagggatggtggcttcattgacttctgtcccagtaataggagtacccatcatgacttcatctttacatggaactgattccctcctatctattgtccagatgccgaaaggtattcctgttgctactgttgcaattggaaatgcggaaaatgcaggtttattggcagttaggatgctggcctcaagagatcctgagttgggggacaagtatgatttcttcttttctgcaattgtcctgcaaattttgaagtttgacacctcccagcaggcaactgaataccagcatgatctgagggatatggtgttggagaaagcaaaaaggctcgaggaactaggttgggaggaatataccgagctatacttgaagaagcattga

SEQ ID NO: 52228 - protein, 640 aa, Oryza sativa (japonica cultivar-group)
MHSRLLSAPSHASAASSSPLPFAAAHPCRASWTPRPTSPLPPLSLLRATASMHPSPPPEGHSDQPVHGVTNTVVGVLGGGQLGKMLCQAASQMGVRMAILDPLEDCPASSVCHEHVVGSFNDGATVSEFAKRCGVLTVEIEHVDAVTLEKLEKQGIDCEPKASTIMIIQDKYRQKTHFSKFGIPLPDFVEVDTLSSIEKAGEMFGYPLMVKSKRLAYDGRGNAVAHDKKELSSVVASLGGFEHGLYVERWTSFVKELSVIVARSRDGSTVCYPVVETIHKDNICHVVEAPAEVPDKIKKLATNVAEKAIKSLEGAGVFAVELFLTQDNQVLLNEVAPRPHNSGHHTIESCYTSQYEQHLRAILGLPLGDPSMKAPASIMYNILGEDEGEAGFTQAHQLIERALDISGASVHWYAKPEIRKQRKMGHITIVGPSKYSVKARLDKLLQRDAYDPKKVKPRAAIIMGSDSDLPVMKDAAVVLKKFNIPFELTIVSAHRTPERMYHYALSTKERGLEVIIAGMVASLTSVPVIGVPIMTSSLHGTDSLLSIVQMPKGIPVATVAIGNAENAGLLAVRMLASRDPELGDKYDFFFSAIVLQILKFDTSQQATEYQHDLRDMVLEKAKRLEELGWEEYTELYLKKH

SEQ ID NO: 52229 - DNA, 516 bp, Gloeobacter violaceus PCC 7421
  CDS (1)..(516): transl_table=11
atgacccatcctgcgctggtggggatcatcatgggcagcgattcggatctgcccacgatgaaggcggcggccgaggtctgcaccgaattcgaggtgccctgttcggtggcgatcgtctcggcccaccgcacgccggagcgcatgtttgaatttgcggcgaccgcccactcccggggcttgaaggtgatcgtggccggggcgggcggggcggcccacctgccggggatggtggcggccctcacacccctgccggtgattggagtgccggtaccggtcaccgccctggggggcgtcgatgcgctctattcgattgtccagatgcccgcaggcattccggtggccaccgtggcgatcggcaacgcccgcaacgccggtctgctcgctgtgcagatcctggcgacggcggacccggtgttgcagcaaaaaatcgtcgcttatcgcgagcggctgcgcacggcggtcgagaaaaaacaggcccgcctcgaagagctgggttggcggaactacgagccttaa

SEQ ID NO: 52230 - protein, 171 aa, Gloeobacter violaceus PCC 7421
MTHPALVGIIMGSDSDLPTMKAAAEVCTEFEVPCSVAIVSAHRTPERMFEFAATAHSRGLKVIVAGAGGAAHLPGMVAALTPLPVIGVPVPVTALGGVDALYSIVQMPAGIPVATVAIGNARNAGLLAVQILATADPVLQQKIVAYRERLRTAVEKKQARLEELGWRNYEP

SEQ ID NO: 52231 - DNA, 531 bp, Photorhabdus luminescens subsp. laumondii TTO1
  CDS (1)..(531): transl_table=11
atgactgcccaacctgatttagcaggaacagctcaacacaatgccaaaatcgccattgtcatgggttctaaaagcgattggacgactatgcagcacgcggctgatatcctcacttctcttaatgtaccttttcatgttgaaattgtttctgctcaccgtacacccgataaactattcagttttgccgagcaagctgagcaaaatggttttgatgtcattatcgccggtgccggtggtgccgctcatttacccggcatgctggctgctaaaacgctggtaccggttctcggcgtacccgtacaaagtgctgcactaaatgggatagacagtctttactctattgtacagatgccaaaagggattcctgtcggcacacttgccattgggaaagctggcgcggcaaacgcagctctactggctgcacagattttggctcgtcataataaagatttactgaaacgcctcagccattggcgtgaaacacaaactcaggatgtactcgataatcccgatccgcgggaggaagcatga

SEQ ID NO: 52232 - protein, 176 aa, Photorhabdus luminescens subsp. laumondii TTO1
MTAQPDLAGTAQHNAKIAIVMGSKSDWTTMQHAADILTSLNVPFHVEIVSAHRTPDKLFSFAEQAEQNGFDVIIAGAGGAAHLPGMLAAKTLVPVLGVPVQSAALNGIDSLYSIVQMPKGIPVGTLAIGKAGAANAALLAAQILARHNKDLLKRLSHWRETQTQDVLDNPDPREEA

SEQ ID NO: 52233 - DNA, 501 bp, Corynebacterium diphtheriae NCTC 13129
  CDS (1)..(501): transl_table=11
atgacaccactcgtaggccttatcatgggctccgactccgactggcccaccgttgaaccagccgccgaggtactcgccgaattcggcatccccttcgaagtaggcgtagtttctgcacaccgtactccagagaaaatgctggcatacgcaaaaaccgcacatgagcgcggtctaaaatgtatcattgcctgcgccggcggtgccgcacacctacctggcatggtcgcagcagccaccccgctacccgtcatcggaatcccacgcgctctcaaagaactcgacggcatggattctctgctctccatcgtccaaatgccaggcggggttcccgttgctaccgtctccattggaggcgctaaaaacgcaggactgttggccgcacgaattcttggcgccggtgatccagaactagtaaccaagatggctgactaccaagaaaacatgcgccaagaagttgagcgcaaagatgccaacctcaagaagaaattgatgggcgagtaa

SEQ ID NO: 52234 - protein, 166 aa, Corynebacterium diphtheriae NCTC 13129
MTPLVGLIMGSDSDWPTVEPAAEVLAEFGIPFEVGVVSAHRTPEKMLAYAKTAHERGLKCIIACAGGAAHLPGMVAAATPLPVIGIPRALKELDGMDSLLSIVQMPGGVPVATVSIGGAKNAGLLAARILGAGDPELVTKMADYQENMRQEVERKDANLKKKLMGE

SEQ ID NO: 52235 - DNA, 489 bp, Rhodopseudomonas palustris CGA009
  CDS (1)..(489): transl_table=11
atgacagctcccgtcgcgatcatcatgggcagccagtcggactgggaaacgatgcggcacgccgccgacaccctgaccgccctcggcgtcgcccatgacacccagatcgtttccgcgcaccgcacccccgaccgcctttatgctttcgccaaaggcgcgaaggcagccggccaccgtatcgtcattgccggcgccggcggagccgcgcatctgccggggatgaccgcggcgctgacggagctgccggtgttcggcgtgccggtggaatccaagaccatgtcgggcctggattcgctgtattcgatcgtgcagatgccggccggcatcccggtcggcacgctggcgatcggcaaggccggcgcagtcaacgccgccctgctggctgcgagcgtgctggcgctgacagattccgatctggcgacccgactggcggcgtggcgcaaggcacagaccgattcggttgcggcccggccggagggcgcggcgtga

SEQ ID NO: 52236 - protein, 162 aa, Rhodopseudomonas palustris CGA009
MTAPVAIIMGSQSDWETMRHAADTLTALGVAHDTQIVSAHRTPDRLYAFAKGAKAAGHRIVIAGAGGAAHLPGMTAALTELPVFGVPVESKTMSGLDSLYSIVQMPAGIPVGTLAIGKAGAVNAALLAASVLALTDSDLATRLAAWRKAQTDSVAARPEGAA

SEQ ID NO: 52237 - DNA, 510 bp, Geobacter sulfurreducens PCA
  CDS (1)..(510): transl_table=11
atggaaaacccgcaggtactcatcattatgggaagtgattcggacgttcccgtcatggaagaagcggcaaaggcccttgatgctttcggcgtgacctgggaaatgcgagtggcgtcggcccaccgttcgccgaaaaaagcggcagatctcgcctcgaacgcggccgcgcgcggcgtgaaggcgatcatcgccggtgccggcgtggctgcccaccttgcgggggtcctcgccgccgagactattctgccggttatcgcggtaccaatgccgggaggggcgctcaacggcgttgatgccctgtactccatggtgcagatgcctggcgggattccggtggctactatggccatcggcaaggcaggagccaaaaatgccgggctgttcgcggtgcagatcctggccctcggggatgccgccatggccggcaggctcgtggaatacaaggcgagtatggcggaagaggtggaggccaaggatcgggcccttcaggtcaagttgggccgcgcgtag

SEQ ID NO: 52238 - protein, 169 aa, Geobacter sulfurreducens PCA
MENPQVLIIMGSDSDVPVMEEAAKALDAFGVTWEMRVASAHRSPKKAADLASNAAARGVKAIIAGAGVAAHLAGVLAAETILPVIAVPMPGGALNGVDALYSMVQMPGGIPVATMAIGKAGAKNAGLFAVQILALGDAAMAGRLVEYKASMAEEVEAKDRALQVKLGRA

SEQ ID NO: 52239 - DNA, 552 bp, Geobacter sulfurreducens PCA
  CDS (1)..(552): transl_table=11
atggaaaaagtcgaaacatcgagcgcacccggcactctcgccgaccgctcgccgctggtgggaatcctgaccgggagccccaatgatctgcccacggtggtgaaggtgcgcgacaccctgaccgagctcggcatcccgagcgagatcgtggtggcttcggcccaccggacccccgacaaggtcctcgcctacctggaccgggcccataaggaaggggtgcaggtactgatcggctgcgccggcgtggccgctcacctggcgggtgtaatcgccgggcacacgagattgccggtcatcggtttgccgctcggcaacggccccttgtcagggatggacagcctcctctcgaccgtgcagatgcccccgggcgtgccggttgccacggtggccatcgacgggagccgcaatgcggccatgctggcggcccgcattctggccctcaagtacccggagattgacaaggccctggaagaggcggctcggaaggagcgggagcgctacgacctgaccgccgatgaggccctggcaaaactcacctcgtgcgtcaagtaa

SEQ ID NO: 52240 - protein, 183 aa, Geobacter sulfurreducens PCA
MEKVETSSAPGTLADRSPLVGILTGSPNDLPTVVKVRDTLTELGIPSEIVVASAHRTPDKVLAYLDRAHKEGVQVLIGCAGVAAHLAGVIAGHTRLPVIGLPLGNGPLSGMDSLLSTVQMPPGVPVATVAIDGSRNAAMLAARILALKYPEIDKALEEAARKERERYDLTADEALAKLTSCVK

SEQ ID NO: 52241 - DNA, 1278 bp, Danio rerio
  CDS (1)..(1278)
atgtctactgcaacagaactaaaactaggtcaaaagctgaatgaggggaagaccaagcagatctttgagattttggatgagccgggtcatgtcctggtccagtctaaagatcagatcaccgcgggcaatgcggttcggaaggatcagatggagggcaaagctgctattgccaacaagaccaccagctgtgtgtttaaacttttacaagatgctgggcttaagaccgcatttgtcaggcagcattctgacactgcatttgtggcatctcgatgtgaaatgatacccattgaatgggtctgcagacgtatcgccacgggttccttcctcaaacgcaaccctggggttaaagagggctaccgcttcactcctttaaaaatggagatgttttttaaggatgatgccaataatgaccctcaatggtcagaagagcagctgttggcagctggttttgacctggctggactgactattggtcgctgtgaggtggacatcatgagcaaaagcactgtggccatttttgaagtcctggagaaggcttgggccacccaggactgcacgctggtggatatgaaaatagaatttggagtaaatgtgaccactaaggagattgtgctggctgatgtgattgacaatgactcatggaggctctggccagctggggatcgcagccagcagaaagacaaacaggtgtaccgtgacctgaaagaagtcactcccgaggccatgcagatggtaaagaggaacttcgagtgggtcgcagagcgagttaagctgctcctggagtcccaggcgagaggaagggtggtagttatgatgggctccacctcagatgtggctcactgtgagaagatccgtaaagcttgtgcttcatatggcattccctgccacctcagagtcaactctgcccataaaggccctgatgagacactccgcatcaaagctgaatatgagggcgatggagaacctactatctttgttgcagtggcaggcagaagtaacggcttgggtcctgtgatgtcaggaaacactgcttatccagtcattaactgtccccctgtaacccctgactggggagctcaggacatctggtcgtctcttcgcatgcctagtggtctgggctgctccactgttctttctcctgaagctgctgctcagtttgcagcgcagatcctgggtctaaacaaccatttgatttgggccaaacttcgtgcatccatgctgaacacctgggtctccctgaaacaggctgataaaaagatgcaagactgcagcctttaa

SEQ ID NO: 52242 - protein, 425 aa, Danio rerio
MSTATELKLGQKLNEGKTKQIFEILDEPGHVLVQSKDQITAGNAVRKDQMEGKAAIANKTTSCVFKLLQDAGLKTAFVRQHSDTAFVASRCEMIPIEWVCRRIATGSFLKRNPGVKEGYRFTPLKMEMFFKDDANNDPQWSEEQLLAAGFDLAGLTIGRCEVDIMSKSTVAIFEVLEKAWATQDCTLVDMKIEFGVNVTTKEIVLADVIDNDSWRLWPAGDRSQQKDKQVYRDLKEVTPEAMQMVKRNFEWVAERVKLLLESQARGRVVVMMGSTSDVAHCEKIRKACASYGIPCHLRVNSAHKGPDETLRIKAEYEGDGEPTIFVAVAGRSNGLGPVMSGNTAYPVINCPPVTPDWGAQDIWSSLRMPSGLGCSTVLSPEAAAQFAAQILGLNNHLIWAKLRASMLNTWVSLKQADKKMQDCSL

SEQ ID NO: 52243 - DNA, 522 bp, Mycobacterium avium subsp. paratuberculosis K-10
  CDS (1)..(522): transl_table=11
atgagcgtgaccgaagctcctcgcgtcgcggtgatcatgggcagcgacagcgactggtcggtgatggccgacgccgcggccgcgctggccgagttcgacgtgcccgccgaggtgcgggtggtctcggcgcaccgcacgccgggggtgatgttcgactacgcgcgcgacgccgccgggcggggcatcgaggtgatcatcgccggcgccggaggcgccgcccacctgcccggcatggtcgcctcggcgacgccgctgccggtgatcggggtcccggtgccgctgggccggctggacgggctggactcgctgctgtcgatcgtgcagatgcccgcgggggtgccggtggccaccgtctccatcggcggcgcccgcaacgccggcctgctggcggtgcgcatcctcggcgcctccgacccggggctgcgggcccgcatcgtcgagttccagacccagctggccgacagcgtgcgggccaaggatgaggcgctgcaaaggctgcacggtaaagttaccggtcagtag

SEQ ID NO: 52244 - protein, 173 aa, Mycobacterium avium subsp. paratuberculosis K-10
MSVTEAPRVAVIMGSDSDWSVMADAAAALAEFDVPAEVRVVSAHRTPGVMFDYARDAAGRGIEVIIAGAGGAAHLPGMVASATPLPVIGVPVPLGRLDGLDSLLSIVQMPAGVPVATVSIGGARNAGLLAVRILGASDPGLRARIVEFQTQLADSVRAKDEALQRLHGKVTGQ

SEQ ID NO: 52245 - DNA, 501 bp, Wolbachia endosymbiont of Drosophila melanogaster
  CDS (1)..(501): transl_table=11
gtgttgaatatgacaaaaataaaaaaagatgttgctgttattatgggaagtgagtcagattacaccactatggtccatactgttgatatgttaaaagcattagaagtttcacatgatatattcataatatctgcacatagaacaccagaaagactcttcaattttgctaaatctgcacaagaagaaggttttaaggttattatagctggtgcaggaggtgcagctcatttacctggtatggttgcgtcactaacttgtttaccagttatcggcgttcctgtgcatagtaaacaattaaatgggctggacagcctactctctatagttcaaatgccaaagggtgttccagttgcaaccatgtctatagggggaaatggagcacataatgctgccattaccgccgtatctatattgtcaatttctaacagtgaaattgcaggtaggttaaaaaagtggagagagaagcagaccaaagaagtaaaagaaaaaccaatttcataa

SEQ ID NO: 52246 - protein, 166 aa, Wolbachia endosymbiont of Drosophila melanogaster
MLNMTKIKKDVAVIMGSESDYTTMVHTVDMLKALEVSHDIFIISAHRTPERLFNFAKSAQEEGFKVIIAGAGGAAHLPGMVASLTCLPVIGVPVHSKQLNGLDSLLSIVQMPKGVPVATMSIGGNGAHNAAITAVSILSISNSEIAGRLKKWREKQTKEVKEKPIS

SEQ ID NO: 52247 - DNA, 486 bp, Bacillus cereus ATCC 10987
  CDS (1)..(486): transl_table=11
atgaaatcactagttggagtcataatgggaagcacgtcagactgggaaacaatgaaatatgcttgtgacattttagatgaattaaatataccgtatgagaaaaaggttgtatccgctcatcggactccggattatatgtttgaatatgcagagacggctcgtgaacgtggattgaaagttattattgcgggagctggtggagcagcacatttaccaggaatggttgcagcgaagacgaatcttcctgtaatcggagttccagttcaatcaaaagcgttaaacggcttagattcattattatccatcgtccaaatgccaggaggggttccagttgcaactgttgcaattggtaaggctggttcaacaaatgctggtttacttgctgcacaaatacttggatcattccatgatgacatatatgatgcattagaattgagaagagaagcaattgaaaaagatgtgcgcgaaggtagtgagctagtatga

SEQ ID NO: 52248 - protein, 161 aa, Bacillus cereus ATCC 10987
MKSLVGVIMGSTSDWETMKYACDILDELNIPYEKKVVSAHRTPDYMFEYAETARERGLKVIIAGAGGAAHLPGMVAAKTNLPVIGVPVQSKALNGLDSLLSIVQMPGGVPVATVAIGKAGSTNAGLLAAQILGSFHDDIYDALELRREAIEKDVREGSELV

SEQ ID NO: 52249 - DNA, 1698 bp, Eremothecium gossypii
  CDS (1)..(1698)
atggaccataggactgtcggtatactgggcggcggccaactgggccgcatgattgtcgaggctgccaaccggctaaacgtgaagaccgtcgtgttggacgggccaaactcgcccgcaaagcaaatcaatgccgtgggagagcacgtggagggcagcttcggggtggctgcggacatcgaggagctcgcgcagcgcagcgacgtgctgactgtggagattgagcatgttgacgtgggcacgctgaggggcctgcaggcgaagatgccatcgcttacaatatacccgacgccggaggccattgagctgatccaggacaagcatgtgcagaaggagcacctgtcggggcacggtgttgcggtggcggagtctatcgcggtcgagggcacggagcctgcgctggtggctgttggcgagcagttggggtacccgtacatgctgaaggcgcgcaagctggcgtacgacggccgggggaactttgtggtgaagagtcgcgacagcatcgcggaggcgctggagacgctggccgacagatcgctctatgcagagcggtgggcgccctttgtgcgcgagctggcggtgatgatcgtgcgatcgccagagggacagctgttctcgtaccctatggtcgagacggtgcaccagaacaacatatgccacctatgctacgcgccagcgcgggttgctgactcaatccagctacgtgccaagcttctagccgaaagagccgtcgcaacgctgcctggcgcgggtatcttcggggtggagatgttcctgctggaggatggcgagctgttggtcaacgagatcgcgccccggccacataattctggccactacaccatcgatgcctgtgtgacctcgcagttcgaggcacacctgcggtcgattcttgggctgccgatgccgcgggggttctcatcgatggctacgtccaacacacacgctattatgctaaatgtgcttggcgacccgcaagtgaaggacaaggaactagcgatatgtgagcgcgccctggaaactcctggagcttcggtatacctgtacgggaaggagtcgaagccgaagaggaaggtcggccacataaatattgtggcttcctccatgcaagaagcggagcgcaaactcaggttcatcaccggcggggcagtgagtttggaagaggatgggcataacccacagggggatgcgtctcccctggttggaatcataatggggtccgactcggatctacccgttatgagcaaggcttgcgagatactgactcagttcggtgtcccatacgaggtgacgattgtctcagcccaccggacccctcataggatgtcgaagtacgccatcgaggcctctgagcgaggaatcaaggctatcattgcaggtgcaggcggtgccgctcatttgccgggaatggtcgcggccatgacccctctccccgtcattggggtgcctgtcaagggttcagtcctcgatggggtcgattcattacattctattgtacagatgcctaggggtgtgccggtggctaccgtcgcaatcaacaatagcaccaatgctgctctactcgctgttagacttctaggagcatacgacaccaagtaccacgccttgatgcaacagtttctcttgaaacaggaggaagaagttctaggcaaggcagaaaagttggaaacgattggatatagggcgtacttggatcaatag

SEQ ID NO: 52250 - protein, 565 aa, Eremothecium gossypii
MDHRTVGILGGGQLGRMIVEAANRLNVKTVVLDGPNSPAKQINAVGEHVEGSFGVAADIEELAQRSDVLTVEIEHVDVGTLRGLQAKMPSLTIYPTPEAIELIQDKHVQKEHLSGHGVAVAESIAVEGTEPALVAVGEQLGYPYMLKARKLAYDGRGNFVVKSRDSIAEALETLADRSLYAERWAPFVRELAVMIVRSPEGQLFSYPMVETVHQNNICHLCYAPARVADSIQLRAKLLAERAVATLPGAGIFGVEMFLLEDGELLVNEIAPRPHNSGHYTIDACVTSQFEAHLRSILGLPMPRGFSSMATSNTHAIMLNVLGDPQVKDKELAICERALETPGASVYLYGKESKPKRKVGHINIVASSMQEAERKLRFITGGAVSLEEDGHNPQGDASPLVGIIMGSDSDLPVMSKACEILTQFGVPYEVTIVSAHRTPHRMSKYAIEASERGIKAIIAGAGGAAHLPGMVAAMTPLPVIGVPVKGSVLDGVDSLHSIVQMPRGVPVATVAINNSTNAALLAVRLLGAYDTKYHALMQQFLLKQEEEVLGKAEKLETIGYRAYLDQ

SEQ ID NO: 52251 - DNA, 477 bp, Methanococcus maripaludis S2
  CDS (1)..(477): transl_table=11
atgataaccataattatgggaagtaaaagcgatgtaaaaattgcagaaaaggcagtttctattttaaaagaatttaaaattgattatgaggtaagagtggcttcagcacacagaacccctgaattagtcgaagaaattgttaaaaattcaaaatcaaaagtatttatcgcaattgcaggacttgcagcgcatttaccgggagttgttgcagcaatgactacaaaaccagttattgcagttccggtcgaaagtaaattagatggacttgatgcattgctaagcgctgttcagatgcctccaggaattcctgcagcttgtgttggaatcgatagaggagaaaatgccgcaattttagctgctgaaatgctctccatttctgatgaaagaattgaaaaaaaattagctgaatttagagaaaatcaaaagaaaaaaatattttcagatgatgcagaagtttcctcactttttaaaaactaa

SEQ ID NO: 52252 - protein, 158 aa, Methanococcus maripaludis S2
MITIIMGSKSDVKIAEKAVSILKEFKIDYEVRVASAHRTPELVEEIVKNSKSKVFIAIAGLAAHLPGVVAAMTTKPVIAVPVESKLDGLDALLSAVQMPPGIPAACVGIDRGENAAILAAEMLSISDERIEKKLAEFRENQKKKIFSDDAEVSSLFKN

SEQ ID NO: 52253 - DNA, 2994 bp, Dictyostelium discoideum
  CDS (1)..(2994)
atgacaacagcaataaataataatattgtaaataaagagtttgacttaaaagataaaacttttttagcatctggtaaaaccaaaaccatttatcaattaaataaagaagatcaatatgttttaattgaatcaaattcagcaattacagctggtgacggtgcaaaaaaggatattttaccaaataaagacatttattcaacaactacaaccgttaacaatttcaaagtattacaattatctggtattaatacccattttgttaaacaagttgaaccaaatgcattcattgcaaagaaatgttcaatgattccattggaagtaattgttagaagattagcaactggtagttatttaaaaagaaatacacatgttacagagggtactaaattcaatccaccattaatcgaatttacattcaaagatgatgttcaacatgatccattagttactgaacaagatattttagagatgaatttaaagattggtggcgttccaatcacttcaaaattattatctcaaactagacatattgcaactttatcatttgaagctttagaaagagcttggcaatcacttgatgtaactttagttgattttaaagttgaatttggtattacatcacaaggtgaattaattttagcagatgttattgataatgattcatggagaatttggccaaaaggtgataaaacattaatgaaagataaacaagtttatcgtaatcttccatctgcactcaatacaccaggtgcaacaccaacaacacaatctggtccattacttaatactttatcagatcaacaattaaaaatgattgaagataattatgcttgggttgcaacttccactgaaaaattagttgaattcactgctgcaaatttaaataataataataataataataataataatagtaataataataataataatacaagttctacatcaagatcaaatagtttaccaaatgtaccatcaataactacaacaccaactcttcaccatcatcatcatcatcatcaacaacaacaaagtggtgttggtaataataataatgttaattcaggatttcaagttcaattaaatcaaccattagttggaattattatgggtagtcaatcagattgggaaactatgaaattagcagcaaatacattaacaacattaggtgtaccatttgaaactagaattgtatcagcacatagaacacctgatagattatttgaatatgcaaaaacagcaaagagtagaggattaaaaattgtgattgcaggtgctggtggtgctgctcatttacctggcatggttgctgcattaactccattgcctgtatttggtgtaccagtgcaatccaaagcattgagtggtgttgatagtttattatcaatcgttcaaatgcctgctggtattcctgttggtactgttgcaattggtgctgctggtgctacaaatgctgctttattatctgctgctgttttggctccttattacccttcaatcgagttaagtttagatttatatagaaagaaacaaactgatgcagttgctgaaatacctgttgataatccaacatcaacatcaactactactactactacaactacatcaaatgcaacatcaattttatcagcaattcatacttcaacaattaatagtaatacatcatcacataataataatcaacaacagcaacaacaacaacaaacaatattaccaacacaaccaactataattaatacaccaacaccagttagatcatcagtatcaagatcacaatcaccattaccatcaggtaatggaagtagtattatatcacaagaaaagacaccattatcaacatttgtactttcaacatgtagaccatcagcattggtattgccaccaggttcaaccattggtattttgggtggcggtcaattagcaagaatgatggctattgcagcagcacaattaggttataagactcatattttctgtccagagaatgatccatccgcttcacatgttgcaacctataccactaaatcaaactataacaactattcagcattggacattttcgcaagacaagtcgatgttgtaacctatgaatttgaaaatattatggttgaaccagttgaatatctaaccaaacaagttgcagtattcccagatccaaagattttaagaacttgtcaagatcgtgttttagagaaaacattcattcaatcattggatataccaacagcacaattccaatctgtcgaatcatttaacgatttaaagagtgcaattgaaaagattggttatccagcaattcttaaatcaaatactatgggttatgatggtaaaggtcaagttaaattaaccgatcaagtcgatcttgaacaagcttggaaaaaggttacctctgaaacttgtgcaaccaaagcaatacttgaacaatatatagagtttgaatcagaagcatcagttattgtagcacgtgctttagatggaacagagttaaccttcccattggttaccaataaacatcgtaatcatattttacgtcaaaccattgcaccagctcaattgccagaatatattcataaacaagccaatgaaattggtttaaagattgctcgttccaatggtttggttggtattattgccgtcgaattatttgtagtgaaaaacaatgaaacaggtcaatactctttaatggtaaatgaattggcaccaagaccacacaatagtggtcattggaccatcgaaggttgtgtaacctctcaatttgaacaattgattcgttgtgtttgtggtttgcctttgggttcagtcgatttcactaaacgtataagtgaagctgaatttattcaacaacaaattccaccaattgtaatgacaaatcttttaggtcaagaagttaacggttgggaaaaaatacttcaaactaaaggttcacatcttcatatctatgctaaaggtgatgcaaaagaaggtcgtaaaatgggtcatgttactcaacaataa

SEQ ID NO: 52254 - protein, 997 aa, Dictyostelium discoideum
MTTAINNNIVNKEFDLKDKTFLASGKTKTIYQLNKEDQYVLIESNSAITAGDGAKKDILPNKDIYSTTTTVNNFKVLQLSGINTHFVKQVEPNAFIAKKCSMIPLEVIVRRLATGSYLKRNTHVTEGTKFNPPLIEFTFKDDVQHDPLVTEQDILEMNLKIGGVPITSKLLSQTRHIATLSFEALERAWQSLDVTLVDFKVEFGITSQGELILADVIDNDSWRIWPKGDKTLMKDKQVYRNLPSALNTPGATPTTQSGPLLNTLSDQQLKMIEDNYAWVATSTEKLVEFTAANLNNNNNNNNNNSNNNNNNTSSTSRSNSLPNVPSITTTPTLHHHHHHHQQQQSGVGNNNNVNSGFQVQLNQPLVGIIMGSQSDWETMKLAANTLTTLGVPFETRIVSAHRTPDRLFEYAKTAKSRGLKIVIAGAGGAAHLPGMVAALTPLPVFGVPVQSKALSGVDSLLSIVQMPAGIPVGTVAIGAAGATNAALLSAAVLAPYYPSIELSLDLYRKKQTDAVAEIPVDNPTSTSTTTTTTTTSNATSILSAIHTSTINSNTSSHNNNQQQQQQQQTILPTQPTIINTPTPVRSSVSRSQSPLPSGNGSSIISQEKTPLSTFVLSTCRPSALVLPPGSTIGILGGGQLARMMAIAAAQLGYKTHIFCPENDPSASHVATYTTKSNYNNYSALDIFARQVDVVTYEFENIMVEPVEYLTKQVAVFPDPKILRTCQDRVLEKTFIQSLDIPTAQFQSVESFNDLKSAIEKIGYPAILKSNTMGYDGKGQVKLTDQVDLEQAWKKVTSETCATKAILEQYIEFESEASVIVARALDGTELTFPLVTNKHRNHILRQTIAPAQLPEYIHKQANEIGLKIARSNGLVGIIAVELFVVKNNETGQYSLMVNELAPRPHNSGHWTIEGCVTSQFEQLIRCVCGLPLGSVDFTKRISEAEFIQQQIPPIVMTNLLGQEVNGWEKILQTKGSHLHIYAKGDAKEGRKMGHVTQQ

SEQ ID NO: 52255 - DNA, 489 bp, Leptospira interrogans serovar Copenhageni str. Fiocruz L1-130
  CDS (1)..(489): transl_table=11
ttgaacacaaaagttgcaatcattatgggaagccattccgattgggaaacgatgaaagaagcggagatcattcttaaagaatttggcgtttctattcacaaagaaattgtttctgcacatagatctcctgagcttatgttagaattttctaaatctgcaaaagaaaaaggttactccgtaatcatcgcaggagcaggaggtgcggcccatcttcccggaatggttgcatcgatgactactcttcctgttttaggagttccaatacaaagtaaaactttaaacggattggatagtttattatccatcgttcaaatgccagggggagttccagtaggaactcttgcgatcggaactgcaggcgcaaaaaatgctggtttattggcagtcagaattcttgcacttcaagatcctatactttccgaaaaactagaacgatatcgtaatcaaattcgagaagacgcactttctaaaaataaggatttattgtga

SEQ ID NO: 52256 - protein, 162 aa, Leptospira interrogans serovar Copenhageni str. Fiocruz L1-130
MNTKVAIIMGSHSDWETMKEAEIILKEFGVSIHKEIVSAHRSPELMLEFSKSAKEKGYSVIIAGAGGAAHLPGMVASMTTLPVLGVPIQSKTLNGLDSLLSIVQMPGGVPVGTLAIGTAGAKNAGLLAVRILALQDPILSEKLERYRNQIREDALSKNKDLL

SEQ ID NO: 52257 - DNA, 495 bp, Thermus thermophilus HB27
  CDS (1)..(495): transl_table=11
atggcgccgttggtaggcctgatcatgggttcccgctccgactgggagaccatgcgccacgcggcggagaccctcgaggccctgggcatcccctacgaggtgcgcgtggtctccgcccaccgcaccccagacctcatggcggagtacgccaagaccgccgaggaacgggggatccaggtgatcatcgccggggccgggggggcggcccacctccccggcatgaccgcggcccacaccgccctgcccgtcctcggggtgccggtggaaagccgggccctagggggcctagactccctcctttccatcgtgcagatgcccgcgggcgtccccgtgggcaccctggccatcgggaaagcaggggcggtgaacgccgctttgcttgccgcaagcatcctgggcctcaagcaccccgagatcctaaagcgcctcaaggcctaccgcaaggcccagacggaggccgtcctcgcccaccccgaccccagggaggaggcgtga

SEQ ID NO: 52258 - protein, 164 aa, Thermus thermophilus HB27
MAPLVGLIMGSRSDWETMRHAAETLEALGIPYEVRVVSAHRTPDLMAEYAKTAEERGIQVIIAGAGGAAHLPGMTAAHTALPVLGVPVESRALGGLDSLLSIVQMPAGVPVGTLAIGKAGAVNAALLAASILGLKHPEILKRLKAYRKAQTEAVLAHPDPREEA

SEQ ID NO: 52259 - DNA, 501 bp, Desulfovibrio vulgaris subsp. vulgaris str. Hildenborough
  CDS (1)..(501): transl_table=11
atgcccaaggtagccatcttcattggcagcatctccgacgaggagaccatcaaaccctgtaccgacgtcctgcgcagcctcggtatcagcttccgcttcacggtgagttccgcgcaccgcacccccgaacgcaccgaacgcctcgtcgaggaacttgaaggctctggaacgcaggtgttcatctgcgcggctggcatggcggcacaccttgcgggggcggtcgccgcccgcaccaccaagcccgtcatcggcatcccggtcacggcctcggcactgggcggcatggacgccctgcttgccacggtgcagatgcctcccggattccccgtcgccaccgtcgccctcgacaaggccggggcacgcaacgcggcatggcttgccgcccagatgctggcacttgccgaccccgaccttgccaagcgcatcgccgatgcacgcgcaggcttccgcgaggatgccgccaaggccggtgccgaccttgaggcgcgctaccccggctag

SEQ ID NO: 52260 - protein, 166 aa, Desulfovibrio vulgaris subsp. vulgaris str. Hildenborough
MPKVAIFIGSISDEETIKPCTDVLRSLGISFRFTVSSAHRTPERTERLVEELEGSGTQVFICAAGMAAHLAGAVAARTTKPVIGIPVTASALGGMDALLATVQMPPGFPVATVALDKAGARNAAWLAAQMLALADPDLAKRIADARAGFREDAAKAGADLEARYPG

SEQ ID NO: 52261 - DNA, 489 bp, Listeria monocytogenes str. 4b F2365
  CDS (1)..(489): transl_table=11
atgcctgctgtaattggtgtcattatggggagtacctcagattgggatacaatgaaaaaagcatgtgatgtattagatgaattagaaatagcttatgagaaaaaagtggtttctgctcatcgtacaccagattttatgtttcaatatgcagaacaagcgcgggaacgtggtttgaaaattattattgccggtgctgggggcgcggcgcatttgccaggtatgattgcggcaaagacgactttgcctgttattggtgtgccaattaaatcaaaagcgttgaatggaatggattcgttactttctattgtacagatgcctggaggtgtcccggtagcgacagttgctattggagaaagtggtgctgtaaatgctggccttctagcggcgcaaattttatccataacggacgatgcaattactaacagattacaaaaaagacgtgctacactagaagaaacagttctagaaagtagtgattatcttggataa

SEQ ID NO: 52262 - protein, 162 aa, Listeria monocytogenes str. 4b F2365
MPAVIGVIMGSTSDWDTMKKACDVLDELEIAYEKKVVSAHRTPDFMFQYAEQARERGLKIIIAGAGGAAHLPGMIAAKTTLPVIGVPIKSKALNGMDSLLSIVQMPGGVPVATVAIGESGAVNAGLLAAQILSITDDAITNRLQKRRATLEETVLESSDYLG

SEQ ID NO: 52263 - DNA, 450 bp, Picrophilus torridus DSM 9790
  CDS (1)..(450): transl_table=11
atgggcagctcatctgatcttgaaaccatgaaacccgcaattgaaacccttgaatcatttggcgttgaggtcatatcaaaaatagtatcggcgcacagaaccccggattttatgtatgaatttgcaaaaggtgcattaaacaatggcatcgaggttattatagcaggtgcaggaggtgccgcgcatctgcccggaatggttgcatccatgacaacattgcctgtcataggcgttccggtgccatcgaggcatctaaacggcctcgattcattgctatcgatagtgcagatgccatcaggcgttccggttgcaaccgttgcaataggcaatgcaaaaaatgcggcattgctagcgctaagaatactgtcaataaagtatgataagataagatcgtatttagaaaaatataataatgatgaaagaaacagggttcttggtgaaaagatatga

SEQ ID NO: 52264 - protein, 149 aa, Picrophilus torridus DSM 9790
MGSSSDLETMKPAIETLESFGVEVISKIVSAHRTPDFMYEFAKGALNNGIEVIIAGAGGAAHLPGMVASMTTLPVIGVPVPSRHLNGLDSLLSIVQMPSGVPVATVAIGNAKNAALLALRILSIKYDKIRSYLEKYNNDERNRVLGEKI

SEQ ID NO: 52265 - DNA, 486 bp, Bacillus anthracis str. Sterne
  CDS (1)..(486): transl_table=11
atgaaatcactagttggagtcataatgggaagcacgtcagactgggaaacaatgaaatatgcttgtgacattttagatgaattaaatataccgtatgagaaaaaggttgtatccgctcatcggactccggattatatgtttgaatatgcagagacggctcgtgaacgtggattgaaagttattattgctggagctggtggagcagcgcatttaccaggaatggttgcagcgaagacgaatcttcctgtaatcggagttccagttcaatcaaaagcgttaaacggcttagattcattattatccatcgtccaaatgccaggaggggttccagttgcaactgttgcaattggtaaggctggttcaacaaatgctggtttacttgctgcacaaatacttggatcattccatgatgacatacatgatgcattagaattgagaagagaagcaattgaaaaagatgtgcgcgaaggtagtgagctagtatga

SEQ ID NO: 52266 - protein, 161 aa, Bacillus anthracis str. Sterne
MKSLVGVIMGSTSDWETMKYACDILDELNIPYEKKVVSAHRTPDYMFEYAETARERGLKVIIAGAGGAAHLPGMVAAKTNLPVIGVPVQSKALNGLDSLLSIVQMPGGVPVATVAIGKAGSTNAGLLAAQILGSFHDDIHDALELRREAIEKDVREGSELV

SEQ ID NO: 52267 - DNA, 498 bp, Bartonella quintana str. Toulouse
  CDS (1)..(498): transl_table=11
atgacgaacgaatcatgtgacgtagcgattttaatgggtagccaatcggattggcaaacgatgcgccatagctcggatattttgacgtgtcttgatatttctcatagttcgcagattgtttcagcccaccgaacaccagaacgactttaccaatttgcaaaaggggcaaaagcagcaggttttaaagttttgatcgccggcgctggaggtgcagcccatcttcctggcatgctagcagcactgactccacttcctgtttttggagttccagtgcattcacaatttttatccggacaagattctttgctttcaattgtgcaaatgcctgcaggaataccggttggcacgctagcaattggcaaagcaggcgcaattaatgcagcgcttttagcagcagcagttatggcagtttatgatgatgatttggcacaacggttacaagattggcgtcagcaacaaacagccagtgtcgcgcaaatccccacaactgagatttaa

SEQ ID NO: 52268 - protein, 165 aa, Bartonella quintana str. Toulouse
MTNESCDVAILMGSQSDWQTMRHSSDILTCLDISHSSQIVSAHRTPERLYQFAKGAKAAGFKVLIAGAGGAAHLPGMLAALTPLPVFGVPVHSQFLSGQDSLLSIVQMPAGIPVGTLAIGKAGAINAALLAAAVMAVYDDDLAQRLQDWRQQQTASVAQIPTTEI

SEQ ID NO: 52269 - DNA, 498 bp, Bartonella henselae str. Houston-1
  CDS (1)..(498): transl_table=11
atgatgaaagaatcatgtgacgtagcgattttaatgggcagtcaatcggattggcaaacgatgcgccatagttcagatattttaacctgtcttggtatttctcatattgcacatattatctcagcccaccgaactcctgaacgactttaccaatttgcaaaaggagcaaaagcagcaggtttcaaagttttgattgccggagctggcggtgcagcgcatcttcctggtatgctagcagcactcacaccgcttcctgtttttggagttccagtgcactcacaatctctctctggtcaagattctttgctttcaattgtgcaaatgccggcaggaataccggttggcacgttagcaattggcaaagcaggagctattaatgcagcacttttagcagcagcagtaatggcagtttatgataatcatttggcacaacggttagacgattggcgtcagcaacaaacagccagtgtcgcgcaaacgcctgcaactgaggtttaa

SEQ ID NO: 52270 - protein, 165 aa, Bartonella henselae str. Houston-1
MMKESCDVAILMGSQSDWQTMRHSSDILTCLGISHIAHIISAHRTPERLYQFAKGAKAAGFKVLIAGAGGAAHLPGMLAALTPLPVFGVPVHSQSLSGQDSLLSIVQMPAGIPVGTLAIGKAGAINAALLAAAVMAVYDNHLAQRLDDWRQQQTASVAQTPATEV

SEQ ID NO: 52271 - DNA, 483 bp, Staphylococcus aureus subsp. aureus MRSA252
  CDS (1)..(483): transl_table=11
gtgaaagtagcagtcattatgggcagttcttccgattggaaaattatgcaagagagttgtaacatgttggattattttgaaattccgtacgaaaaacaagtagtatccgcacatcgtacgccaaaaacgatggttcaatttgcttctgaagcgagagaaagaggtatagacattatcattgcaggcgctggcggtgcggcacatttaccaggtatggttgcatcattaacgacgctaccagttattggagtgccgattgaaacaaaaagtttaaagggtatagattctttattatcaattgttcaaatgccaggaggtattccggttgcaacgactgcaattggtgcagcaggtgctaaaaatgcaggtatacttgcagcaagaatgttaagtattcaaaatccttctttagttgaaaaactaaatcagtatgaatcttcgttaattcaaaaagtggaggacatgcaaaatgaacttcaataa

SEQ ID NO: 52272 - protein, 160 aa, Staphylococcus aureus subsp. aureus MRSA252
MKVAVIMGSSSDWKIMQESCNMLDYFEIPYEKQVVSAHRTPKTMVQFASEARERGIDIIIAGAGGAAHLPGMVASLTTLPVIGVPIETKSLKGIDSLLSIVQMPGGIPVATTAIGAAGAKNAGILAARMLSIQNPSLVEKLNQYESSLIQKVEDMQNELQ

SEQ ID NO: 52273 - DNA, 483 bp, Staphylococcus aureus subsp. aureus MSSA476
  CDS (1)..(483): transl_table=11
gtgaaagtagcagtcattatgggcagttcttccgattggaaaattatgcaagagagttgtaacatgttggattattttgaaattccgtacgaaaaacaagtagtatccgcacatcgtacgccaaaaatgatggttcaatttgcttctgaagcgagagaaagaggtataaacattatcattgcaggcgctggcggtgcggcacatttaccaggtatggttgcatcattaacgacgctaccagttattggtgtgccgattgaaacaaaaagtttaaagggtatagattctttattatcaattgttcaaatgccaggaggtattccggttgcaacgactgcaattggtgcagcaggtgctaaaaacgcaggtatacttgcagcaagaatgttaagtattcaaaatccttctttagttgaaaaactaaatcagtatgaatcttcgttaattcaaaaagtggaggacatgcaaaatgagcttcaataa

SEQ ID NO: 52274 - protein, 160 aa, Staphylococcus aureus subsp. aureus MSSA476
MKVAVIMGSSSDWKIMQESCNMLDYFEIPYEKQVVSAHRTPKMMVQFASEARERGINIIIAGAGGAAHLPGMVASLTTLPVIGVPIETKSLKGIDSLLSIVQMPGGIPVATTAIGAAGAKNAGILAARMLSIQNPSLVEKLNQYESSLIQKVEDMQNELQ

SEQ ID NO: 52275 - DNA, 516 bp, Acinetobacter sp. ADP1
  CDS (1)..(516): transl_table=11
atgaacgcggtcgcagcgaaagatgctcaacccttagtcggaattattatgggttctcaatcggattgggcaactctagaacatactgccaatatgttgaaacaacttggtgtaccttttgaagctgaagttgtttccgcacaccggacaccagaccgtttatttgaatacgcagaaactgcgcgtgaccgtggtattcaggtgatcattgcaggtgcaggtggtgccgcgcatttaccagggatgtgtgctgccaaaaccgatttacccgttttaggtgttcctgtgaaatcatcaattttaaatggtgtggattctttgctttcaattgtacaaatgcctgcaggtattgcagtgggtacattggcgataggccctgcgggtgcaaccaatgctgcgattatggcagcccagattcttggcttgacccgtccagagattgcaaaaaatgttgtagattttcgtgcggcccaaaccgacaaggttgctagcaataatattccaggccaagcgtga

SEQ ID NO: 52276 - protein, 171 aa, Acinetobacter sp. ADP1
MNAVAAKDAQPLVGIIMGSQSDWATLEHTANMLKQLGVPFEAEVVSAHRTPDRLFEYAETARDRGIQVIIAGAGGAAHLPGMCAAKTDLPVLGVPVKSSILNGVDSLLSIVQMPAGIAVGTLAIGPAGATNAAIMAAQILGLTRPEIAKNVVDFRAAQTDKVASNNIPGQA

SEQ ID NO: 52277 - DNA, 510 bp, Erwinia carotovora subsp. atroseptica SCRI1043
  CDS (1)..(510): transl_table=11
atgtcatccaacgttgccccggctaaaattgccatcgtcatgggttcaaagagtgactgggccactatgcagtttgctgcggaaatcctcaccacgctgaacattccttttcataccgaagtcgtttccgcacaccggacgccggataaactgttcagcttcgctgagcaggcggcacaaaatggttttgatgtgattatcgctggcgctggcggcgcagcacacctgccaggtatgctggcagcgaaaacgctggttcctgtgctcggcgtgccagtacaaagctcgacgctgagcggtgtcgacagcctgtattccatcgttcaaatgcctcgtggtatcccggtcggcacgttggcaatcggcaaggcaggcgcagcgaatgcggctctgctggccgcacaaattcttgccctgcatgacaatggaatagcctctcgactagccgactggcgtcaggcgcaaacggatgatgtgctgtctcatcccgatccgcgggaggaggcatga

SEQ ID NO: 52278 - protein, 169 aa, Erwinia carotovora subsp. atroseptica SCRI1043
MSSNVAPAKIAIVMGSKSDWATMQFAAEILTTLNIPFHTEVVSAHRTPDKLFSFAEQAAQNGFDVIIAGAGGAAHLPGMLAAKTLVPVLGVPVQSSTLSGVDSLYSIVQMPRGIPVGTLAIGKAGAANAALLAAQILALHDNGIASRLADWRQAQTDDVLSHPDPREEA

SEQ ID NO: 52279 - DNA, 591 bp, Propionibacterium acnes KPA171202
  CDS (1)..(591): transl_table=11
atgcctgagaccaccactgctagccgtaagccgcgccgaggtgagaaggtcaaaacaaccaccgggggagcacgccggctggcgtgcgacgccaatggccctcaagtgtcgatcatcatgggctcggactctgactggccgacgatggagcctgcggctcaggtgcttaccgacttcaatgtgggatttgaggctgacgtcgtgtcggcccaccgcatgcctgaggacatgatcgagttcggtcgaggcgcgcacaagcgcggtatcaaggtgatcatcgccggtgctggcggtgccgcccatctgccgggcatggtcgccgcgctgaccccgctgccggttatcggggttcccgtgccgctagcccacctcgacggtatggattccttgctatcgatcgttcagatgccaggtggtgtgccggtggcgacggtcggcgtcggtaatgccaagaacgccggcctgctagcggtacggattcttgccgcgtcgacccctgagctgtgcgaggccatggtcaagtaccagtccgatttgcacgatgtggctgcgggcaagggcgagaaagtgcgtcgtcactcctgtccctga

SEQ ID NO: 52280 - protein, 196 aa, Propionibacterium acnes KPA171202
MPETTTASRKPRRGEKVKTTTGGARRLACDANGPQVSIIMGSDSDWPTMEPAAQVLTDFNVGFEADVVSAHRMPEDMIEFGRGAHKRGIKVIIAGAGGAAHLPGMVAALTPLPVIGVPVPLAHLDGMDSLLSIVQMPGGVPVATVGVGNAKNAGLLAVRILAASTPELCEAMVKYQSDLHDVAAGKGEKVRRHSCP

SEQ ID NO: 52281 - DNA, 612 bp, Streptococcus pyogenes MGAS10394
  CDS (1)..(612): transl_table=11
atgctaaagcacctagtcgccctgacgtgggttcgtcttcgaaatcaaagatttcggacttaccgcatatttttctacggaaagtttcgacaagtcgaaacgcccctttatatcttaattatgaaaactccaattatttctattatcatgggctccaaatctgactgggcaaccatgcaaaaaacggctgaaattctagacaactttggcattgcttacgagaagaaagtcgtctctgctcaccgcacgcccgacctcatgttcaagcatgctgaggaagcacgtggtcgtggcatcaaaatcatcatcgcaggagcaggtggggcagctcacttgcctggtatggtggcagctaaaacaacgctgcctgttatcggtgtgccagtcaaatcacgtgtcctttcaggtttggattcgctctattccattgtgcagatgcctggcggtgtgcctgtggcaaccatggctatcggagaagcgggagcgactaacgctgccctaacagccctccgtatcctttctatcgaggaccaaaatctggctgatgcgctagctcatttccatgaggaacaaggaaaaatcgcagaggagtcaagcaatgaactcatttaa

SEQ ID NO: 52282 - protein, 203 aa, Streptococcus pyogenes MGAS10394
MLKHLVALTWVRLRNQRFRTYRIFFYGKFRQVETPLYILIMKTPIISIIMGSKSDWATMQKTAEILDNFGIAYEKKVVSAHRTPDLMFKHAEEARGRGIKIIIAGAGGAAHLPGMVAAKTTLPVIGVPVKSRVLSGLDSLYSIVQMPGGVPVATMAIGEAGATNAALTALRILSIEDQNLADALAHFHEEQGKIAEESSNELI

SEQ ID NO: 52283 - DNA, 504 bp, Leifsonia xyli subsp. xyli str. CTCB07
  CDS (1)..(504): transl_table=11
atgtccgttccacccccgcccttggtgtccgtcgtgatgggttccgactcggactggccggtgatgcaggaagcctcgcggctgctcgccgaattcggtgtcgcgcacgaggtcgaggtcgtctccgcccaccgcacgccggagaggatgatcggcttcggcaaggtcgcggcctcccgcggtgtccgtgtgatcatcgccggagcggggggagccgcccacctgcccgggatgctcgccgccgtcaccacgctgcccgtggtgggcgttcctgtgccgctggcccgtctcgatgggctcgactcgctgctctcgatcgtgcagatgccggcgggcgtgccggtcgcgaccgtctccatcggcggtgcgcgcaacgcgggtcttctggccgtgaagatcctcgccacggccgatcccaggctcgcgagcatgcttgagcgcttcgccgccgaactggaggcgagcgtcgacgagaagaaccgcgcactgcaagcgaagctatga

SEQ ID NO: 52284 - protein, 167 aa, Leifsonia xyli subsp. xyli str. CTCB07
MSVPPPPLVSVVMGSDSDWPVMQEASRLLAEFGVAHEVEVVSAHRTPERMIGFGKVAASRGVRVIIAGAGGAAHLPGMLAAVTTLPVVGVPVPLARLDGLDSLLSIVQMPAGVPVATVSIGGARNAGLLAVKILATADPRLASMLERFAAELEASVDEKNRALQAKL

SEQ ID NO: 52285 - DNA, 1773 bp, Desulfotalea psychrophila LSv54
  CDS (1)..(1773): transl_table=11
atgaaggttcttgttgtgggttctggtgggcgtgagcatgcccttgtgtggaaaataaagcaaagtcagaaggttgaggaagttttttgtgcgcctggcaatgcagggattgaagaacttgctacctgcgtcaatatttcagcgaccgatataaagggtttgcttcattttgcccagaaagagaaaattgatcttaccgttgtagggccagaatcatctttggttgctggtatcgtggatctttttgaagaaaatggcctgcgtatatttggtcccagccaggctgccgcaatccttgagggaagtaaggtttttaccaaaaactttttgcaaaaatattctatcccgactgcagcctttggtgtctttaccgagcgagaggcggcaaaagagtacatcgagcaacagggtgcacccattgtagtaaaggcagatgggcttgccgcaggtaagggtgttgtggttgctaagaccatcgaggaagccaaaaaagccgtcgatgaaattatgcttgataaggcctttggtgaggctggtgatagtattgtcgtggagagttgtctcttgggtgaagaggcatcctttatcgcctttaccgatgggaaaacaattcttcccttgcctacctctcaggatcacaaggccgcatatgacggggataaggggcccaatacaggcggaatgggtgcctattcaccggcaccaatagtgaccgatgaaattacagaatatgtgatgacagaggttatgctaccaacgattaagggacttgccgctgagggacgtccctataagggtatgctctatgctggcctgatgatcgatggcgatgatattaaggtgcttgagtttaactgtcgatttggtgatccggaggcccagcctcttctcatgcgtcttaaaagtgatattattgatatctttgaagcatgcatagatggtacccttgatcgggtcgagatgaagattgatccacgccccacggtttgtgtggttatgtcctccggtggttaccccggagcatatgccagtggtgatattattaccggttttgagcaagccgataaggtggatggagtcgaagtgttccatgcaggaactgcgaaggagggtgaagctattgttagcaatggtggtcgagtattaggtattacctccattggtaaaactcttgagcaggcactggagagggcatataaggcaacagactgtattacttggaataagtgcttttatcgaaaagatataggtggcaaggccctggctaaaaagctggcgaagccgagtaagcctcttgtcggtattgtcatgggcagtgattcggatctgccaaccatgagggcagccagtgattttttacagagtgttggcattccctatgaaatgaccgttgcctcggcgcatagaactccggagagagcagctgaatatgccaaaactgcgtcggcacgtgggttgaaaatgattattgccggagcaggcatggcggctcaccttgcaggagttttagcatctcataccgatctgcctgtaattggcgttcctcttgacgcctcatccctgcagggaatggatgcactgctggcgacggtacagatgcctcctggtattcccgttgcaaccatgggtataggaaaatcaggagcaaaaaatgcggcagtattagccctacgaattttggccctgaacgatcatactcttgccaaagaacttgtcaatttccgggaaaacatggtgagggaagttgaggaaaaagcaaaacgaattcagtag

SEQ ID NO: 52286 - protein, 590 aa, Desulfotalea psychrophila LSv54
MKVLVVGSGGREHALVWKIKQSQKVEEVFCAPGNAGIEELATCVNISATDIKGLLHFAQKEKIDLTVVGPESSLVAGIVDLFEENGLRIFGPSQAAAILEGSKVFTKNFLQKYSIPTAAFGVFTEREAAKEYIEQQGAPIVVKADGLAAGKGVVVAKTIEEAKKAVDEIMLDKAFGEAGDSIVVESCLLGEEASFIAFTDGKTILPLPTSQDHKAAYDGDKGPNTGGMGAYSPAPIVTDEITEYVMTEVMLPTIKGLAAEGRPYKGMLYAGLMIDGDDIKVLEFNCRFGDPEAQPLLMRLKSDIIDIFEACIDGTLDRVEMKIDPRPTVCVVMSSGGYPGAYASGDIITGFEQADKVDGVEVFHAGTAKEGEAIVSNGGRVLGITSIGKTLEQALERAYKATDCITWNKCFYRKDIGGKALAKKLAKPSKPLVGIVMGSDSDLPTMRAASDFLQSVGIPYEMTVASAHRTPERAAEYAKTASARGLKMIIAGAGMAAHLAGVLASHTDLPVIGVPLDASSLQGMDALLATVQMPPGIPVATMGIGKSGAKNAAVLALRILALNDHTLAKELVNFRENMVREVEEKAKRIQ

SEQ ID NO: 52287 - DNA, 525 bp, Yersinia pseudotuberculosis IP 32953
  CDS (1)..(525): transl_table=11
atgggagccaacctcaattcagcttatgcagccggggttaaaatcgccatcgtaatggggtccaagagtgattgggccaccatgcagttcgccgccgacgttctcaccacgctcaatgttccgtttcatgtggaagtcgtctctgcacaccgcaccccagataggttgttcagctttgccgaacaggccgaagccaatggcttacatgtgatcattgccggtgccggtggcgcagcacatttgccagggatgctggccgccaaaacgctggtgccggttttaggggttccggtgcaaagtgcggccttgagtggcgttgatagcctgtactcaattgtgcaaatgccacgcggcattcctgtgggaacgctcgctatcggtaaagccggtgcggcaaatgcggcgttgctggccgcacaaatcttagcattacacgatactgaattagccggccgcttagcacattggcgtcaaagccaaacggatgacgtgctggacaaccccgatccgagggaagaagcatga

SEQ ID NO: 52288 - protein, 174 aa, Yersinia pseudotuberculosis IP 32953
MGANLNSAYAAGVKIAIVMGSKSDWATMQFAADVLTTLNVPFHVEVVSAHRTPDRLFSFAEQAEANGLHVIIAGAGGAAHLPGMLAAKTLVPVLGVPVQSAALSGVDSLYSIVQMPRGIPVGTLAIGKAGAANAALLAAQILALHDTELAGRLAHWRQSQTDDVLDNPDPREEA

SEQ ID NO: 52289 - DNA, 498 bp, Symbiobacterium thermophilum IAM 14863
  CDS (1)..(498): transl_table=11
atggcgcagacggagaggaccggaccgcttgtgggcatcatcatgggcagccgctcggacctggagaccatgcaggaggccgccgccgttctggacgagctcggcattccctacgagatgaaggtcgtctcggcccaccgcacacccgacgcgatgttcgcctacgccgagtcggccgcggcgcggggactgaaggtgatcatcgccggcgccggcggagccgcgcacctgccgggcatgaccgcgtccaagaccctccttccggtgatcggcgtgccggtgaagtcctcgaccctgaacgggatcgactcgctgctctccatcgtgcagatgcccgggggcgtgcctgtggcgaccatggccatcggcaaggccggcgcccgcaatgccgggctgctggcagcccagatcctcgccctggaggacccggggctgagggccatcctggaggagtaccgggcctacatgcggcagcaggtggaggagagccagccatga

SEQ ID NO: 52290 - protein, 165 aa, Symbiobacterium thermophilum IAM 14863
MAQTERTGPLVGIIMGSRSDLETMQEAAAVLDELGIPYEMKVVSAHRTPDAMFAYAESAAARGLKVIIAGAGGAAHLPGMTASKTLLPVIGVPVKSSTLNGIDSLLSIVQMPGGVPVATMAIGKAGARNAGLLAAQILALEDPGLRAILEEYRAYMRQQVEESQP

SEQ ID NO: 52291 - DNA, 498 bp, Mannheimia succiniciproducens MBEL55E
  CDS (1)..(498): transl_table=11
atgtcaaatactcatgctcaaattgcaattgttatgggttcgaaaagcgattggtcgaccatgcaggaagcgactggtatgcttgatcaactcaatgtgccttatcatgttgaaattgtttccgcacatcgcacgccggataaacttttcagctttgccgaaaatgcgcaagctaaaggatataaagtgattattgccggtgcaggcggcgccgcccatttaccgggcatgattgcggctaaaaccttagtacctgttttaggcgtgccggttaaaagctcaatgttaagcggtgttgacagtctctattctatcgtgcaaatgccgaaagggattcccgtagggacattagctatcggtcctgccggcgctgccaatgcaggcttacttgcggcgcagattttagccgcatgggacagtgaattgtccgctcgtctgcaaaaattccgcgaacagcaaaccaatgcggtgttaaacaatccggatccacgaaattaa

SEQ ID NO: 52292 - protein, 165 aa, Mannheimia succiniciproducens MBEL55E
MSNTHAQIAIVMGSKSDWSTMQEATGMLDQLNVPYHVEIVSAHRTPDKLFSFAENAQAKGYKVIIAGAGGAAHLPGMIAAKTLVPVLGVPVKSSMLSGVDSLYSIVQMPKGIPVGTLAIGPAGAANAGLLAAQILAAWDSELSARLQKFREQQTNAVLNNPDPRN

SEQ ID NO: 52293 - DNA, 501 bp, Legionella pneumophila subsp. pneumophila str. Philadelphia 1
  CDS (1)..(501): transl_table=11
atgaaacccattttaataggtctaattatgggttctcaaagtgattggcaaacattaatccatgccgcccacacactggatgcgctaaacattggctatgaggcagaaattgtctccgctcataggacaccggacaaacttttccggtatgccgaacaggctgaggcaagaggtttggaagtgattattgctggtgcaggaggagcggctcatctccctggcatggtagcagccaaaacatctttgcctgttttaggtgtcccagtcatgtcacaaactttaaacggcgtcgattccttgctatccattgtgcaaatgcctgcggggatacctgtaggcactttatcgataggtaaagcaggtgccatcaactccgcactgtttgcagccgcaattcttgctaataaatatcctgatattcgagctgccttaaaacactatagagaacaacaaacacaaaaagtgctcgacaatccaaaccctaaagaggaaaagtcatga

SEQ ID NO: 52294 - protein, 166 aa, Legionella pneumophila subsp. pneumophila str. Philadelphia 1
MKPILIGLIMGSQSDWQTLIHAAHTLDALNIGYEAEIVSAHRTPDKLFRYAEQAEARGLEVIIAGAGGAAHLPGMVAAKTSLPVLGVPVMSQTLNGVDSLLSIVQMPAGIPVGTLSIGKAGAINSALFAAAILANKYPDIRAALKHYREQQTQKVLDNPNPKEEKS

SEQ ID NO: 52295 - DNA, 519 bp, Burkholderia mallei ATCC 23344
  CDS (1)..(519): transl_table=11
atgagcgaagtccagaccgcccacacgcacagcgcgccgctcgtcggcgtgctgatgggttccagctccgactgggacgtgatgaagcatgccgtcgcgattctgcaggaattcgacgtgccgtacgaggcgagggtcgtgtccgcgcaccggatgcccgacgagatgttcgactacgcgcagcaggcgcgcgagcgcggcctgcgcgcgatcatcgcgggcgcgggcggcgccgcgcacctgcccggcatgctcgccgcgaagacgacggtgcccgtgctcggcgtgcccgtcgcgagcaagtacctgaagggcgtcgattcgctgcactcgatcgtgcagatgccgaagggcgtgcccgtggcgacgttcgcgatcggcgaggccggcgcggcgaacgcggcgctcttcgcggtgtcgatcctgtccggcacgtcggccgactatgcgaaccggctcgccgcgttccgcgtgcggcagaacgaggccgcgcacgcgatggcgctgccgccgctgtga

SEQ ID NO: 52296 - protein, 172 aa, Burkholderia mallei ATCC 23344
MSEVQTAHTHSAPLVGVLMGSSSDWDVMKHAVAILQEFDVPYEARVVSAHRMPDEMFDYAQQARERGLRAIIAGAGGAAHLPGMLAAKTTVPVLGVPVASKYLKGVDSLHSIVQMPKGVPVATFAIGEAGAANAALFAVSILSGTSADYANRLAAFRVRQNEAAHAMALPPL

SEQ ID NO: 52297 - DNA, 489 bp, Methylococcus capsulatus str. Bath
  CDS (1)..(489): transl_table=11
atggttcaggtcggtatcgtgatggggagtaccagcgactgggaggtcatgcagcacgctgtccgcaagctcgaggagttcggtatcccctgcgaggccaaggtggtgtccgcccatcgtacgccggacctgttgttcgactatgcggaacgggcccggtcccgcggcctcaagtgcatcatcgccggtgcaggcggcgcggcccatctgcccggaatgatggcggccaagaccactgtgccggttttgggcgtaccggtgcccggcagacatctcggcgggcaggattcactgtattcgatcgtgcagatgcccaagggcgtgcccgtggcgacgtttgccatcggcgaggcgggagcggtcaacgccgcgctgttcgcggtggccctgctggcgaacggcgatccggccctgcagcttcgtctcgacgagttccgccggcatcaggccgaatccgtattggcggcacgattgccggaggtgccctga

SEQ ID NO: 52298 - protein, 162 aa, Methylococcus capsulatus str. Bath
MVQVGIVMGSTSDWEVMQHAVRKLEEFGIPCEAKVVSAHRTPDLLFDYAERARSRGLKCIIAGAGGAAHLPGMMAAKTTVPVLGVPVPGRHLGGQDSLYSIVQMPKGVPVATFAIGEAGAVNAALFAVALLANGDPALQLRLDEFRRHQAESVLAARLPEVP

SEQ ID NO: 52299 - DNA, 507 bp, Nocardia farcinica IFM 10152
  CDS (1)..(507): transl_table=11
atggacaccgcaggcccggccgtggggctgatcatgggcagcgactcggactggccgacgatggaggccgccgccgaggcgctggccgagttcggcgtccggttcgaggtgggtgtcgtctccgcgcaccgcaccccgcagcgcatgctcgactacgcgcgccgggccgcggaccgcggggtgaaggtgatcatcgccggtgcgggcggcgccgcccacctgccgggcatggtcgcctccgccacgccgctgccggtgatcggcgtgcccgtgccgctgaaatacctcgacggcatggactccctgctgtccatcgtgcagatgcccgcgggcgtgcccgtggccaccgtctccatcggcggcgcccgcaacgccggcctgctcgccgtccgcatcctcgccgccaccgaccccaccctgcgcgcccgcatggaacagttccaggccgacctggaaaaactcgtcctcgacaaggacgaagccctccgcaccaaactcctcggctga

SEQ ID NO: 52300 - protein, 168 aa, Nocardia farcinica IFM 10152
MDTAGPAVGLIMGSDSDWPTMEAAAEALAEFGVRFEVGVVSAHRTPQRMLDYARRAADRGVKVIIAGAGGAAHLPGMVASATPLPVIGVPVPLKYLDGMDSLLSIVQMPAGVPVATVSIGGARNAGLLAVRILAATDPTLRARMEQFQADLEKLVLDKDEALRTKLLG

SEQ ID NO: 52301 - DNA, 501 bp, Legionella pneumophila str. Paris
  CDS (1)..(501): transl_table=11
atgaaacccatattaataggtctaattatgggttctcaaagtgattggcaaacattaatccatgccgcccaaacactggatgcgctcaacattggctatgaggcagaaattgtctccgctcatagaacacccgacaaacttttccagtatgcggaacaggctgagaaaagaggtttggaagtgattattgctggtgcaggaggagcggctcatctcccaggcatggtagcagccaaaacatctttgcctgttttaggtgttcctgtcatgtcacaaactttaaacggcgtcgattccctgctatccattgtgcaaatgcctgcagggatacctgtagggactttatcgataggtaaagcaggtgccattaattctgcactgtttgcagctgcaattcttgctaataaatatcctgatattcgagctgccttaaaacgctatcgagaacaacaaacacaaaaagtgctcgacaatccaaaccctaaagaggaaaagtcatga

SEQ ID NO: 52302 - protein, 166 aa, Legionella pneumophila str. Paris
MKPILIGLIMGSQSDWQTLIHAAQTLDALNIGYEAEIVSAHRTPDKLFQYAEQAEKRGLEVIIAGAGGAAHLPGMVAAKTSLPVLGVPVMSQTLNGVDSLLSIVQMPAGIPVGTLSIGKAGAINSALFAAAILANKYPDIRAALKRYREQQTQKVLDNPNPKEEKS

SEQ ID NO: 52303 - DNA, 501 bp, Legionella pneumophila str. Lens
  CDS (1)..(501): transl_table=11
atgaaacccattttaataggtctaattatgggctctcaaagtgattggcaaacattaatccatgccgcccaaacactggatgcgctaaacattagctatgaggcagaaattgtctctgctcataggacacccgacaaacttttccagtatgcggaacaggctgagacaagaggtttggaagtgattattgctggtgcaggaggagcggctcatctccctggcatggtagcagccaaaacatccttgcctgttttaggtgtcccagtcatgtcacaaactttaaacggcgtcgattccttgctatccattgtgcaaatgcccgcggggatacctgtaggcactttatcgataggtaaagcaggtgccatcaactctgcactgtttgcagctgcaattcttgctaataaatatcctgacatccaagctgccttaaaacgctatcgagaacaacaaacacaaaaagtgctcgacaatccaaaccctaaagaggaaaagtcatga

SEQ ID NO: 52304 - protein, 166 aa, Legionella pneumophila str. Lens
MKPILIGLIMGSQSDWQTLIHAAQTLDALNISYEAEIVSAHRTPDKLFQYAEQAETRGLEVIIAGAGGAAHLPGMVAAKTSLPVLGVPVMSQTLNGVDSLLSIVQMPAGIPVGTLSIGKAGAINSALFAAAILANKYPDIQAALKRYREQQTQKVLDNPNPKEEKS

SEQ ID NO: 52305 - DNA, 606 bp, Photobacterium profundum SS9
  CDS (1)..(606): transl_table=11
gtgtcaccacattcagcaataatcattctcgatctattcggaatttcctctataatacttacgcaatcgattacgttacttaatatggaaggaaagatgatgactaagccatttgtagctgttttgatgggttcagattcagatttgccagtaatgcaggcaacgcttgatgttttaaaatcttttgaaattacgactgaagtgaaagtaacttctgctcaccgtacaccagccgcaacgcatagctatgtgactgatgctgaagcgcgtggttgtggcgtatttatttgtgcagcaggcttagcggcacatttagcaggtgctgttgctggtattacaacattacctgttatcggagtgccaattgatgctggtcctctaaaaggaatggatgcattactttcaactgcaatgatgccaggtggtgtacctgttgctaccgttgctattggtagcgctggtgcaaaaaacgcaggttacttagcggcacaaattctagcgactggcgataaagcgctagcattagcagtaaaagctgatcgtcaaaagaacgctgaagctgttattgcgaaagatgcagctttacaagagcgtctaaagggctaa

SEQ ID NO: 52306 - protein, 201 aa, Photobacterium profundum SS9
MSPHSAIIILDLFGISSIILTQSITLLNMEGKMMTKPFVAVLMGSDSDLPVMQATLDVLKSFEITTEVKVTSAHRTPAATHSYVTDAEARGCGVFICAAGLAAHLAGAVAGITTLPVIGVPIDAGPLKGMDALLSTAMMPGGVPVATVAIGSAGAKNAGYLAAQILATGDKALALAVKADRQKNAEAVIAKDAALQERLKG

SEQ ID NO: 52307 - DNA, 651 bp, Haloarcula marismortui ATCC 43049
  CDS (1)..(651): transl_table=11
atgcccgcagacaacgtgcagtcgcttatcgaccagttgcacgaagaggccgagatggaccgaccgaacgacctgacgcccgatgtcggcatcatcatgggctccgactcagacctgccgacgatggccggcggacagggcaagcgaccgggagcctacgcggcgctcgccgacgaactcggcttcgaggaacagacggactacactgacgcgcccgagagccgcttcaccttcgaaacgttcgtttgctcggcccatcggacgccggacctgatgtacgcgtacgcagagacggccgccgaccgcggtatcgacgtgataatcgctggcgctggcggtaaatccgctgacctgccgaacatgaccgccagcatcgcctacccgctgccagtcatcggtgtcccagtgcaggagaaatccgtcgactcggttatcgggatgccacagggcgcgccgatgacggcggtcgacgccggcaagtcgttcaacgccgccctctcagcggcacaaatccttgcacggcagcacgacgaactccgtgaccggctcgtctcgtaccacgagggactccaggccgacgttggcgaggcgtcgcgtgacctccacgaactcgggacgcccggattcaaacgcgagtattgggacgagtga

SEQ ID NO: 52308 - protein, 216 aa, Haloarcula marismortui ATCC 43049
MPADNVQSLIDQLHEEAEMDRPNDLTPDVGIIMGSDSDLPTMAGGQGKRPGAYAALADELGFEEQTDYTDAPESRFTFETFVCSAHRTPDLMYAYAETAADRGIDVIIAGAGGKSADLPNMTASIAYPLPVIGVPVQEKSVDSVIGMPQGAPMTAVDAGKSFNAALSAAQILARQHDELRDRLVSYHEGLQADVGEASRDLHELGTPGFKREYWDE

SEQ ID NO: 52309 - DNA, 501 bp, Streptococcus thermophilus LMG 18311
  CDS (1)..(501): transl_table=11
ttgtatcttaatatgaaaccagtaatttccatcatcatgggctcaaaatccgactgggcaaccatgcaaaaagccgctgaagtcctcaataacttcggtgtcgtttacgaaaagaaagttgtttctgcacaccgtacaccggacctcatgttcaagcatgccgaagaagctcgtagccgtggcatcaaggttatcatcgctggtgcgggtggcgcagctcacttgccagggatggtagcagctaaaactacccttccagtcattggcgtgcctgtcaaatctcgtgctcttagcggtgtggattcactttattccatcgttcagatgccaggtggagtaccagtcgcaactatggcgatcggtgaagcaggtgcgaccaacgcagccctctttgcccttcgtcttctctcggtagaagacaaggctattgcagaggcacttgctaactttgctgaagaacaagaaaaaatcgcagaggagtctacaaatgagctcaactaa

SEQ ID NO: 52310 - protein, 166 aa, Streptococcus thermophilus LMG 18311
MYLNMKPVISIIMGSKSDWATMQKAAEVLNNFGVVYEKKVVSAHRTPDLMFKHAEEARSRGIKVIIAGAGGAAHLPGMVAAKTTLPVIGVPVKSRALSGVDSLYSIVQMPGGVPVATMAIGEAGATNAALFALRLLSVEDKAIAEALANFAEEQEKIAEESTNELN

SEQ ID NO: 52311 - DNA, 501 bp, Streptococcus thermophilus CNRZ1066
  CDS (1)..(501): transl_table=11
ttgtatcttaatatgaaaccagtaatttccatcatcatgggctcaaaatccgactgggcaaccatgcaaaaagccgctgaagtcctcaataacttcggtgtcgtttacgaaaagaaagttgtttctgcacaccgtacaccggacctcatgttcaagcatgccgaagaagctcgtagccgtggcatcaaggttatcatcgctggtgcgggtggcgcagctcacttgccagggatggtagcagctaaaactacccttccagtcattggcgtgcctgtcaaatctcgtgctcttagcggtgtggattcactttattccatcgttcagatgccaggtggagtaccagtcgcaactatggcgatcggtgaagcaggtgcgaccaacgcagccctctttgcccttcgtcttctctcggtagaagacaaggctattgcagaggcacttgctaactttgctgaagaacaaggaaaaatcgcagaggagtctacaaatgagctcaactaa

SEQ ID NO: 52312 - protein, 166 aa, Streptococcus thermophilus CNRZ1066
MYLNMKPVISIIMGSKSDWATMQKAAEVLNNFGVVYEKKVVSAHRTPDLMFKHAEEARSRGIKVIIAGAGGAAHLPGMVAAKTTLPVIGVPVKSRALSGVDSLYSIVQMPGGVPVATMAIGEAGATNAALFALRLLSVEDKAIAEALANFAEEQGKIAEESTNELN

SEQ ID NO: 52313 - DNA, 489 bp, Geobacillus kaustophilus HTA426
  CDS (1)..(489): transl_table=11
atgagcccgctcgttggggtgatcatgggaagccattcggattgggaaacgatgaaacatgcttgcgccattttggcggaattgggtgttccgtttgagaaaaaagtcgtatcggcgcaccggacgccggatgagatgtttcggtatgcggagacagccgaggagcgcggcatccgcgtgatcattgccggcgctggcggagcggctcacttgccggggatgatcgcggcgaaaacgacgctgccggtgattggggtgcccgtgcagtcaaaagcattgaatggacttgattcgttattgtcgattgtgcaaatgccaggcggggtgccggtggcgacggtggcgatcggcaaggcgggggcgaccaacgccggactgctcgccgcatcgattcttggactgcttgagccacgctatatggaggcgctcaaagcgcggcgggaagcgattcgcaaacaaatcgtagaaagcagtgatcaatttgactaa

SEQ ID NO: 52314 - protein, 162 aa, Geobacillus kaustophilus HTA426
MSPLVGVIMGSHSDWETMKHACAILAELGVPFEKKVVSAHRTPDEMFRYAETAEERGIRVIIAGAGGAAHLPGMIAAKTTLPVIGVPVQSKALNGLDSLLSIVQMPGGVPVATVAIGKAGATNAGLLAASILGLLEPRYMEALKARREAIRKQIVESSDQFD

SEQ ID NO: 52315 - DNA, 510 bp, Salmonella enterica subsp. enterica serovar Paratyphi A str. ATCC
  CDS (1)..(510): transl_table=11
atgtcttcccgcaataatccggcgcgtgtcgccatcgtgatggggtccaaaagcgactgggctaccatgcaattcgccgccgaaatttttgaaattctggatgtcccgcaccatgtagaagtggtttccgcccatcgcacccccgataagctgttcagcttcgccgaaacggcggaagagaacggatatcaagtgattattgccggcgcgggcggcgcggcgcacctgccgggaatgattgcggcaaaaacgctggtcccggtactcggcgtgccggtacaaagcgctgcgctaagcggcgtggatagcctctactccatcgtgcagatgccgcgcggcattccggtgggtacgctggcgatcggtaaagccggtgccgctaacgccgccctgctcgccgcgcagattctggcgcaacacgacgcggaactgcatcagcgcatcgctgactggcgcaaagcgcaaaccgatgaagttctggaaaatcccgatccgcgggggacgctatga

SEQ ID NO: 52316 - protein, 169 aa, Salmonella enterica subsp. enterica serovar Paratyphi A str. ATCC
MSSRNNPARVAIVMGSKSDWATMQFAAEIFEILDVPHHVEVVSAHRTPDKLFSFAETAEENGYQVIIAGAGGAAHLPGMIAAKTLVPVLGVPVQSAALSGVDSLYSIVQMPRGIPVGTLAIGKAGAANAALLAAQILAQHDAELHQRIADWRKAQTDEVLENPDPRGTL

SEQ ID NO: 52317 - DNA, 501 bp, Anaplasma marginale str. St. Maries
  CDS (1)..(501): transl_table=11
gtgagtaagagcggcgcgcgggtatcagtggtgatgggcagcaagtctgactttcccaccatgagcgctgcgacgtcggttttggatgagctgcgcattgaatttgaggtgatggtagtctcagcccacagaacaccagacaggctgtacgattttgcgaaaactgcgcacacgagaggaatcaaagttataatagccggcgcgggtggggcggcgcatttaccggggatggttgcctcgctaacgagcgttcctgtcataggtgtgcccgtaaagagcgagtgtttgaatggcctggatagcttgttgtctatagtacaaatgcctaaaggcaccccggtcgctactatgtctatcggagtagcgggggcggcaaatgccgccgtgtttgcggcatccatactagggctaagcgatgctggcgtgcagcacaggcttggggagtggaaggcgagtcttacagctgcggttgaggtgtcgccttttgagcggaagcattag

SEQ ID NO: 52318 - protein, 166 aa, Anaplasma marginale str. St. Maries
MSKSGARVSVVMGSKSDFPTMSAATSVLDELRIEFEVMVVSAHRTPDRLYDFAKTAHTRGIKVIIAGAGGAAHLPGMVASLTSVPVIGVPVKSECLNGLDSLLSIVQMPKGTPVATMSIGVAGAANAAVFAASILGLSDAGVQHRLGEWKASLTAAVEVSPFERKH

SEQ ID NO: 52319 - DNA, 492 bp, Idiomarina loihiensis L2TR
  CDS (1)..(492): transl_table=11
atggctccggtattgattctaatgggttcccagtccgattggccggtaatgcaaaaagcggcagaaatgctcgagtccctgggcattaaatggcaggcgaaagtggtctctgcacaccgcacgccggacttacttaaatcgacaatggaacaagcggaacaagatggtgtgcctgtggttattgcgggagccggtggtgctgctcatttaccgggtatgctggcggcttatactgctattccagtgtttggtgtgccggttccgagcaagcagttaaaaggtttagacagcttattgtctattgtgcaaatgcctaagggtgtcgctgttggtactctggctattggcgatgccggcgcggcaaacgcaggcttactggcggcacaggttattggcagctttgacagtgacgtgcgcaaacgggtacacgaattccgcactgcacaaaaagaaaaagtgatggctaactcagacttggaattaccaaaatga

SEQ ID NO: 52320 - protein, 163 aa, Idiomarina loihiensis L2TR
MAPVLILMGSQSDWPVMQKAAEMLESLGIKWQAKVVSAHRTPDLLKSTMEQAEQDGVPVVIAGAGGAAHLPGMLAAYTAIPVFGVPVPSKQLKGLDSLLSIVQMPKGVAVGTLAIGDAGAANAGLLAAQVIGSFDSDVRKRVHEFRTAQKEKVMANSDLELPK

SEQ ID NO: 52321 - DNA, 495 bp, Azoarcus sp. EbN1
  CDS (1)..(495): transl_table=11
atgagcgacaagcccctcgtcgggatcatcatgggctcgaattccgactggccgacgatgcaggcggcggcgaagatgctcgccgaattcgacgtgccgtacgaggcccgcgtggtgtccgcccaccgcacgcccgacctgatgttcgtctatgctgacagcgcgcgcgaacgcggcctcaaggcgatcatcgccggcgcaggcggcgcggcccatctacccggcatggtcgcggcgaagacgacgctgcccgtgctcggcgtgccggtgcagtcgaaggcgctgtcggggcaggattcgctgctgtcgatcgtgcagatgccgaaaggcatcccggtcgcgactttcgcgatcggtgaagccggtgcggcaaatgcggcgcttttcgccatcgcgctgctcgccaacgaggataccgcgctcgccgaaaaactcgccgcgttccgcgcccgccagacgcaggcggtgctcgatatgaccctggacccgatatga

SEQ ID NO: 52322 - protein, 164 aa, Azoarcus sp. EbN1
MSDKPLVGIIMGSNSDWPTMQAAAKMLAEFDVPYEARVVSAHRTPDLMFVYADSARERGLKAIIAGAGGAAHLPGMVAAKTTLPVLGVPVQSKALSGQDSLLSIVQMPKGIPVATFAIGEAGAANAALFAIALLANEDTALAEKLAAFRARQTQAVLDMTLDPI

SEQ ID NO: 52323 - DNA, 540 bp, Zymomonas mobilis subsp. mobilis ZM4
  CDS (1)..(540): transl_table=11
atgaacaaccagcccccctctatagacgaatctagccctgccccgatcattgccttgattatgggcagtcaatccgattgggaaaccatgcatcatgcggcagatgttttatctgcccttaaaattccgtatgaaacgcgtatcatttcagcgcatagaaccccgaaacggttatatgactatgtcggttcgctggtttcaaaagggtttaaagccgttattgcgggtgctggtggggcggcacatttgccgggcatgtccgcggctattacaagattgcctgttttcggggtgccggtgcaatcaaaagccctaaacggcatggatagcttgctttctattgttcagatgcccgccggaattccggttggaacccttgcgattggccgcgcaggtgctatcaatgcggctcttctttctgctgccatacttgccaataatgatgatgatctggccgaaaggttggatcagtggcggcagcgtcaaacggctgatgttcaggatcagccagatactctgccaaggatctcttctttatga

SEQ ID NO: 52324 - protein, 179 aa, Zymomonas mobilis subsp. mobilis ZM4
MNNQPPSIDESSPAPIIALIMGSQSDWETMHHAADVLSALKIPYETRIISAHRTPKRLYDYVGSLVSKGFKAVIAGAGGAAHLPGMSAAITRLPVFGVPVQSKALNGMDSLLSIVQMPAGIPVGTLAIGRAGAINAALLSAAILANNDDDLAERLDQWRQRQTADVQDQPDTLPRISSL

SEQ ID NO: 52325 - DNA, 489 bp, Silicibacter pomeroyi DSS-3
  CDS (1)..(489): transl_table=11
atggccggggtcaaggtagggatcatcatgggcagccagtcggactggccgaccatgaagggtgcagcggaaattctggatgagctgggcgtggcttacgaggcgcggatcgtctcggcgcatcgcaccccggaccggctgtgggactatggccgcgccgccgtggggcgcggcttgcaggtgatcatcgccggggccggcggggccgcgcatctgccgggcatgatggcgtccaagacgcgggtgccggtcattggcgtgccggtgcagacccgggcgctgtcgggggtcgattcgctttactccatcgtgcagatgcccaagggctatccggttgcgaccatggcgatcggcgcggcgggtgccgccaatgcggggctgatggcggccggcatcctcgccctgcaggacgcaggcctggccgaacggctggacgcctggcgcgcggcgctttctgcctcgatccccgaggagccggtcgatgagtga

SEQ ID NO: 52326 - protein, 162 aa, Silicibacter pomeroyi DSS-3
MAGVKVGIIMGSQSDWPTMKGAAEILDELGVAYEARIVSAHRTPDRLWDYGRAAVGRGLQVIIAGAGGAAHLPGMMASKTRVPVIGVPVQTRALSGVDSLYSIVQMPKGYPVATMAIGAAGAANAGLMAAGILALQDAGLAERLDAWRAALSASIPEEPVDE

SEQ ID NO: 52327 - DNA, 492 bp, Francisella tularensis subsp. tularensis SCHU S4
  CDS (1)..(492): transl_table=11
atgagtgtacaagttggtgtaataatgggctctaaatctgattggagtacaatgaaagaatgttgtgatatcttggataatttaggtattggttatgaatgtgaagtagtgtctgctcatcgaactccagataagatgtttgactatgccgaaactgctaaagaaagaggccttaaggttataatagcaggagctggcggtgctgcacatttacctggaatggttgcggcaaaaactactttaccagtattaggtgtaccagttaaatcaagtacacttaatggccaagatagtttattatcaatagtacagatgccagcgggtattccagtagctacttttgcaattggtatggcaggagcaaaaaacgcggcgctttttgctgcaagtatcttgcaacatacagatataaatattgcaaaagcactagctgagtttagagctgagcaaacacgatttgttttggaaaatcctgatcctagggagcactaa

SEQ ID NO: 52328 - protein, 163 aa, Francisella tularensis subsp. tularensis SCHU S4
MSVQVGVIMGSKSDWSTMKECCDILDNLGIGYECEVVSAHRTPDKMFDYAETAKERGLKVIIAGAGGAAHLPGMVAAKTTLPVLGVPVKSSTLNGQDSLLSIVQMPAGIPVATFAIGMAGAKNAALFAASILQHTDINIAKALAEFRAEQTRFVLENPDPREH

SEQ ID NO: 52329 - DNA, 669 bp, Synechococcus elongatus PCC 6301
  CDS (1)..(669): transl_table=11
atgcgaatattcgtcagcagggtaggagcagcggtcatcatcggtctgcatgtaacggccgacccagcaactcaggccgatcgccccaatcttacgtcagtgaccatgtcttctcctgttcctgctgcaccctctgcgctcacccagcctgccgttggcatcatcatgggcagcgactctgatttacccaccatgcgtggcgcgatcgccatctgccagcagtttggcattgcccacgaggtcgaaattgtctccgctcaccgtactccggtgcggatggtggagtacgcccaaacagcccatcagcgcagcctcaaggtgatcattgccggcgcaggcggtgcggcccatttaccgggcatggtggctgccctaactcccctgccggtgattggcgtacctgtgcagacccgcacgttgcagggagtggactcgctctattcgatcgtgcaaatgccggctggcatcccagtagcaaccgtcgcgatcggtaatgccaccaatgcagggctcctagcagtgcaaatgctggctagccacaaccccgaactactccaagcggtgcagacctatcgccaagaattggcgcaaatggtgcaagataagcagactcgcctcagtgcgatcggtgttgaggcctacctcgaaaatgctggtggtcatcactag

SEQ ID NO: 52330 - protein, 222 aa, Synechococcus elongatus PCC 6301
MRIFVSRVGAAVIIGLHVTADPATQADRPNLTSVTMSSPVPAAPSALTQPAVGIIMGSDSDLPTMRGAIAICQQFGIAHEVEIVSAHRTPVRMVEYAQTAHQRSLKVIIAGAGGAAHLPGMVAALTPLPVIGVPVQTRTLQGVDSLYSIVQMPAGIPVATVAIGNATNAGLLAVQMLASHNPELLQAVQTYRQELAQMVQDKQTRLSAIGVEAYLENAGGHH

SEQ ID NO: 52331 - DNA, 492 bp, Bacillus clausii KSM-K16
  CDS (1)..(492): transl_table=11
atgaaacagccgattgtcggcatcattatgggcagtacttctgattgggaaacgatgcgccatgccagtgagattttagacgaacttggcgttccttatgaaaaaaaagtcgtgtccgcccaccgtactcctgattatatgtttgaatacgcggaacaagcggaagagcgtgggcttcgtgtcattattgcaggggcagggggagcggcccatttgccaggaatggtcgcggcaaagacgcttcttccagtcattggcgttcctgttgaatcacgtgccttaaaagggttggactccttgttgtcgattgtgcaaatgccaggaggagtacctgtggctactgtggcaattggcaaagcaggtgcaaccaatgcagcgcttttggctgcgcaaatgattgcaacaacggacaaggtcttgcaacaacgattggcaacgcgccgtgaacgcattaaaaagaccgttctagaaagcagtggtgaactcgtatga

SEQ ID NO: 52332 - protein, 163 aa, Bacillus clausii KSM-K16
MKQPIVGIIMGSTSDWETMRHASEILDELGVPYEKKVVSAHRTPDYMFEYAEQAEERGLRVIIAGAGGAAHLPGMVAAKTLLPVIGVPVESRALKGLDSLLSIVQMPGGVPVATVAIGKAGATNAALLAAQMIATTDKVLQQRLATRRERIKKTVLESSGELV

SEQ ID NO: 52333 - DNA, 513 bp, Ehrlichia ruminantium str. Welgevonden
  CDS (1)..(513): transl_table=11
atgtcgattaacgaagatattgccgatgttgcagtaattatgggaagccaatcagattttccaacaatgaataattcaatatcaatactggaagaattaaacatcagctataaaacaatgatcatatctgctcatagaacaccagaaagactctatacatttgcaaaatcagcagaaacaaatggattcaaaataattatcgctggagcaggaggcgcagctcatctaccaggattagtagcgtctttaacatatcttcccgtaataggagttccaataaaaagcagcaatcttaatggaatagatagtttactatcaatagtacagatgccaaaaggaatacctgtagcaacaatgtcaataggatcttcaggaggatataatgcagcaataatggcagcttctattctagctttatcgaataacataataaaaacaaacttacaaatatggagagataacttatctgcttctgtaaaactattaccagatacatctttgcagacttcataa

SEQ ID NO: 52334 - protein, 170 aa, Ehrlichia ruminantium str. Welgevonden
MSINEDIADVAVIMGSQSDFPTMNNSISILEELNISYKTMIISAHRTPERLYTFAKSAETNGFKIIIAGAGGAAHLPGLVASLTYLPVIGVPIKSSNLNGIDSLLSIVQMPKGIPVATMSIGSSGGYNAAIMAASILALSNNIIKTNLQIWRDNLSASVKLLPDTSLQTS

SEQ ID NO: 52335 - DNA, 465 bp, Dehalococcoides ethenogenes 195
  CDS (1)..(465): transl_table=11
atgccgctagtaagtattgtaatgggctctaaatctgatgccgaggttatgaaacctactgaggaaatactggagaaaatgggcatttcttttgagacgctggttatgtctgctcaccgtactcccgaaaaagtgcaggagttttgtctgggtgcgtccgcacggggggttgaactggttatagctgccgctgggggggcagcccatttgccgggagtaattgccagctggctgacactgccggttataggcgtaccggtggcttcaggtgaactcaaaggggttgatgccctttattccatagtccagatgcccgccggtataccggtagcaaccgtagctatcggagcggccggtgccaagaatgcggcttatctggcggctgaaatactgggtttaaaatatcaaaatatccgtcaggcttatgaaagctaccgtcgggaactaaaaggtgagaacaaatga

SEQ ID NO: 52336 - protein, 154 aa, Dehalococcoides ethenogenes 195
MPLVSIVMGSKSDAEVMKPTEEILEKMGISFETLVMSAHRTPEKVQEFCLGASARGVELVIAAAGGAAHLPGVIASWLTLPVIGVPVASGELKGVDALYSIVQMPAGIPVATVAIGAAGAKNAAYLAAEILGLKYQNIRQAYESYRRELKGENK

SEQ ID NO: 52337 - DNA, 525 bp, Thermococcus kodakarensis KOD1
  CDS (1)..(525): transl_table=11
atgcccaaagtgggaataataatgggtagcgactccgacctcccggtcatgaaggccgcggccgaggtgctcgaggagttcggtgttgactacgagataaccatagtttcagcccacagaacccccgagaggatgttcgagtacgccaaaacggcagaagaaagggggatagaggtaataatagccggagctggaggtgccgcccaccttccgggcatgacggcatccataaccacgctccctgtgataggagtccccgtaaagacatccacgctgaacgggcttgactcgctcctctccatagtccagatgccgaggggagtgcccgttgcaaccgtcgccataaacaacgccaagaacgcggccctgctggccctctcaatcctcggggtgaagtacccggagataagggagaagctcaaggagtacaggaggaggatgagggaagaagtggaggagaaggcggagaggcttgaggagatgggctacgaggagtacctccaagtgacagggcaaggaaagtga

SEQ ID NO: 52338 - protein, 174 aa, Thermococcus kodakarensis KOD1
MPKVGIIMGSDSDLPVMKAAAEVLEEFGVDYEITIVSAHRTPERMFEYAKTAEERGIEVIIAGAGGAAHLPGMTASITTLPVIGVPVKTSTLNGLDSLLSIVQMPRGVPVATVAINNAKNAALLALSILGVKYPEIREKLKEYRRRMREEVEEKAERLEEMGYEEYLQVTGQGK

SEQ ID NO: 52339 - DNA, 483 bp, Staphylococcus epidermidis RP62A
  CDS (1)..(483): transl_table=11
gtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatatttagtcgcaaaagtggaggaaatgcaaaatgaacttcagtaa

SEQ ID NO: 52340 - protein, 160 aa, Staphylococcus epidermidis RP62A
MKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKYLVAKVEEMQNELQ

SEQ ID NO: 52341 - DNA, 483 bp, Gluconobacter oxydans 621H
  CDS (1)..(483): transl_table=11
atgccgatccgtgtcggtgtgatcatgggaagccagtccgactgggataccatgcgccacgcctgcgagatcctcgacgatcttggaattgcccatgaaaagcggattgtttcggctcaccgcacgcccgaccgtctggtggaatacgcaaagacagcccgtcagcgtggccttcatgtgattatcgccggtgcgggtggggcagcacatcttccgggtatgtgttccgcctggacaagcattcccgtcctcggcgttcctgtgcagagtcgtgccctgaacgggcaggacagcctgctctccatcgtgcagatgccgggtggcgtgccggtcgggacgctggcgatcggcaaggccggtgcgatcaatgccggtctgctcgccgcgtcgatcctgtcggtgaacgacaaacaggtcatggcgcgtctggatgcctggcgggcgacgcagacggcggctgttgcggatgtgccggtcgaatga

SEQ ID NO: 52342 - protein, 160 aa, Gluconobacter oxydans 621H
MPIRVGVIMGSQSDWDTMRHACEILDDLGIAHEKRIVSAHRTPDRLVEYAKTARQRGLHVIIAGAGGAAHLPGMCSAWTSIPVLGVPVQSRALNGQDSLLSIVQMPGGVPVGTLAIGKAGAINAGLLAASILSVNDKQVMARLDAWRATQTAAVADVPVE

SEQ ID NO: 52343 - DNA, 486 bp, Lactobacillus acidophilus NCFM
  CDS (1)..(486): transl_table=11
atgtctgaagtaagcgtaattatgggtagtaaatcagattggccaacaatgaagcatgcttgccaaatcttggatcagttcaatgttagttatgacaaacacgtcatttcagcacatagaatgccaaaagaaatgtatgaatttgcccaatctgccgaaaaaaatggtactaaggtaatcatcgctggtgccggcatggcagctcatttgcctggtatgacggctgctaataccgtgattcctgtgatcggcgttcccggtcaaactaaggcattaggcggaatggattctcttttgtctattgtgcaaatgccaacgggcatccctgtagccacaactgctatcggcagtgcaggtgcaagcaatgctgccttgcttgcgttagaaattctcggaataggtaacgaaaaaataagacagcaactaaaaaactatcgacaaaaaatgcatgacgaagcaaaagaaagcggtgtagaacttgactga

SEQ ID NO: 52344 - protein, 161 aa, Lactobacillus acidophilus NCFM
MSEVSVIMGSKSDWPTMKHACQILDQFNVSYDKHVISAHRMPKEMYEFAQSAEKNGTKVIIAGAGMAAHLPGMTAANTVIPVIGVPGQTKALGGMDSLLSIVQMPTGIPVATTAIGSAGASNAALLALEILGIGNEKIRQQLKNYRQKMHDEAKESGVELD

SEQ ID NO: 52345 - DNA, 504 bp, Wolbachia endosymbiont strain TRS of Brugia malayi
  CDS (1)..(504): transl_table=11
atgttgaatatggcggaaataaaaaaagatgttgctgtaattatgggaagtgaatcagactatagcactatgattcatgctgttgatatgttaacagaattaggaattttgcatgacgtgtttataatatctgcacatagaacaccagaaaggctcttcaattttgctcagtctgcacaagaaaaaggctttagagttattatagccggtgcgggaggagcagctcatttacctggtatggttgcatcgctcacttgtttacccgttatcggtgttcctgtacatagtaaacagttaaatgggctggatagtctgttatctatagtacaaatgccaaagggtgtgccggttgcaacaatgtctataggagaaagtggggcttataatgcagcaattgctgctgcatctgtactgtcaatttctaacagtgaaattgctgataggttaaaaaaatggagaaaggaacagaccgaagtagtaaaggaaaaaccagcatcacagtaa

SEQ ID NO: 52346 - protein, 167 aa, Wolbachia endosymbiont strain TRS of Brugia malayi
MLNMAEIKKDVAVIMGSESDYSTMIHAVDMLTELGILHDVFIISAHRTPERLFNFAQSAQEKGFRVIIAGAGGAAHLPGMVASLTCLPVIGVPVHSKQLNGLDSLLSIVQMPKGVPVATMSIGESGAYNAAIAAASVLSISNSEIADRLKKWRKEQTEVVKEKPASQ

SEQ ID NO: 52347 - DNA, 504 bp, Xanthomonas oryzae pv. oryzae KACC10331
  CDS (1)..(504): transl_table=11
atgacctccaaccactccgcgccgctggtcggcatcgtgatgggctcccgttcggattgggagaccatgcaacacgcagcttacaagcttgacgcgctgggcgtgccgtacgaagtcaaggtggtctcggcgcaccgtacccccgacgtattgttcacctacgccgaacaggctggcgaacgcggcctgcgcgcgatcattgccggtgccggcggcgcggcgcatctgccgggcatgctggctgccaagaccgcggtgccggtacttggtgtgccggtgcagtccaaggcgctcaatggcatggattcgctgctatcgatcgtgcagatgccagccggcattccggtggccacctttgccatcggcaatgcgggtgcggccaatgcggcgttgtttgcggcggccatgctggcgcccgagcaggcgcagatcggtcaagcactggggcagttccgcgccaagcagaccgacgatgtcatggcctgcgacgacccgcgtcaatga

SEQ ID NO: 52348 - protein, 167 aa, Xanthomonas oryzae pv. oryzae KACC10331
MTSNHSAPLVGIVMGSRSDWETMQHAAYKLDALGVPYEVKVVSAHRTPDVLFTYAEQAGERGLRAIIAGAGGAAHLPGMLAAKTAVPVLGVPVQSKALNGMDSLLSIVQMPAGIPVATFAIGNAGAANAALFAAAMLAPEQAQIGQALGQFRAKQTDDVMACDDPRQ

SEQ ID NO: 52349 - DNA, 486 bp, Neisseria gonorrhoeae FA 1090
  CDS (1)..(486): transl_table=11
atgatacaaatcggcatcatcatgggcagcaacagcgattggcccgttatgcggcaggcagcgcagtttcttgaagagttcggcgtagaatatgaggcgcgcgtcgtttccgcacaccgcactccggatttgatgtttgaatacgccgaaaccgcacgggcgcgcggcatcaaagccatcatcgcgggtgcgggcggcgcggcgcatttacccggcatggttgccgccaagaccaccgtccccgttttgggcgtacccgtcccaagcaaatacctgcgcggcgaagattcgcttttatcgattgtacaaatgcccaaaggcgtacccgtcgccacattcgccatcggcgaggcaggcgcggcaaatgccgcattgttcgccatctccatgctcgccaacgaaaaccccgaactggcgcaaaaactggcagacttccgagccaaacaggaacaaaccgttttaaacatggaattggaacagatttaa

SEQ ID NO: 52350 - protein, 161 aa, Neisseria gonorrhoeae FA 1090
MIQIGIIMGSNSDWPVMRQAAQFLEEFGVEYEARVVSAHRTPDLMFEYAETARARGIKAIIAGAGGAAHLPGMVAAKTTVPVLGVPVPSKYLRGEDSLLSIVQMPKGVPVATFAIGEAGAANAALFAISMLANENPELAQKLADFRAKQEQTVLNMELEQI

SEQ ID NO: 52351 - DNA, 507 bp, Bacteroides fragilis NCTC 9343
  CDS (1)..(507): transl_table=11
atgactccaatcgtaagcattatcatgggtagcacttccgaccttcctgtcatggaaaaggccgcacagttgctcaacgatctccatgtaccgttcgaaatgaacgccctctcggctcaccgcactcccgaagctgtggaagagtttgccaagaatgcccgctcacgcggcattaaagtaattattgctgctgccggtatggctgcccatctgccgggcgtgattgccgcatcgaccccgcttccggtcatcggtgtacccatcaaatcgtctcttgacggaatggacgcccttctggcgatcgtacagatgcctccggggattcctgtagcgactgtgggtatcaatggcgcactgaacgccgccatccttgccgtacaaatgctttcattggaagataaagaactcgaaacaaaattcatagcctataaagaaggactgaaaaagaaaatcgtaaaggctaacgaagaactgaaagaaattaagtacgagtttaaaacaaactaa

SEQ ID NO: 52352 - protein, 168 aa, Bacteroides fragilis NCTC 9343
MTPIVSIIMGSTSDLPVMEKAAQLLNDLHVPFEMNALSAHRTPEAVEEFAKNARSRGIKVIIAAAGMAAHLPGVIAASTPLPVIGVPIKSSLDGMDALLAIVQMPPGIPVATVGINGALNAAILAVQMLSLEDKELETKFIAYKEGLKKKIVKANEELKEIKYEFKTN

SEQ ID NO: 52353 - DNA, 492 bp, Pseudomonas syringae pv. syringae B728a
  CDS (1)..(492): transl_table=11
atgagcgcactggttggcgtgatcatgggctccaagtccgattggtccacccttagccacaccgccgatatgctggaaaagctcggcatcccttttgaagtcaaggtggtgtcagctcaccgcacaccggatctgctgtttcagtacgccgacgaagcggaaggccgtggcattgaagtgatcatcgccggtgccggcggtgccgctcacttgccgggcatgtgcgctgccaagacccacctgcctgtgctgggcgttccggtgcagtcttcgatgctttcgggggtcgattcgctgttgtcgatcgtgcagatgccggccggtatcccggtcgcgaccctggccatcggcaaggcgggtgcaatcaacgcagcgctgctttcagccagcatccttggcgcaaagcacccgcaattccacgcagcgctgaagaaatttcgcactgaacagacagacagcgtcctggataatccagacccacgccacgcctga

SEQ ID NO: 52354 - protein, 163 aa, Pseudomonas syringae pv. syringae B728a
MSALVGVIMGSKSDWSTLSHTADMLEKLGIPFEVKVVSAHRTPDLLFQYADEAEGRGIEVIIAGAGGAAHLPGMCAAKTHLPVLGVPVQSSMLSGVDSLLSIVQMPAGIPVATLAIGKAGAINAALLSASILGAKHPQFHAALKKFRTEQTDSVLDNPDPRHA

SEQ ID NO: 52355 - DNA, 504 bp, Xanthomonas campestris pv. campestris str. 8004
  CDS (1)..(504): transl_table=11
atgacctccaaccactccgcgccgctggtcggcatcgtgatgggttcccgttcggactgggacaccatgcaacacgcagctcagaagctcgatgcactgggcgtgccgtacgaggtcaaggtggtctcggcccaccgcacaccggatgtgttgttcacctacgccgaacaggcaggcgagcgcggcctgcgcgcgatcatcgccggcgctggcggtgccgcgcatctgcccggcatgctggcggccaagaccgcagtgcccgtgctgggcgtgccggtgcagtccaaggcgctcaacggcatggattcgctgctgtcgatcgtgcagatgccagccggtattccggtggccaccttcgcgatcggcaatgcgggcgctgccaatgcggccctgtttgcagcagcgatgctgtcgccggagcagccgcagatcggtcaggcattggcgcagttccgcgccaagcagaccgacgatgtgatggccagcgacgatccccgccaatga

SEQ ID NO: 52356 - protein, 167 aa, Xanthomonas campestris pv. campestris str. 8004
MTSNHSAPLVGIVMGSRSDWDTMQHAAQKLDALGVPYEVKVVSAHRTPDVLFTYAEQAGERGLRAIIAGAGGAAHLPGMLAAKTAVPVLGVPVQSKALNGMDSLLSIVQMPAGIPVATFAIGNAGAANAALFAAAMLSPEQPQIGQALAQFRAKQTDDVMASDDPRQ

SEQ ID NO: 52357 - DNA, 495 bp, Haemophilus influenzae 86-028NP
  CDS (1)..(495): transl_table=11
atgtcaaaaactgcacaaattgctgttgtgatgggttccaaaagcgattgggctaccatgcaagaggcaactcagattttagatgaattaaaagtaccttatcatgtggaaatcgtctctgctcatcgtacgcctgataaactttttgaatttgctgaaaatgcacaaaaaaatggctataaagtaattattgctggggctggcggtgcggcacatttacccggcatgatcgcagccaaaacccttgtgcctgtgctgggtgtgccagtaaaaagttctatgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcacataa

SEQ ID NO: 52358 - protein, 164 aa, Haemophilus influenzae 86-028NP
MSKTAQIAVVMGSKSDWATMQEATQILDELKVPYHVEIVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELLSRLQSFRESQTSNVLDNPDPRT

SEQ ID NO: 52359 - DNA, 513 bp, Corynebacterium jeikeium K411
  CDS (1)..(513): transl_table=11
atgactgaaaacgcacgcaccccgctggtcggcctggtgatgggctccgactccgactggcccaccgtcgagccagccgccgaggtgttggccgagttcggcatccccttcgaggtcggagtggtctctgcgcaccgcaccccggagcgcatgctcgactacgcccgcaccgcgcacacccgcggcgtgaaggtgatcatcgcctgcgccggcggtgccgcccacctgcccggcatggttgccgcggccactccgctgccggtgatcggcattccgcgtgccctgggcaatctggatggcctggattctctgctctccatcgtgcagatgcccggcggcgtgccgactgccaccgtctccatcgacggtgcgaagaacgccggactgctggctgtgcgcaccctcgcggtggctgacgaggctctgatggacaagatggtcgaataccaggagaacatgcgcgacgcggtgctggagaaggatcgcgccctgcagcagaagctgatggggtga

SEQ ID NO: 52360 - protein, 170 aa, Corynebacterium jeikeium K411
MTENARTPLVGLVMGSDSDWPTVEPAAEVLAEFGIPFEVGVVSAHRTPERMLDYARTAHTRGVKVIIACAGGAAHLPGMVAAATPLPVIGIPRALGNLDGLDSLLSIVQMPGGVPTATVSIDGAKNAGLLAVRTLAVADEALMDKMVEYQENMRDAVLEKDRALQQKLMG

SEQ ID NO: 52361 - DNA, 483 bp, Staphylococcus haemolyticus JCSC1435
  CDS (1)..(483): transl_table=11
gtgaaagtagcggttattatgggtagttcttcagattggaaggttatgcaagaaagttgtgcgatgttagatgaattcgaaataccgtacgaaaagaaagtcgtttcggcacatcgtacgcctaaattaatgtatgaatttgcaagtcaagctagaacaaatggatacgatgtcattattgctggtgcaggtggtgctgcgcatctaccaggaatggttgcatcaatgacaacaatacctgttataggtgtaccgattgagtccaagagtttaaaaggattggattctttattatcgattgttcaaatgccaggaggtattccagtagctacaactgcaataggtaatgcaggtgcaaaaaatgctgggatactagctgcgagaattttaagtattagtaatgaatcggttcgtaaacatttagatgaatatgagcaaagtctagtagataaagttggtgaaatgcaaaatgaacttcaataa

SEQ ID NO: 52362 - protein, 160 aa, Staphylococcus haemolyticus JCSC1435
MKVAVIMGSSSDWKVMQESCAMLDEFEIPYEKKVVSAHRTPKLMYEFASQARTNGYDVIIAGAGGAAHLPGMVASMTTIPVIGVPIESKSLKGLDSLLSIVQMPGGIPVATTAIGNAGAKNAGILAARILSISNESVRKHLDEYEQSLVDKVGEMQNELQ

SEQ ID NO: 52363 - DNA, 474 bp, Sulfolobus acidocaldarius DSM 639
  CDS (1)..(474): transl_table=11
atgcccaaagtagcggtaattatgggaagtaagaacgattgggaatatatgaaggatgcagtggatattttgaaagagtttggagtggaagttgaggtaagggttgtttcggctcatagaaccccagagtttatgatggagtttgcgaaaactgcgtcccaaaaagggattgaagtaataattgctggagctggaggagcagcccatttaccaggaatgactgcttccttaactcacctacctgttataggtgttcctgtgccttctaagaacctaaatggacttgactcactgttatctatagttcagatgccttatggggttccagtagctacagttgctataggaaatagtaaaaacgcagcattgctagcactaagaatattaggaattaagtactcagagattgccgagagaattaagaagtttatggaggatatgaaaagtgaagtccttaacacgaaactaccttaa

SEQ ID NO: 52364 - protein, 157 aa, Sulfolobus acidocaldarius DSM 639
MPKVAVIMGSKNDWEYMKDAVDILKEFGVEVEVRVVSAHRTPEFMMEFAKTASQKGIEVIIAGAGGAAHLPGMTASLTHLPVIGVPVPSKNLNGLDSLLSIVQMPYGVPVATVAIGNSKNAALLALRILGIKYSEIAERIKKFMEDMKSEVLNTKLP

SEQ ID NO: 52365 - DNA, 492 bp, Pseudomonas fluorescens Pf-5
  CDS (1)..(492): transl_table=11
atgagtgcactggttggcgtgatcatgggctccaagtccgattggtccacccttagccacaccgccgatatgctggaaaagctcggcatcccttacgaggtgaaggtggtttccgcacaccgcaccccggacctgctgttccagtacgccgatgaggctgaggcgcgaggcatcgaggtgatcatcgccggtgccggcggcgcggcgcacctgccgggcatgtgcgcggccaagacccacctgccggtgctgggcgtgccggtgcagtcgtcgatgctctcaggcgtggattcgctgctgtccatcgtgcagatgccggccggcatccccgtggccaccctggccatcggcaaggccggcgcgatcaacgcggcgctgctctcggcgagcatcctgggcgccaagcacccgcagttccatgcggtgctgaaaaaattccgtgctgaacagacagacagcgtcctggacaatccagacccgcgcgtcgcctga

SEQ ID NO: 52366 - protein, 163 aa, Pseudomonas fluorescens Pf-5
MSALVGVIMGSKSDWSTLSHTADMLEKLGIPYEVKVVSAHRTPDLLFQYADEAEARGIEVIIAGAGGAAHLPGMCAAKTHLPVLGVPVQSSMLSGVDSLLSIVQMPAGIPVATLAIGKAGAINAALLSASILGAKHPQFHAVLKKFRAEQTDSVLDNPDPRVA

SEQ ID NO: 52367 - DNA, 561 bp, Psychrobacter arcticum 273-4
  CDS (1)..(561): transl_table=11
atgagcaccacatcagcgactgttaacgctattgatcagaacggacctattacctcgcctgctggtcaaccaaaagttggtattatcatgggctcacaatctgactgggcgaccatgagcgcggcggcacaattgcttgcagactttgatatcgcctttgaatgtgaagtagtatcagcgcaccgtacgcctgatagattgtttgattatgccaaaagtgcaaaaggtaacggcttacaagtgattatcgctggtgccggtggtgccgcccacctacctggtatgtgcgccagtcaaacgccgctacctgtttttggtgtccccgtaaaatcttctatgctgagtggttgggacagcttactttctatcgttcagatgcctaaaggcgtggcagttggaacgttagcgattggatccgctggtgcttataatgctgcactgcttgccatccaagtgttggcattacatgatgaatcgattgcgactaagcttggccatctgcgtcatacccaaactaataccattcttgccagtccaatacccggtattatcaatccttaa

SEQ ID NO: 52368 - protein, 186 aa, Psychrobacter arcticum 273-4
MSTTSATVNAIDQNGPITSPAGQPKVGIIMGSQSDWATMSAAAQLLADFDIAFECEVVSAHRTPDRLFDYAKSAKGNGLQVIIAGAGGAAHLPGMCASQTPLPVFGVPVKSSMLSGWDSLLSIVQMPKGVAVGTLAIGSAGAYNAALLAIQVLALHDESIATKLGHLRHTQTNTILASPIPGIINP

SEQ ID NO: 52369 - DNA, 492 bp, Candidatus Pelagibacter ubique HTCC1062
  CDS (1)..(492): transl_table=11
atggctaaaaataaattaaacaaagtatcaattgttatgggtagtcaatctgactacaaaaccatgacattttgtcaaaatattcttaaaaaattaaacataaaatttgaaacaaaaataatatcagctcatagaacccctaaaagaatgtatgaatttgctattaatgctgaaaaaaatggtattgcagtaattattgctggagctggtggatctgcacatttaccaggaatgatttcagcccttacttctctaccggtactaggtgttccaattgaaagtaaaaagctgaaaggtcttgatagtcttctatccattgcacaaatgccaaaaggaatacctgttggaacattagcaattggagaagatggtgcaattaatgctgccttattagctgcatctattattggtcttagtgatttaactgttaagagaaaattaaatcagtttcgtttaaatcaaagcaaatctgttaaaaaaaaacccaaatag

SEQ ID NO: 52370 - protein, 163 aa, Candidatus Pelagibacter ubique HTCC1062
MAKNKLNKVSIVMGSQSDYKTMTFCQNILKKLNIKFETKIISAHRTPKRMYEFAINAEKNGIAVIIAGAGGSAHLPGMISALTSLPVLGVPIESKKLKGLDSLLSIAQMPKGIPVGTLAIGEDGAINAALLAASIIGLSDLTVKRKLNQFRLNQSKSVKKKPK

SEQ ID NO: 52371 - DNA, 483 bp, Colwellia psychrerythraea 34H
  CDS (1)..(483): transl_table=11
atgacagtcggtatcatcatgggatcaaaatcagattggccaacaatgcagcatacagcagaaatgcttgattctttaggtgtacagtacgaaaccaaagtagtttctgcacaccgtactcctcacttacttgctgagtatgctgaaagtgcaaaagatagaggtattaaggtaattattgcaggcgctggtggtgcagctcatttaccaggtatggccgcagcttatacttctttacctgttttaggtgtgccagtgcaatctaaagcgcttaatggacaagattctttattatctattgtgcaaatgccaaaaggtattgcagtaggtacattggccatcggcaatgccggtgctgccaacgcaggtttacttgcagcacaaattattggcactcataacactgagatccaacaaaatatcgaagagtttcgtcgaaagcagacagaaaccatacttgctaacccaaacccggcagaataa

SEQ ID NO: 52372 - protein, 160 aa, Colwellia psychrerythraea 34H
MTVGIIMGSKSDWPTMQHTAEMLDSLGVQYETKVVSAHRTPHLLAEYAESAKDRGIKVIIAGAGGAAHLPGMAAAYTSLPVLGVPVQSKALNGQDSLLSIVQMPKGIAVGTLAIGNAGAANAGLLAAQIIGTHNTEIQQNIEEFRRKQTETILANPNPAE

SEQ ID NO: 52373 - DNA, 648 bp, Pseudomonas syringae pv. phaseolicola 1448A
  CDS (1)..(648): transl_table=11
gtgatcgcaggtgctttaaactcaccactttgcggtatactgcgcggcctttggccggctaaatcggtcactattcgtacaacaagccacgccggttcccctgcgtggcttgttgttttcagacgcgcctgcgggcgcccgatgagaggcacgacgatgagcgcactggttggcgtgatcatgggctccaagtccgattggtccacccttagccacactgccgacatgctggaaaagctcggcatcccttatgaagtcaaggtggtgtcagctcaccgcacgccggacctgctgttccagtacgccgacgaagcagagggccgtggcattgaagtgatcatcgccggtgctggcggtgctgctcacttgcctggcatgtgtgccgccaagacccacctgcctgtgctgggcgttccggtgcagtcgtcgatgctgtcgggggtcgactccctgctgtcgatcgtgcagatgcctgcgggtattccggtagcgaccctggccatcggcaaagcgggggcgatcaacgctgcgctgctttcggccagtatcctgggcgccaaacaccctcaattccacgcagcgctgaagaaattccgcgctgagcagacagacagcgtcctggacaatccagacccacgccacgcctga

SEQ ID NO: 52374 - protein, 215 aa, Pseudomonas syringae pv. phaseolicola 1448A
MIAGALNSPLCGILRGLWPAKSVTIRTTSHAGSPAWLVVFRRACGRPMRGTTMSALVGVIMGSKSDWSTLSHTADMLEKLGIPYEVKVVSAHRTPDLLFQYADEAEGRGIEVIIAGAGGAAHLPGMCAAKTHLPVLGVPVQSSMLSGVDSLLSIVQMPAGIPVATLAIGKAGAINAALLSASILGAKHPQFHAALKKFRAEQTDSVLDNPDPRHA

SEQ ID NO: 52375 - DNA, 612 bp, Streptococcus pyogenes MGAS6180
  CDS (1)..(612): transl_table=11
atgctaaagcacctagtcgccctgacgtgggttcgtcttcgaaatcaaagatttcggacttaccgcatatttttctacggaaattttcgacaagtcgaaacgcccctttgtatcttaattatgaaaactccaattatttctattatcatgggctccaaatctgactgggcaaccatgcaaaaaacggctgaagttctagacaactttggcattgcttacgagaagaaagtcgtctctgcccaccgtacgccagacctcatgttcaagcatgctgaggaagcacgtggtcgtggcatcaaaatcatcatcgcaggagcaggtggggcagctcacttgcctggtatggtggcagctaaaacaaccctgcctgttatcggtgtgcctgtcaaatcacgtgccctttcaggtttggattcactctattcgattgtgcagatgcctggcggtgtgcctgtggcaaccatggctatcggagaagcgggagcgactaacgctgccctgacagccctccgtattctctccatcgaggatcaaaatctggctgatgcgctagctcatttccatgaggaacaaggaaaaatcgcagaggagtcaagtggtgaactcatttaa

SEQ ID NO: 52376 - protein, 203 aa, Streptococcus pyogenes MGAS6180
MLKHLVALTWVRLRNQRFRTYRIFFYGNFRQVETPLCILIMKTPIISIIMGSKSDWATMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSGELI

SEQ ID NO: 52377 - DNA, 612 bp, Streptococcus pyogenes MGAS5005
  CDS (1)..(612): transl_table=11
atgctaaagcacctagtcgccctgacgtgggttcgtcttcgaaatcaaagatttcggacttacctcatatttttctacggaaagtttcgacaagtcgaaacgcccctttgtatcttaattatgaaaactccaattatttctattatcatgggctccaaatctgactgggcaaccatgcaaaaaacggctgaagttctagacaactttggcattgcttacgagaagaaagtcgtctctgcccaccgtacgccagacctcatgttcaagcatgctgaggaagcacgtggtcgtggcatcaaaatcatcatcgcaggagcaggtggggcagctcacttgcctggtatggtggcagctaaaacaacgctgcctgttatcggtgtgcctgtcaaatcacgtgccctttcaggtttggatttgctatattccattgtgcagatgcctggcggtgtgcctgtggcaaccatggctatcggagaagcgggagcgactaacgctgccctgacagccctccgtatcctctctatcgaggaccaaaatctggctgatgcgctagctcatttccatgaggaacaaggaaaaatcgcagaggagtcaagtggtgaactcatttaa

SEQ ID NO: 52378 - protein, 203 aa, Streptococcus pyogenes MGAS5005
MLKHLVALTWVRLRNQRFRTYLIFFYGKFRQVETPLCILIMKTPIISIIMGSKSDWATMQKTAEVLDNFGIAYEKKVVSAHRTPDLMFKHAEEARGRGIKIIIAGAGGAAHLPGMVAAKTTLPVIGVPVKSRALSGLDLLYSIVQMPGGVPVATMAIGEAGATNAALTALRILSIEDQNLADALAHFHEEQGKIAEESSGELI

SEQ ID NO: 52379 - DNA, 501 bp, Dechloromonas aromatica RCB
  CDS (1)..(501): transl_table=11
atgaacgccgtgcaacaacccgtcgtcggtatcgtcatgggttccgattccgactggccgaccatgcaggccgccgccgtcatcctcaaggatttcggcgtgcccttcgaggcccgtgtcgtttccgctcaccgcaccccggatctgctattcgattacgccgccatggctggcgagcgtggcctcaaggcaatcattgccggggccggcggtgccgcccacctgccgggcatgctggccgccaagaccatcgtgccggtgctcggcgtgccggtgcaatcgaaagccctgtccggtgtcgattcgctgcattccatcgtccagatgccgaagggtattcccgtcgccaccttcgccatcggtgaagccggtgccgccaatgcagcactgtttgccgttgccatgctggccaacgagaacccggcgttgaatgccaagctgcaggccttccgccaggctcagaccgaaaaggtcctggccatgaaactccccggggtttaa

SEQ ID NO: 52380 - protein, 166 aa, Dechloromonas aromatica RCB
MNAVQQPVVGIVMGSDSDWPTMQAAAVILKDFGVPFEARVVSAHRTPDLLFDYAAMAGERGLKAIIAGAGGAAHLPGMLAAKTIVPVLGVPVQSKALSGVDSLHSIVQMPKGIPVATFAIGEAGAANAALFAVAMLANENPALNAKLQAFRQAQTEKVLAMKLPGV

SEQ ID NO: 52381 - DNA, 534 bp, Thermobifida fusca YX
  CDS (1)..(534): transl_table=11
gtgagccagagcccgcccgccgtcggcatcgtgatgggaagcgactccgactggccgttcatggaagaggcagccgaggcactggacgagttcagtgtcccctacgaggttgacgtggtctcggcgcaccggatgccgcacgagatgatcgcctacggctcccaggcagcggagcggggcctgaaagtcctcattgccggggccggcggggcagcccacctgccgggcatgctcgcctcggtcactccgctgccggtcatcggggtgccggtcccgctgaagtacctcgacgggctcgactcgctgctgtccatcgtgcagatgcccgcgggagtcccggtggccacggtggcggtgggcgcggcccgcaatgcgggcctgctggcagtgcggatcctcggcgcccacgacgaggagctgcgcgcgaagatggccgacttccaggacgacctcaaccagcaggccaaagccaagggggagcggctgcgccgcaaactcacggaaggctcctcgttcggcttcggcgcccgctga

SEQ ID NO: 52382 - protein, 177 aa, Thermobifida fusca YX
MSQSPPAVGIVMGSDSDWPFMEEAAEALDEFSVPYEVDVVSAHRMPHEMIAYGSQAAERGLKVLIAGAGGAAHLPGMLASVTPLPVIGVPVPLKYLDGLDSLLSIVQMPAGVPVATVAVGAARNAGLLAVRILGAHDEELRAKMADFQDDLNQQAKAKGERLRRKLTEGSSFGFGAR

SEQ ID NO: 52383 - DNA, 537 bp, Prochlorococcus marinus str. NATL2A
  CDS (1)..(537): transl_table=11
ttgtctttaactgaagctaatacatttaagcaagtagctgtagtaatgggtagtgattcagatcttaaaactcttaagcctgcggtggcaattctagatcaatttggaatatctaatgaagtaaggattctgtctgctcataggactccaaaagaaatgatggattttgctcaaatggcagaatcaaatggttttggagtgataattgctggggctggcggggctgctcatctaccaggaatgatcgcatctcttacaacccttcctgtcataggcgttcccgtcaagagcaaggcactttcagggatagattctatgtattcaatcttgcaaatgccctcaggcatccccgtagcaacagttgccatagaagggggcctaaatgctggccttttggcaactcaaattttagccatcaacaatactgaattaaaaaataaattaaacgcctacagatgtgagctgcacgaccttgtggttaaaaaagatcacacacttaaagagattggagccataacttatctagaaaaaatgtaa

SEQ ID NO: 52384 - protein, 178 aa, Prochlorococcus marinus str. NATL2A
MSLTEANTFKQVAVVMGSDSDLKTLKPAVAILDQFGISNEVRILSAHRTPKEMMDFAQMAESNGFGVIIAGAGGAAHLPGMIASLTTLPVIGVPVKSKALSGIDSMYSILQMPSGIPVATVAIEGGLNAGLLATQILAINNTELKNKLNAYRCELHDLVVKKDHTLKEIGAITYLEKM

SEQ ID NO: 52385 - DNA, 498 bp, Ralstonia eutropha JMP134
  CDS (1)..(498): transl_table=11
gtgagcaagcaagaaaagccggtcgtcggcgtcgtaatgggcagcagttccgactgggacgtgatgcagcacgccgtggccatgctgaaggatttcggcgtgccgttcgaggcacaggtcgtttcggcgcaccgcatggccgacgacatgttccgctatgcggagaccgcgcgcagccgtggcatccgcgcgatcatcgccggtgccggcggtgccgcgcatctgccgggcatgatcgccgccaagaccatcgtgccggtgttcggcgtgccggtgccgtccaagtacctgcgcggcgaggactcgctgctgtcgatcgtgcagatgcccaagggcgtgcccgtcgcgacgttcgcgatcggcgaagccggcgcggccaatgcggcgctgcatgcgatcgccacgctggccaccaccgacgacgcgctggccagcgcgctggaagcattccgcgccaggcagaccgaagccgcgcgcgcgatgacgctgccgctgtaa

SEQ ID NO: 52386 - protein, 165 aa, Ralstonia eutropha JMP134
MSKQEKPVVGVVMGSSSDWDVMQHAVAMLKDFGVPFEAQVVSAHRMADDMFRYAETARSRGIRAIIAGAGGAAHLPGMIAAKTIVPVFGVPVPSKYLRGEDSLLSIVQMPKGVPVATFAIGEAGAANAALHAIATLATTDDALASALEAFRARQTEAARAMTLPL

SEQ ID NO: 52387 - DNA, 483 bp, Staphylococcus saprophyticus subsp. saprophyticus ATCC 15305
  CDS (1)..(483): transl_table=11
ttgaaagtagtagtcattatgggaagttcttctgattgggaaacaatgaaagaaagttgttcgatgttagaccaatttgaaattccgtatgataaaaaagtagtttcagcacatcgtacgcctcaattaatgtttgaattttcaagagaagcgagagatgcaggatatgatgtcattatcgctggtgcaggcggtgctgcgcatttaccaggtatggttgcgtcaatgacgactttaccagtaattggcgttcctattgagtctaaaagtttaaaaggaatggattcgctattgtcaattgtacaaatgccaggtggtattccagtagcaacgacagcaataggtaaagctggcgctaaaaatgcgggtatcttggctgcaagaatacttagtattggtaatcaaacagtgcaaaagaatttggaaaattatgaaaaatctttagttgagaaagtgagtgatatgcaagatgaacttgagtaa

SEQ ID NO: 52388 - protein, 160 aa, Staphylococcus saprophyticus subsp. saprophyticus ATCC 15305
MKVVVIMGSSSDWETMKESCSMLDQFEIPYDKKVVSAHRTPQLMFEFSREARDAGYDVIIAGAGGAAHLPGMVASMTTLPVIGVPIESKSLKGMDSLLSIVQMPGGIPVATTAIGKAGAKNAGILAARILSIGNQTVQKNLENYEKSLVEKVSDMQDELE

SEQ ID NO: 52389 - DNA, 504 bp, Ehrlichia canis str. Jake
  CDS (1)..(504): transl_table=11
atgtcaattaatcaaaacacagtagacgtcgcagtaatcatgggaagtcaatcagattttccaacaatgaataattcgatctcaatactaaaagaactcaatataacacacaaagtaatgattatatctgcacatagaacaccagacaggctttacacatttgcaaaatctgcagaagacaatgggtttaaagtaattatagcaggagcaggaggagcagcgcatttaccaggattagtagcatctttaacacatataccagttataggggtaccaataaaaagtagtaatttaaacggaatagatagcttgctatcaatagtacaaatgcccaaaggaatacctgttgcaacaatgtccataggatcatcaggagcatacaacgcagctatcatagcagcatctattttatctttagaaaatgatattatcaaagacaatctaaaaacatggagaaaaaatctatctgattcagtaaaactgataccagacacatcactataa

SEQ ID NO: 52390 - protein, 167 aa, Ehrlichia canis str. Jake
MSINQNTVDVAVIMGSQSDFPTMNNSISILKELNITHKVMIISAHRTPDRLYTFAKSAEDNGFKVIIAGAGGAAHLPGLVASLTHIPVIGVPIKSSNLNGIDSLLSIVQMPKGIPVATMSIGSSGAYNAAIIAASILSLENDIIKDNLKTWRKNLSDSVKLIPDTSL

SEQ ID NO: 52391 - DNA, 402 bp, Methanosarcina barkeri str. fusaro
  CDS (1)..(402): transl_table=11
atggttgatatctcagtaattatgggttccgaatccgataggcctatcgccaaccgtgcgatatccgtacttgaaaagagcaaatacacttacgaagtaatggttatctctgctcacaggaaccctgaagaacttgaaagctacatatcaagtaccgacgcaaaagtctttattacaattgcaggtttatctgcagcccttcctggggttgtagcttccagaacaaaaagacctgtagtaggagtccctgtaagcgcgaagcttggtggactcgatgccctgctctctattgcccagatgcccccaggagtgcctgtcggaagcgtagggatcgataatggagcaaatggtgcacatcttgctctgagaattatggatttgattgacaccacgaagccttaa

SEQ ID NO: 52392 - protein, 133 aa, Methanosarcina barkeri str. fusaro
MVDISVIMGSESDRPIANRAISVLEKSKYTYEVMVISAHRNPEELESYISSTDAKVFITIAGLSAALPGVVASRTKRPVVGVPVSAKLGGLDALLSIAQMPPGVPVGSVGIDNGANGAHLALRIMDLIDTTKP

SEQ ID NO: 52393 - DNA, 465 bp, Dehalococcoides sp. CBDB1
  CDS (1)..(465): transl_table=11
atgccattagttagtattgttatggggtccaagtctgacgccgagtttatgaagcccactgaagaaatactggagaaaatggctatttcttttgaaactctggttatgtctgcccatcgtactccggaaaaagtgcaggagttttgtttgaatgcacctgaccgggggattgaactgattatagctgctgccgggggcgcagcgcatctgccgggggtaattgccagctgggtaacactgccggttattggtgtccctattgcttccagtgaactcaaaggagttgacgccctgtactctatagtccagatgccggccggtataccggtagctacagtagctattggtgctgcgggtgctaaaaatgcggcttatctggcggccgaaattctgggtttaaaatatcaaaatatccgtcaggcttacgtaagctaccgtcaggaactaaaaggtgaaaacaaatga

SEQ ID NO: 52394 - protein, 154 aa, Dehalococcoides sp. CBDB1
MPLVSIVMGSKSDAEFMKPTEEILEKMAISFETLVMSAHRTPEKVQEFCLNAPDRGIELIIAAAGGAAHLPGVIASWVTLPVIGVPIASSELKGVDALYSIVQMPAGIPVATVAIGAAGAKNAAYLAAEILGLKYQNIRQAYVSYRQELKGENK

SEQ ID NO: 52395 - DNA, 498 bp, Thiobacillus denitrificans ATCC 25259
  CDS (1)..(498): transl_table=11
atgatgagcgcgcctgaggtaggggtggtgatgggatcttccagcgactgggaggtgatgaagcatgcggcgattctgctcaagcagctcggcatccacttcgaaaccaaggtggtgtcggcgcaccgtacccccgacctgctctacgaatacgcggcgagcgccgaggcgcgcggcatcaaggcgatcatcgcgggcgcgggcggcgcggcgcacctgccgggcatgatcgcggcgaagacgatcgttccggtgctcggcgtgccggtgccgtcgaaatatctcaagggcgtcgattcgctgctctcgatcgtgcagatgccgcgcggcatcccggtcgcgaccttcgcgatcggcgaggccggcgccgccaacgccgcgctcttcgcggcggcgctgatcgcgcgcgccgaccccggcctcgcggcgcagctcaacgaattccgccgcggccagtccgattcggtgctcgcgatggagctgcccgatgtcgaatga

SEQ ID NO: 52396 - protein, 165 aa, Thiobacillus denitrificans ATCC 25259
MMSAPEVGVVMGSSSDWEVMKHAAILLKQLGIHFETKVVSAHRTPDLLYEYAASAEARGIKAIIAGAGGAAHLPGMIAAKTIVPVLGVPVPSKYLKGVDSLLSIVQMPRGIPVATFAIGEAGAANAALFAAALIARADPGLAAQLNEFRRGQSDSVLAMELPDVE

SEQ ID NO: 52397 - DNA, 498 bp, Haemophilus somnus 129PT
  CDS (1)..(498)
atgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgccggtggtgccgcacatttacctggtatgattgcagcaaaaactatcttgcctgtattaggtgtaccagtaaaaagctcaatgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataa

SEQ ID NO: 52398 - protein, 165 aa, Haemophilus somnus 129PT
MQDNKPQIAIVMGSKSDWSTMQETAIILDSLDLPYHVEVVSAHRTPDKLFEFAENAEAKGYKVIIAGAGGAAHLPGMIAAKTILPVLGVPVKSSMLNGVDSLYSIVQMPKGIPVGTLAIGSAGAANAALLASQILAAFDPHLAQKLHQFRQAQTDSVLNNSDPRE

SEQ ID NO: 52399 - DNA, 498 bp, Haemophilus somnus 2336
  CDS (1)..(498)
atgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgctggtggtgccgcacatttacccggtatgattgcagcaaaaactatcgtgcctgtattaggtgtgccagtaaaaagctcaacgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataa

SEQ ID NO: 52400 - protein, 165 aa, Haemophilus somnus 2336
MQDNKPQIAIVMGSKSDWSTMQETAIILDSLDLPYHVEVVSAHRTPDKLFEFAENAEAKGYKVIIAGAGGAAHLPGMIAAKTIVPVLGVPVKSSTLNGVDSLYSIVQMPKGIPVGTLAIGSAGAANAALLASQILAAFDPHLAQKLHQFRQAQTDSVLNNSDPRE

SEQ ID NO: 52401 - DNA, 495 bp, Haemophilus influenzae R2846
  CDS (1)..(495)
atgtcaaacactgcacaaattgccgttgtaatgggttccaaaagcgattgggctaccatgcaagaggcaactcagattttagatgaattaaaagtaccttatcatgtggaagtcgtctctgctcatcgtacgcctgataaactttttgaatttgctgaaaatgcacaaaaaaatggatacaaagtaattattgctggggcaggcggtgcggcacatttaccaggtatgatcgcagcgaaaacccttgtgccagtgctgggcgtgccagtaaaaagttctatgttaagtggcgtagatagcctttattcaattgtgcaaatgccaaaagggattccagtcggaacattagcaattggccctgcgggtgccgcaaatgctggattgttagccgcacaaattctagcaagttgggatgcagaattattttcacgcttgcaatctttccgtgaaagccaaactcgtactgtactggacaatcccgatccacgcacataa

SEQ ID NO: 52402 - protein, 164 aa, Haemophilus influenzae R2846
MSNTAQIAVVMGSKSDWATMQEATQILDELKVPYHVEVVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELFSRLQSFRESQTRTVLDNPDPRT

SEQ ID NO: 52403 - DNA, 495 bp, Haemophilus influenzae R2866
  CDS (1)..(495)
atgtcaaacactgcacaaattgccgttgtgatgggttccaaaagcgattgggctactatgcaagaggcaactcagattttagatgaattaaaagtaccttatcatgtggaagtcgtctctgctcatcgtacgcctgataaactttttgaatttgctgaaaatgcacaaaaaaatggctacaaagtgattattgctggggctggcggtgcggcacatttacctggtatgatcgcagccaaaacccttgtgccagtgctgggcgtgccagtaaaaagttctatgttaagtggcgtagatagcctttattcaattgtgcaaatgccaaaagggattccagtcggaacattagcaattggccctgcgggtgccgcaaatgctggattgttagccgcacaaattctagcaagttgggatgcagaattgctttcacgcttgcaatctttccgtgaaagccaaactcgtgctgtactggacaatcccgatccacgcacataa

SEQ ID NO: 52404 - protein, 164 aa, Haemophilus influenzae R2866
MSNTAQIAVVMGSKSDWATMQEATQILDELKVPYHVEVVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELLSRLQSFRESQTRAVLDNPDPRT

SEQ ID NO: 52405 - DNA, 486 bp, Lactococcus lactis subsp. cremoris SK11
  CDS (1)..(486)
atgacagaagttgcaattatcatgggttcaagttcagactgggccacaatgaaagaaacagcgaagattttagatgattttgggttagcttatgagaaaaaagttgtctcagctcatcggacaccggctttaatggctgaattttccaatcaggcccatgaacaaggctataaggttatcattgctggcgctggtggagctgcacacttaccaggaatggttgctgctcagacgcttgttccagtgattggtgtgccaatcaaatcacgggctttatccggtcttgactctctttattcaattgttcaaatgccagcaggcgttcctgtagcgacaatggcaattggagaggctggggcaaaaaatgcggcattatttgccttgcaacttttggcaaataatgatgatgatttatacaataaattagtgaactatcgggcagccgctcaagaaatggttgagcaatcaaacaatgaattgaaatga

SEQ ID NO: 52406 - protein, 161 aa, Lactococcus lactis subsp. cremoris SK11
MTEVAIIMGSSSDWATMKETAKILDDFGLAYEKKVVSAHRTPALMAEFSNQAHEQGYKVIIAGAGGAAHLPGMVAAQTLVPVIGVPIKSRALSGLDSLYSIVQMPAGVPVATMAIGEAGAKNAALFALQLLANNDDDLYNKLVNYRAAAQEMVEQSNNELK

SEQ ID NO: 52407 - DNA, 462 bp, Bacillus anthracis str. A2012
  CDS (1)..(462)
atgggaagcacgtcagactgggaaacaatgaaatatgcttgtgacattttagatgaattaaatataccgtatgagaaaaaggttgtatccgctcatcggactccggattatatgtttgaatatgcagagacggctcgtgaacgtggattgaaagttattattgctggagctggtggagcagcgcatttaccaggaatggttgcagcgaagacgaatcttcctgtaatcggagttccagttcaatcaaaagcgttaaacggcttagattcattattatccatcgtccaaatgccaggaggggttccagttgcaactgttgcaattggtaaggctggttcaacaaatgctggtttacttgctgcacaaatacttggatcattccatgatgacatacatgatgcattagaattgagaagagaagcaattgaaaaagatgtgcgcgaaggtagtgagctagtatga

SEQ ID NO: 52408 - protein, 153 aa, Bacillus anthracis str. A2012
MGSTSDWETMKYACDILDELNIPYEKKVVSAHRTPDYMFEYAETARERGLKVIIAGAGGAAHLPGMVAAKTNLPVIGVPVQSKALNGLDSLLSIVQMPGGVPVATVAIGKAGSTNAGLLAAQILGSFHDDIHDALELRREAIEKDVREGSELV

SEQ ID NO: 52409 - DNA, 483 bp, Jannaschia sp. CCS1
  CDS (1)..(483): transl_table=11
atggttcaggtcgcgatcatcatgggctctcaatcggattggcccaccctgcgggaagcggccgacattctcgatacgctgggggtggcctatgacgcgaagatcgtttcggctcaccgcacaccggaccgcttgtgggacttcggcaaaggcgcggtggatgcgggcctgaaagtgatcatcgcaggtgcaggcggggcggcgcatttgcctggcatggtggcgtcgaaaacccgcgtgccggtgatcggcgtaccggtccagaccaaggcacttggcggcgtcgatagcctgtattccatcgtgcagatgcccaaaggctaccccgtggcaaccatggcgatcggtgcggcgggggcggcaaatgcgggcttgatggcggcagcgatcctggccaatgaagaccccgccctcgccgcacgactggaccagtggcgcgccgatctgagcgcctcaatcccggaggcccccagcgatgagtga

SEQ ID NO: 52410 - protein, 160 aa, Jannaschia sp. CCS1
MVQVAIIMGSQSDWPTLREAADILDTLGVAYDAKIVSAHRTPDRLWDFGKGAVDAGLKVIIAGAGGAAHLPGMVASKTRVPVIGVPVQTKALGGVDSLYSIVQMPKGYPVATMAIGAAGAANAGLMAAAILANEDPALAARLDQWRADLSASIPEAPSDE

SEQ ID NO: 52411 - DNA, 495 bp, Methylobacillus flagellatus KT
  CDS (1)..(495): transl_table=11
atgtccaaaccattggttggtatcatcatgggctcagacagcgactggcccgtcatgcgcgccgcggcgcagacgttggccgatttaggcattgtctacgaggcacgcgtggtctctgcgcaccgtacgcctgacctgatgtttgagtttgccgagcaagcggccgaacgcggcttgcgtgtcattattgctggcgctggcggcgccgcccacctgcctggcatggtggcggccaagacgacattgccggtactaggcgtgccggtgccatcacgccatctacaggggcaggattccctgctatccatcgtccagatgcctaaagggattccagtcgcgacgtttgcgatcggtgaggcaggggctgccaacgccggtttgtttgccgccgccatcctggcgacgacggatagcgcacttgcgcagcagctggcagattttcgtgccgcacaggcggcccgggtgctggacatgacattgccggaccagccctga

SEQ ID NO: 52412 - protein, 164 aa, Methylobacillus flagellatus KT
MSKPLVGIIMGSDSDWPVMRAAAQTLADLGIVYEARVVSAHRTPDLMFEFAEQAAERGLRVIIAGAGGAAHLPGMVAAKTTLPVLGVPVPSRHLQGQDSLLSIVQMPKGIPVATFAIGEAGAANAGLFAAAILATTDSALAQQLADFRAAQAARVLDMTLPDQP

SEQ ID NO: 52413 - DNA, 492 bp, Shewanella denitrificans OS-217
  CDS (1)..(492): transl_table=11
atgtcagcccaagttgcaatcgttatgggttctaagagtgattggccgaccatggaagccgctgccgatattttagatttactgcaagtgccctaccatgtggaagttgtctcggcgcaccgcactccggataagttaatggaatttgccagtgccgcagtaaagtccggctttaaaattatcataggcggcgctggcggcgcggctcatctaccaggcatgattgccgctaagactcgccttcctgtactcggggtacccgtgcaaagtaaagccctgtcaggcatggacagcttattatccatagtacaaatgcctaaaggcatagccgttggcacactggctattggcacagctggggcgtttaacgccggattactcgccgcacaaatgttggcaaaccatgatgcacagcttgcggcacgtcttgatgcctttagagagcaacaaacccgcaccgtattagagaatcccgatccgagagtcgattaa

SEQ ID NO: 52414 - protein, 163 aa, Shewanella denitrificans OS-217
MSAQVAIVMGSKSDWPTMEAAADILDLLQVPYHVEVVSAHRTPDKLMEFASAAVKSGFKIIIGGAGGAAHLPGMIAAKTRLPVLGVPVQSKALSGMDSLLSIVQMPKGIAVGTLAIGTAGAFNAGLLAAQMLANHDAQLAARLDAFREQQTRTVLENPDPRVD

SEQ ID NO: 52415 - DNA, 504 bp, Xylella fastidiosa Dixon
  CDS (1)..(504): transl_table=11
atgatctccaatcaatcccccccgctggtcggtattgtcatgggttcctcttcggattggggagcgatgcagcacgccgcacaaaagctcgatgctctcagcgtcgcgtatgaagtgaaggtcgtttcggcgcatcgtactccggataaattgtttgcttatgctgagcaggctgaaggacgtggtttgcgtgccatcattgccggggccggtggtgcagcgcaccttccaggtatgttggcggctaagacgatggttccagtgttgggggtgccaatgcagtccagggctctgaatggtttggattcgctgttatcgatcgtacagatgccggcgggtattccagtagccacgttcgcgattggggaagctggtgcagtcaatgccgccctgtttgccgcagcgctgttggtacccgaaaatccagcaatgcgtcggatgctgactgagttccgccaacgtcagacggatcaggtgaatgctgcggacgatccacgccaatga

SEQ ID NO: 52416 - protein, 167 aa, Xylella fastidiosa Dixon
MISNQSPPLVGIVMGSSSDWGAMQHAAQKLDALSVAYEVKVVSAHRTPDKLFAYAEQAEGRGLRAIIAGAGGAAHLPGMLAAKTMVPVLGVPMQSRALNGLDSLLSIVQMPAGIPVATFAIGEAGAVNAALFAAALLVPENPAMRRMLTEFRQRQTDQVNAADDPRQ

SEQ ID NO: 52417 - DNA, 504 bp, Xylella fastidiosa Ann-1
  CDS (1)..(504): transl_table=11
atgatctccaatcaatcccccccgctggtcggtattgtcatgggttcctcttcggattggggggcgatgcagcatgccgcacaaaagctcgatgctctcagcgtcgcgtatgaagtgaaggtcgtttcggcgcatcgtactccggataaattgtttgcttatgctgagcaggctgaaggacgtggtttgcgtgccatcattgccggggccggtggcgcagcgcaccttccaggtatgttggctgctaagacgatagttccagtgttgggggtgccaatgcagtccagggctctgaatggtttggattcgctgttatcgatcgtacagatgccggcgggtattccagtagccacgttcgcgattggggaagctggtgcagtcaatgccgccctgtttgccgccgcgctgttggtacccgaaaatccagtaatgcgtcggatgctgactgagttccgccaacgtcagacggatcaggtgaatgctgcggacgatccacgccaatga

SEQ ID NO: 52418 - protein, 167 aa, Xylella fastidiosa Ann-1
MISNQSPPLVGIVMGSSSDWGAMQHAAQKLDALSVAYEVKVVSAHRTPDKLFAYAEQAEGRGLRAIIAGAGGAAHLPGMLAAKTIVPVLGVPMQSRALNGLDSLLSIVQMPAGIPVATFAIGEAGAVNAALFAAALLVPENPVMRRMLTEFRQRQTDQVNAADDPRQ

SEQ ID NO: 52419 - DNA, 1938 bp, Arabidopsis thaliana
  CDS (1)..(1938)
atgttgcttttgaaacaaagctcagctgctgttcttgtcgttggaaatacaactccagtccttcacacttctcgctccacctacagagttggaccttttccagtgaccagaacgcagtcgttccagagtttgactatggcaaatttgcagaagcttcccacttcttcgtctgggaaattgaatacggcttcagctgtgccctgtagctctcacgatgcttctcctatcagtgagaatcgcgagaataaacatgtccatggagtttctgagaaaattgtgggagttcttgggggtggacaattgggtcgtatgctttgccaagctgcttctcagttggctatcaaagtgatgattttagatccttctaaaaattgttcagcaagtgcattgtcctacggtcacatggttgatagctttgacgacagtgctacagtagaagaatttgcaaaaagatgtggagtcttaactgtagaaattgaacatgttgacgtggacacactagagaagcttgagaaacaaggagtggattgccaacccaaagcttctactattaggataatacaggataaatacatgcaaaaggttcatttctctcagcatggcatcccacttccagaatttatggagataagcgatattgaaggagcaagaaaagcaggtgaacttttcggttaccctcttatgatcaagagcaaacgattggcttatgatggacgtggaaatgcagttgccaacaaccaagatgagctttcttctgctgtaacggctcttggaggtttcagtcgtggtttgtatattgagaaatgggcaccttttgttaaggagttagctgttattgtggctagggggagagatggttctatggtttgttatcccgttgttgaaaccattcacagggataacatatgccatatagttaaagcacctgcagatgtgccttggaagattaacaaacttgccaccgatgttgcccaaaaggctgtcggttctttagaaggtgctggtgtttttgcagttgaactgttcttgacagaggatagtcagattctgctaaacgaagttgcacctagaccacacaacagtggccatcaaacgatcgagtgctgttatacttcacagtttgaacaacacttgcgagctgtggttggtcttccacttggtgatccgtcaatgagaactccggcgtccattatgtacaatattctgggagaagatgatgtaattgatggagaagcaggtttcaaattggctcatcggcttattgcaagggctctgtgtattccaggtgcatctgttcattggtatgacaagccagaaatgagaaagcagagaaagatgggtcacatcactcttgttgggcagtctatgggcattttggaacaaaggttacaatgcatattaagtgagcaaagccaccaagtacacgagacacctcgtgttgctatcatcatgggttcagacacggatcttcctgttatgaaggatgctgccaaaattctggacctgtttggtgtgacacatgaggtaaagatagtttctgctcatcgcaccccagagatgatgtatacatatgcaacctcagctcatagtcgaggcgttcaagtcattattgcaggtgctggtggtgctgctcacttaccaggtatggttgcttcactcactcctttgcctgtgattggtgtccctgtccgtgctacccgtttggatggagttgattcacttctttccatcgttcagatgcctagaggtgttcctgttgcgacagttgcaataaacaatgcgaccaacgcagccttgcttgcagttcggatgttgggaatctctgatacggatcttgtctcaaggatgaggcagtaccaggaagacatgagagatgagaacctgaataaaggagagaaactggagacagaaggttgggaatcatatttgaaccagtga

SEQ ID NO: 52420 - protein, 645 aa, Arabidopsis thaliana
MLLLKQSSAAVLVVGNTTPVLHTSRSTYRVGPFPVTRTQSFQSLTMANLQKLPTSSSGKLNTASAVPCSSHDASPISENRENKHVHGVSEKIVGVLGGGQLGRMLCQAASQLAIKVMILDPSKNCSASALSYGHMVDSFDDSATVEEFAKRCGVLTVEIEHVDVDTLEKLEKQGVDCQPKASTIRIIQDKYMQKVHFSQHGIPLPEFMEISDIEGARKAGELFGYPLMIKSKRLAYDGRGNAVANNQDELSSAVTALGGFSRGLYIEKWAPFVKELAVIVARGRDGSMVCYPVVETIHRDNICHIVKAPADVPWKINKLATDVAQKAVGSLEGAGVFAVELFLTEDSQILLNEVAPRPHNSGHQTIECCYTSQFEQHLRAVVGLPLGDPSMRTPASIMYNILGEDDVIDGEAGFKLAHRLIARALCIPGASVHWYDKPEMRKQRKMGHITLVGQSMGILEQRLQCILSEQSHQVHETPRVAIIMGSDTDLPVMKDAAKILDLFGVTHEVKIVSAHRTPEMMYTYATSAHSRGVQVIIAGAGGAAHLPGMVASLTPLPVIGVPVRATRLDGVDSLLSIVQMPRGVPVATVAINNATNAALLAVRMLGISDTDLVSRMRQYQEDMRDENLNKGEKLETEGWESYLNQ

SEQ ID NO: 52421 - DNA, 483 bp, Pseudoalteromonas haloplanktis TAC125
  CDS (1)..(483): transl_table=11
atgaaagttggcattattatgggttctaaatcagattggccaaccatggaacatgcggcgctcatgctagaaaaatttggcattgagtacgaaacaaaagtagtttctgcccaccgaactcctcaactccttgctgattacgcaagctcagcaagtgaccgtggtattaaagttataattgcaggcgcaggcggcgcggcccatttgccgggtatggcagctgcatttacctcattaccagtacttggtgtgccagttaaatcaaaagcgcttaatggtattgattcgctactttctatttgccaaatgcctaaaggtgttgcagtaggaacattagctattggcgagcctggtgctgctaatgcaggtttacttgcagcgcaaatattagggtgtcaaaaccctgaaatattcgcaaaaattgaagcgtttcgtaaagaacaaaccgacactattttagctaaccctaatcctgcagagtaa

SEQ ID NO: 52422 - protein, 160 aa, Pseudoalteromonas haloplanktis TAC125
MKVGIIMGSKSDWPTMEHAALMLEKFGIEYETKVVSAHRTPQLLADYASSASDRGIKVIIAGAGGAAHLPGMAAAFTSLPVLGVPVKSKALNGIDSLLSICQMPKGVAVGTLAIGEPGAANAGLLAAQILGCQNPEIFAKIEAFRKEQTDTILANPNPAE

SEQ ID NO: 52423 - DNA, 621 bp, Natronomonas pharaonis
  CDS (1)..(621): transl_table=11
atgacacgttccgaggaagtggcggcgcttatcgacctgttcgaagccgaagccgagcgggaccgctccgatgcggagacgcccgatatcggcatcgtcatggggtcggattcggacctcgatacgatgtatggggcctacgaggcgctgacggaactcggcttcgaggaggtgaccgactacgacgacccgccggagagccggtttaccttcgagacgttcgtcgtctcggcccaccggacgccggagctgatgtacgcctacggcgagacggcccgcgaccgcggcctcgatgtcatcatcgccggcgcgggcggtaagtcggctgacctcccgaacatgaccgcctcgatagcgtacccgcttccggtcgtcggcgttccggtccacgaaaagtcagtcagttcggtcattggaatgccgaccggcgcgccgatagtcgctgtcgacgccggcaagtcgttcaacgctgcgctgtcggccgtccagatgcttgcccgcggccacccggaactcgaagccagactcgaagcgtatcacgatgacctgcaggacaacgtcggtgcggtctcgaagcggctccacgaacaaggcaccgaccggttccgcgagtcccggtga

SEQ ID NO: 52424 - protein, 206 aa, Natronomonas pharaonis
MTRSEEVAALIDLFEAEAERDRSDAETPDIGIVMGSDSDLDTMYGAYEALTELGFEEVTDYDDPPESRFTFETFVVSAHRTPELMYAYGETARDRGLDVIIAGAGGKSADLPNMTASIAYPLPVVGVPVHEKSVSSVIGMPTGAPIVAVDAGKSFNAALSAVQMLARGHPELEARLEAYHDDLQDNVGAVSKRLHEQGTDRFRESR

SEQ ID NO: 52425 - DNA, 486 bp, Rhodobacter sphaeroides 2
  CDS (1)..(486): transl_table=11
atgactgtggacgttgggatcatcatgggcagccagtcggactgggccacgatgaaggaggccgcggcgatcctcgacgagctcggcatctctcacgaggcgaggatcgtctcggcgcaccgcacgcccgaccggctctggaactacggcaagaccgccgtcgggcgcgggctcaaggtcatcatcgcgggcgcgggcggtgcggcgcaccttcccggcatgatggcctcgaaaacgcgggtgcccgtcatcggcgtgcccgtccagacccgcgcgctctcgggcgtcgacagcctctattccatcgtccagatgcccaagggttttccggtcgccaccatggcgatcggcagcgccggcgcggcgaacgcgggcctgatggccgcgggcatcctcgccctctccgatccggcgctcggccagcggctcgacgcctggcgcgcagccctctccgcctccatccccgaggagccctccgatgactga

SEQ ID NO: 52426 - protein, 161 aa, Rhodobacter sphaeroides 2
MTVDVGIIMGSQSDWATMKEAAAILDELGISHEARIVSAHRTPDRLWNYGKTAVGRGLKVIIAGAGGAAHLPGMMASKTRVPVIGVPVQTRALSGVDSLYSIVQMPKGFPVATMAIGSAGAANAGLMAAGILALSDPALGQRLDAWRAALSASIPEEPSDD

SEQ ID NO: 52427 - DNA, 501 bp, Nitrosococcus oceani ATCC 19707
  CDS (1)..(501): transl_table=11
atgaacaacccctttgttgccgtgctgatgggatcggaatcggatttacctattatgcagactaccttggacgtattaaaaacattagaagtgccttttgaggtgcggatcagttctgcccaccgaactccagaggctaccgcccattatgtcaaagaagcggatgcccgtggctgtggggtgtttattgctgcggctgggttagcagctcatcttgccggcgctgttgccgccaataccctaaagccggtaattggggtgcccatggagggggggccattaaaggggatggacgctttattgtctacggtacagatgcccggaggcgttcccgtggcttgtgtggctattggtaaagcgggggcaaaaaacgccgcttatttggcagcccaaattttaggaatcacagataccgctctagctcagcgtcttctttcggatcgccaagccatggctgatgctatcctcgccaaagctaatgttttggagcaccattcctga

SEQ ID NO: 52428 - protein, 166 aa, Nitrosococcus oceani ATCC 19707
MNNPFVAVLMGSESDLPIMQTTLDVLKTLEVPFEVRISSAHRTPEATAHYVKEADARGCGVFIAAAGLAAHLAGAVAANTLKPVIGVPMEGGPLKGMDALLSTVQMPGGVPVACVAIGKAGAKNAAYLAAQILGITDTALAQRLLSDRQAMADAILAKANVLEHHS

SEQ ID NO: 52429 - DNA, 489 bp, Streptococcus agalactiae A909
  CDS (1)..(489): transl_table=11
atgcaaccaattatttctattatcatgggatccaaatctgactggacaaccatgcaaaaaacggctgaagttctagataactttggcattgcttacgagaagaaagtcgtctctgcccaccgcacaccagacctcatgttcaagcatgctgaggaagcacgtgaccgtggcatcaaaatcatcatcgctggtgcaggtggagcagctcacttgcctggtatggtggcagctaaaacaacgctacctgttatcggtgtgcctgtcaaatcacgtgctctttcaggtttggattcgctctattccattgtgcagatgcctggcggtgtgcctgtggcaaccatggctatcggagaagcgggagcgactaacgctgccctgacagccctccgtatcctctctatcgaagaccaaaatttggctgatgcgctagctcatttccatgaggaacaaggaaaaatcgcagaggagtcaagcaatgaactcatttaa

SEQ ID NO: 52430 - protein, 162 aa, Streptococcus agalactiae A909
MQPIISIIMGSKSDWTTMQKTAEVLDNFGIAYEKKVVSAHRTPDLMFKHAEEARDRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSNELI

SEQ ID NO: 52431 - DNA, 489 bp, Nitrobacter winogradskyi Nb
  CDS (1)..(489): transl_table=11
atgaccgccgttgtcgccatcatcatgggaagccagtcggactgggagaccatgcgtcacgccgctgaaacgctggccgcgctcggcgtcacgagcgagaaccggatcgtctccgcgcaccgtacccctgaaagactgtttgcgttcgccaggggcgccaaggccgaagggttcaaggtcatcatcgcgggcgcgggcggcgcggcgcacctgcccggcatgacggcggcgctgacggaacttccggtgctgggtgtgcccgtggagtccagggcgcttgccggagtcgattcgctctattccatcgtgcagatgccggccggcgttccggtggggacgctcgcgatcggcaaggcgggcgccatcaatgcggcgctgctggcggcaagcgtgctggcgctcaatgacccgccgctcgccggccgcctcgaagcatggcgcaagcggcagacggatgcggtggccgagcatccggaggaatcggcgtga

SEQ ID NO: 52432 - protein, 162 aa, Nitrobacter winogradskyi Nb
MTAVVAIIMGSQSDWETMRHAAETLAALGVTSENRIVSAHRTPERLFAFARGAKAEGFKVIIAGAGGAAHLPGMTAALTELPVLGVPVESRALAGVDSLYSIVQMPAGVPVGTLAIGKAGAINAALLAASVLALNDPPLAGRLEAWRKRQTDAVAEHPEESA

SEQ ID NO: 52433 - DNA, 1896 bp, Oryza sativa
  CDS (1)..(1896)
atgcactccaggctcctcagcgccccctcccacgcctccgccgcctcctcctcccccctccccttcgccgccgcccacccttgccgcgcctcctggacgccgcggcccacctccccgctgccgcctctatcgctgctgcgcgccaccgcctccatgcatccttctcctcctcccgaggggcatagcgaccagcctgtgcatggcgtcaccaacacggtcgtcggcgtgctggggggaggccagctggggaagatgctgtgccaggcggccagccagatgggggtcaggatggccatacttgatcccctcgaggactgcccggcgagctcggtttgccacgagcatgtcgtcgggagcttcaatgatggcgccacggttagcgagttcgcaaagaggtgcggggttttgacggtggaaattgagcatgtcgacgctgtaacactcgagaagcttgagaaacagggcatcgattgtgagcccaaagcctccaccatcatgattattcaagacaagtacaggcagaaaactcatttctcaaaatttggaattccgttacctgactttgtggaagtagatactttaagtagcatagagaaagctggggaaatgtttggttatcctctaatggtcaaaagcaagagattagcatatgatggccgtggaaatgctgttgctcacgacaaaaaagagctatcttctgttgttgcttctcttggtgggtttgagcatggcttgtatgttgagaggtggacatcttttgtaaaggagctttctgtcattgtggcaaggagcagagacggttctacggtgtgctatcctgttgttgaaaccatccacaaggataacatctgccatgttgttgaggctcctgccgaggtgcctgataaaataaagaagttggctactaatgtagctgaaaaggctatcaaatcattggaaggtgctggtgttttcgctgtagaattatttttaacacaagataatcaggttttattgaatgaagtagctccaaggcctcacaacagtgggcatcacacaattgagtcatgttatacctcgcaatatgagcaacatttacgtgctattcttggccttcctcttggtgatccttcaatgaaagcgcctgcatcaataatgtacaacatcctgggtgaggatgagggtgaggcaggatttactcaagctcatcagttgattgagagagctttggacatttcaggtgcatctgtccattggtatgcaaaaccagaaatacggaagcagagaaagatgggccatattacaattgtggggccttcaaagtacagtgtaaaagcacgcttagataagttgctgcaaagagacgcatatgaccccaagaaagttgcagttaaacctcgtgctgcaataataatgggttctgattctgatcttcctgtcatgaaagatgctgcagtagtattgaagaaattcaacataccttttgagcttacaattgtttcggctcatcgtacaccagagaggatgtaccattatgcattatctactaaagaaagaggcttagaggtcataattgcaggtgcaggtggagcggctcacttaccagggatggtggcttcattgacttctgtcccagtaataggagtacccatcatgacttcatctttacatggaactgattccctcctatctattgtccagatgccgaaaggtattcctgttgctactgttgcaattggaaatgcggaaaatgcaggtttattggcagttaggatgctggcctcaagagatcctgagttgggggacaaggcaactgaataccagcatgatctgagggatatggtgttggagaaagcaaaaaggctcgaggaactaggttgggaggaatataccgagctatacttgaagaagcattga

SEQ ID NO: 52434 - protein, 631 aa, Oryza sativa
MHSRLLSAPSHASAASSSPLPFAAAHPCRASWTPRPTSPLPPLSLLRATASMHPSPPPEGHSDQPVHGVTNTVVGVLGGGQLGKMLCQAASQMGVRMAILDPLEDCPASSVCHEHVVGSFNDGATVSEFAKRCGVLTVEIEHVDAVTLEKLEKQGIDCEPKASTIMIIQDKYRQKTHFSKFGIPLPDFVEVDTLSSIEKAGEMFGYPLMVKSKRLAYDGRGNAVAHDKKELSSVVASLGGFEHGLYVERWTSFVKELSVIVARSRDGSTVCYPVVETIHKDNICHVVEAPAEVPDKIKKLATNVAEKAIKSLEGAGVFAVELFLTQDNQVLLNEVAPRPHNSGHHTIESCYTSQYEQHLRAILGLPLGDPSMKAPASIMYNILGEDEGEAGFTQAHQLIERALDISGASVHWYAKPEIRKQRKMGHITIVGPSKYSVKARLDKLLQRDAYDPKKVAVKPRAAIIMGSDSDLPVMKDAAVVLKKFNIPFELTIVSAHRTPERMYHYALSTKERGLEVIIAGAGGAAHLPGMVASLTSVPVIGVPIMTSSLHGTDSLLSIVQMPKGIPVATVAIGNAENAGLLAVRMLASRDPELGDKATEYQHDLRDMVLEKAKRLEELGWEEYTELYLKKH

SEQ ID NO: 52435 - DNA, 396 bp, uncultured archaeon GZfos32E7
  CDS (1)..(396)
atggacaaagtagctataatcatgggttctgagagtgatcgtgcggttgcggataaggcggttgcggtactggcagagtataatgtcccttacgaagtaaagatgatttccgcacataggaatcccgatgagctggatagatatctgaaggaaagcgaagatgtatcggtgataatagcgattgcaggtctatcggctgcgttaccgggtgtgatagcgtcaaaaacggaaaagcccgttattggcgtgcccgtgagtggtaagttgttaggcatggatgctctgctttctatggttcaaatgccccctggtgttccggtaggcgtagtgggtatagacagcgggaaaaatgcggctttgcttgcgcttcggatgctgaacgtgaaaaagcaatag

SEQ ID NO: 52436 - protein, 131 aa, uncultured archaeon GZfos32E7
MDKVAIIMGSESDRAVADKAVAVLAEYNVPYEVKMISAHRNPDELDRYLKESEDVSVIIAIAGLSAALPGVIASKTEKPVIGVPVSGKLLGMDALLSMVQMPPGVPVGVVGIDSGKNAALLALRMLNVKKQ

SEQ ID NO: 52437 - DNA, 405 bp, uncultured archaeon GZfos13E1
  CDS (1)..(405)
atggataaaatagcggtgatactgggctcggagagcgatagggcgatagcggacaaagtggtaaaggtgctgggtgagcataagatttcttatgacgtgaaggtgatttctgcacacaggaatcccgatgagctggatagatatttaaaagaaagcgaagaagaggtggaagtgataatagcaattgcagggttatcggcggcattgccgggggtaatagcgtcaaaaacgaaaaagcccgtgattggtgttcccgtgagtgggaagttgctcggtatggatgctctgctttccatggtgcagatgcctccgggtgttcctgtagcggtagtaggcatagacaacggcgaaaatgctgctttgcttgctttacgaattttagaacttacaatgaaatgcggatag

SEQ ID NO: 52438 - protein, 134 aa, uncultured archaeon GZfos13E1
MDKIAVILGSESDRAIADKVVKVLGEHKISYDVKVISAHRNPDELDRYLKESEEEVEVIIAIAGLSAALPGVIASKTKKPVIGVPVSGKLLGMDALLSMVQMPPGVPVAVVGIDNGENAALLALRILELTMKCG

SEQ ID NO: 52439 - DNA, 1758 bp, Hebeloma cylindrosporum
  CDS (1)..(1758)
atgtcagaacaggttgttggaatacttggaggaggccagcttggtcgcatgcttgcagcatcggcttccttgttaaaccagaaagttattattcttgatacgggagaacatggaccagccaagcagattatcgcaccgacggaacctcacttggcccatctcgatggatcgttcgcagatcctgtgaagattcgcgaactcgctagcaaagtagatgtgcttaccgtcgagatcgagcacgtcgatgcagccgccctcgaagaagtacgattggcgacgaaaggaaaagttctcgctatccatccgagtccatccaccatccagattatccaggacaaatttcggcagaagcaacacttgtcgtcccacggtctgccagtatcggaatttgtcgaggtcgagtcctctgtggattcgatatccgaagcggcccagaaacttggcctgcctctcatgttgaagagtcgtaccttagcctacgacggccgtggcaattttgtggtccgaaacttgcgacaggtcgaagaagcaattgctgccctgggagggcggcccctttacgctgaaaagtgggttcccttctccaacgaaattgccattatggtcgttaggactgtcgacggtgaggtccaatcttaccctgtggtagaaaccgttcacaaggacaatgtttgccaccttgtattggcacctttacggagtcgagacccttctcttccatcgaaagcgacatctatcgccgaaaatgccataaaatcgttcaccggcgcaggtgtcttcggcgttgaattgtttctgatggatgatgggaaaatatttatcaatgaaattgctccccgtccccataactctggccattacacgatcgaagcctgtgaaacttctcagtatgaaaatcatttacgcgccatcctctcgctcccccttgggtcaaccgcactaaaggtgccttccgctgccatgcttaacttgatcggccagtcgtcttccatgggtgagatcacgaaaaccaaggatgtcgccctcaccattcccggggcttcggtccacttgtatgggaagtcagaatgcaggaaaggtcgaaagatgggtcatatcaccattgtggccgattcggacgcccaactccgatcccgtctgcgcacccttctccaatccctccccgaaaactactgtccgcctggtgagatagacctgtacgcccccgctgccatggtccctggctctggtttctccgatcccaacccactagtgggggttatcatgggctcagactcggatctgcatgtcatgcttccagcagcccgaattcttgatcatttcaagatcccatacgagttgacgatcgtatcagcgcaccgaactcccgaccgcctcgtcgaatacgcccggtccgcatcgacgaggggcctgcgaaccatcattgcaggcgcaggtggtgcggcccatcttccaggaatggtggctgcgatgacggccctccctgtgatcggcgttcccgtgaaaggcagtaccctcgatggcgtagattctttgcacagtatcgttcagatgccgcgtggtatacctgtggcgaccgttgccattaataacggcacgaacgctggtctattagcggtgcggatattgtcagcgggtatcccacatctcattcactccatggagcattatatgagctccatggaaaatgaagttctgggtaaagtcgaaaaattgaaggaagtggggtgggagaactatcaggtgaaacgaagttga

SEQ ID NO: 52440 - protein, 585 aa, Hebeloma cylindrosporum
MSEQVVGILGGGQLGRMLAASASLLNQKVIILDTGEHGPAKQIIAPTEPHLAHLDGSFADPVKIRELASKVDVLTVEIEHVDAAALEEVRLATKGKVLAIHPSPSTIQIIQDKFRQKQHLSSHGLPVSEFVEVESSVDSISEAAQKLGLPLMLKSRTLAYDGRGNFVVRNLRQVEEAIAALGGRPLYAEKWVPFSNEIAIMVVRTVDGEVQSYPVVETVHKDNVCHLVLAPLRSRDPSLPSKATSIAENAIKSFTGAGVFGVELFLMDDGKIFINEIAPRPHNSGHYTIEACETSQYENHLRAILSLPLGSTALKVPSAAMLNLIGQSSSMGEITKTKDVALTIPGASVHLYGKSECRKGRKMGHITIVADSDAQLRSRLRTLLQSLPENYCPPGEIDLYAPAAMVPGSGFSDPNPLVGVIMGSDSDLHVMLPAARILDHFKIPYELTIVSAHRTPDRLVEYARSASTRGLRTIIAGAGGAAHLPGMVAAMTALPVIGVPVKGSTLDGVDSLHSIVQMPRGIPVATVAINNGTNAGLLAVRILSAGIPHLIHSMEHYMSSMENEVLGKVEKLKEVGWENYQVKRS

SEQ ID NO: 52441 - DNA, 1869 bp, Nicotiana tabacum
  CDS (1)..(1869)
atggggaatgctgagcctgcctctccaattttagctgtcaatcctcaaaaaagtatcagcttccttaaaaatcacagctttgtgttttcatcatctttaatgagacaacagtctgaacacaccccaactatgttatcttgcaaagcttctttggaagttgtaacggactcacccggcggtttagaagtccatggaatatcggaaatggttgtgggtgttttgggaggagggcagctgggtcgtatgctgtgtgaagcggcatcccagatggcgatcaaagtgattgtcttggacccaatgaataattgtcctgctagtgcactggcacatcaacatgtggtaggaagctatgatgacagtgccactgttgaagaatttgggaaaaggtgtggagtactaaccgttgagatcgagcatgttgatgttgtcacacttgagaagcttgagcaacaaggtgtggattgccaacccaaggcctctactattcgtataatccaggataaatatcttcagaaggtccacttttctcgtcatgctatcccacttcctaagtttatgcagattgatgatcttgaaagtgctagacgagcaggggacctgtttggttatcctcttatgataaagagcaggaggttggcatatgatgggcgtggcaacgctgtcgctaaaagcgaggaggagctctcctctgctgttaatgcacttggaggatatggtcgtggtttatatgttgagaaatgggcgccatttgtgaaggagctctctgtgattgtggcgaggggaagggatggttcaattgcatgttaccctgctgtagaaactattcacagggataacatttgtcatatcgtaaagtcacctgctaatgtatcttggaagagtatgaaacttgcaacggacgttgcgcacagagctgttagttcattagaaggtgcaggagtctttgctgttgagttgtttttgacagaagatggtcagattttactaaatgaagtagctcccagacctcataatagtgggcatcacaccattgaggcttgcttcacttcacaattcgagcaacatttgcgggctgtggttggccttccacttggtgatccatcaatgaaaactcctgctgcagtcatgtataacatattgggggaagacgatggcgaacctggatttcttttagctaatcaacttattgaaaaagcattgggaatcccgggggtatctgttcattggtatgacaaaccagagatgcgaaggcaacgcaagatgggacacatcacaatagttggcccttctatgggcattgtggaagctcagctaagggtgattctaaatgaagaaagtgttaatggccatcctgcagttgcaccacgtgttgggatcataatgggatctgattcagatcttcctgttatgaaggatgctgccaagattttaaatgagtttgatgtgcctgctgaagtaaaaatagtttcagcccaccgtacacctgagatgatgttttcttatgctttgtctgcacgggaacgtggcatccaagtaataattgctggtgctggtggtgccgcccacttacctggaatggttgctgcatttactccactacctgttattggcgttccagtacgcgcttccacattagatggacttgactccctattgtccattgttcagatgccaagaggggtcccagttgcaacagttgcaattaacaacgccacaaatgctggtctactggcagtaagattgttagggatcagcgacataaagttgcaagctaggatggcccagtaccaagaggacagaagagatgaggttttggtcaagggggagagactagaaaagattggctttgaagaatatctgaactcttaa

SEQ ID NO: 52442 - protein, 622 aa, Nicotiana tabacum
MGNAEPASPILAVNPQKSISFLKNHSFVFSSSLMRQQSEHTPTMLSCKASLEVVTDSPGGLEVHGISEMVVGVLGGGQLGRMLCEAASQMAIKVIVLDPMNNCPASALAHQHVVGSYDDSATVEEFGKRCGVLTVEIEHVDVVTLEKLEQQGVDCQPKASTIRIIQDKYLQKVHFSRHAIPLPKFMQIDDLESARRAGDLFGYPLMIKSRRLAYDGRGNAVAKSEEELSSAVNALGGYGRGLYVEKWAPFVKELSVIVARGRDGSIACYPAVETIHRDNICHIVKSPANVSWKSMKLATDVAHRAVSSLEGAGVFAVELFLTEDGQILLNEVAPRPHNSGHHTIEACFTSQFEQHLRAVVGLPLGDPSMKTPAAVMYNILGEDDGEPGFLLANQLIEKALGIPGVSVHWYDKPEMRRQRKMGHITIVGPSMGIVEAQLRVILNEESVNGHPAVAPRVGIIMGSDSDLPVMKDAAKILNEFDVPAEVKIVSAHRTPEMMFSYALSARERGIQVIIAGAGGAAHLPGMVAAFTPLPVIGVPVRASTLDGLDSLLSIVQMPRGVPVATVAINNATNAGLLAVRLLGISDIKLQARMAQYQEDRRDEVLVKGERLEKIGFEEYLNS

SEQ ID NO: 52443 - DNA, 1668 bp, Mucor circinelloides
  CDS (1)..(1668): n means a or g or c or t/u, s means g or c
atgaatagtcaaaaagtcggtattcttggaggcggtcagttgggtcgtatgatggtagaagctgcatccagactcaacctctctgtcaccattcttgatgctcccgtggacgcacccgccaagcaaattgaatccactcaaaaccacattcaaggcgctttcaacgatgccgccaagatcactgaattagcctctcaagtggatgtgttgactgtagagatcgagcatgtcaatgcggatgtgcttgcccagatcgagcaagaaggtcgtgtgcgtgtctgcccctctgccttcactgtcaagaccatccaagacaagtacaaccaaaagaagtacctagagtcacatggcattcccgttgccgagtaccgcgaaatcaaggatgccgatgctgtcaagcaagtcgccaaggagtttggctatccattgatgctcaagtccaagaccatggcctatgacggcaagggcaactacgtcgtcaagtcagaagctgatgtcgagaaggcagtagctgctctgtccaagacacccttgtacgcagaaaagtgggccccctttgtcaaggaactcgctgtcatggtcgtccgtcgtgccaacggcgaaattagatcatatcctgtagtggaaaccattcacaagaacagcatttgccacctcgtcattgctcctgctcaaatcgacggcagcgtcgctgtcaaggctcaaaagattgccgaaaacgccatcaaatccttccctggtgctggtatctttggcgtcgagatgtttgtcatggccgacggtgagattctgctcaacgaaattgctcctcgtccccacaactcgggccattacaccatcgaggcctgtgagacctctcaatacgaaaaccacatgcgcgccatcttggatttgcccttgggctccactgccagtgyaaggtgcctgcgttccatcatggtcaatatcttgggcgaaaacagcgacatggaagcttgttacaagccttgccaagctgctttattggcagagggcgctaccatccacttgtacggtaagaaggaatccagagctggccgtaagatgggccacattacgttggtgggtgaatccatgatgcaagtgcaaaagaacttgaagcccatcttggacgaaatcgagcctggtgtagagagacccttgacattgcgacctttggtgggtatgattatgggttctgacagcgatttgcctgtcatgaaggtgggtgctcagatcctcaaggactttggtattccctttgaattgtccattgtgtctgctcatcgcactcccttgcgtatggtggaatatgcaaagtctgctgctcagcgcggtctgatggccatcattgctggtgctggtggtgctgctcatttgcctggtatggtggctgccatgacacctttgcctgtcattggtgtgcctgtcaagggcagctctcttgacggcgtggactctctctacagtattgtgcaaatgcctcgcggtatccctgtggccaccgtcgctgtcaacaacagcaccaatgctgctctgcttgctattcgtatcttgggtgcttccattcccggcattcaaaagcaaatggctgcttacatggagaagatggagggagaagtcttgaccaaggtcgagaagcttgacaatgttggatgggaaaactactag

SEQ ID NO: 52444 - protein, 555 aa, Mucor circinelloides
  Xaa in position 306 is unknown
MNSQKVGILGGGQLGRMMVEAASRLNLSVTILDAPVDAPAKQIESTQNHIQGAFNDAAKITELASQVDVLTVEIEHVNADVLAQIEQEGRVRVCPSAFTVKTIQDKYNQKKYLESHGIPVAEYREIKDADAVKQVAKEFGYPLMLKSKTMAYDGKGNYVVKSEADVEKAVAALSKTPLYAEKWAPFVKELAVMVVRRANGEIRSYPVVETIHKNSICHLVIAPAQIDGSVAVKAQKIAENAIKSFPGAGIFGVEMFVMADGEILLNEIAPRPHNSGHYTIEACETSQYENHMRAILDLPLGSTASXRCLRSIMVNILGENSDMEACYKPCQAALLAEGATIHLYGKKESRAGRKMGHITLVGESMMQVQKNLKPILDEIEPGVERPLTLRPLVGMIMGSDSDLPVMKVGAQILKDFGIPFELSIVSAHRTPLRMVEYAKSAAQRGLMAIIAGAGGAAHLPGMVAAMTPLPVIGVPVKGSSLDGVDSLYSIVQMPRGIPVATVAVNNSTNAALLAIRILGASIPGIQKQMAAYMEKMEGEVLTKVEKLDNVGWENY

SEQ ID NO: 52445 - DNA, 1719 bp, Aspergillus oryzae
  CDS (1)..(1719)
atgtggaactctcctaaggtgggaatcctcggcggaggccaattgggccgcatgctggtcgagtccgccaaccgattgaacattcaatgcaacgtgctcgatgcggagaactccccggccaagcagatcagtagccacgatggccacgttaccggttcttttaaggagcgcgaggccgttcgggaactggccaagacctgcgacgttgtgacggcagagattgaacatgtcgatacctacgccctggaggagattgcctctcaggtcaagattgaacccagctggcaagcgattcggacgatccagaacaagttcaaccagaaggagcacctgcggaaatatggtattcccatggcggagcatcgcgagctggccgagaacactcccgaagaattggccaaggtcggcgaacagcttggatatcctatgatgttgaagtcgaagactatggcttacgacggacgtggaaactatcgtgttaactctaaggaggatatccccgaggcccttgaagcgcttaaggaccgcccattgtatgcagagaagtgggcttacttcaagatggaattggccgtcatggtcgtaaagaccaaggatgatgtcctgtcataccctaccgtcgagaccgtccaagaagactcgatatgcaaactcgtctatgcccccgcgcgcaacgtgtccgacgccatcaaccagaaagcccaggagttagcacgtaaggccgtcgcagccttcgacggaaagggtgtttttggtgtcgaaatgttcctcctcgaagacgacagtctgatcctgtgcgaaattgctagccgcattcacaactccggtcactacaccattgaaggttgccccctgtctcaattcgatacccatatccgcgccatcctcgatctccccatccctcctaagagcctcgagctccgtcaaccctccatcatgctcaacatcatcggcggtgccgcccccgacacacacctcaaggccgcagagcatgctctctccatccccaacgccagcatccatctctacagcaagggcgccgccaaaccaggccgcaagatgggccatatcactgtcaccgcgccgaccatgcacgaagccgagacacacatccagcccctgatcgacgtggtcgacgagatccgctcccagcgcagcgacatcaagacccagccccagaagtcgggcccctcgaagcctgcaccctccgtggccgtcatcatgggctcggacagcgatctcaagaccctcgttccaggactcaagctccttaaagagtacttcggcatcgaacccgcagtcgacatcacctccgctcaccgcaccccggagtacatggccgaatactccgccagtgccgctgcccgcggtatcaaggttatcatcgccgctgctggcggcgccgcccatctccccggtatggccgccgctcacaccgctcttcctgtgatcggtgtcccggtcaagggcagctccttggatggtgtcgacagtctgtacagcatcgtgcagatgcccagaggtgtccctgtcgccaccgtcggaatcaacaacagcattaacgccgctctcctggccgccagaatcctgggctcctttgatccagccattcagcgcaaggtggaggcgtatgctgagcaggctaagaccgagaatctcgacttcaagggcactaagatgcgcgaactcggttgggaaaagtactttgagcaaatgtga

SEQ ID NO: 52446 - protein, 572 aa, Aspergillus oryzae
MWNSPKVGILGGGQLGRMLVESANRLNIQCNVLDAENSPAKQISSHDGHVTGSFKEREAVRELAKTCDVVTAEIEHVDTYALEEIASQVKIEPSWQAIRTIQNKFNQKEHLRKYGIPMAEHRELAENTPEELAKVGEQLGYPMMLKSKTMAYDGRGNYRVNSKEDIPEALEALKDRPLYAEKWAYFKMELAVMVVKTKDDVLSYPTVETVQEDSICKLVYAPARNVSDAINQKAQELARKAVAAFDGKGVFGVEMFLLEDDSLILCEIASRIHNSGHYTIEGCPLSQFDTHIRAILDLPIPPKSLELRQPSIMLNIIGGAAPDTHLKAAEHALSIPNASIHLYSKGAAKPGRKMGHITVTAPTMHEAETHIQPLIDVVDEIRSQRSDIKTQPQKSGPSKPAPSVAVIMGSDSDLKTLVPGLKLLKEYFGIEPAVDITSAHRTPEYMAEYSASAAARGIKVIIAAAGGAAHLPGMAAAHTALPVIGVPVKGSSLDGVDSLYSIVQMPRGVPVATVGINNSINAALLAARILGSFDPAIQRKVEAYAEQAKTENLDFKGTKMRELGWEKYFEQM

SEQ ID NO: 52447 - DNA, 1278 bp, Xenopus laevis
  CDS (1)..(1278)
atggagtcttacgcagaactgaagctgggtaagaaattaaatgaagggaaaacgaaagaagtgtacgaactgcccgagcaccctggctgcgtactgatgaagtccaaagacctgattactgccggcgatgcagtacggaaagatcacatggaagggaaagcctctatttccaacaagactactagctgcgtcttcaaactgctgcaggaggctgggatcaaaacggcgtttgtgcggaagtgcagcgacgcggctttcattcctactcactgcgagatgattcccattgaatgggtgtgccgcagaatcgccacgggctcattcttgaagagaaatcctggtgttaaggaaggctacaaattcctcccccctaaagtggagaccttttttaaggatgatgccaaccatgatcctcagtggtctgaggaacaactgatctcggcaaaactcagctgtgcagggcttgtgattggtcaggctgaggtggatatcatgactcactccacagcggccatctttgagattctagagaaggcttggatgactcaggagtgcacactagtagacatgaagattgagtttggtgtggatgttacaaagaaggagattgtcctcgctgatgttattgataatgactcttggcgcctgtggccggctggggacaaatctcaacagaaagataagcaaacatatcgggaactaaaggaggtgacacctgaagctctgcagatggtgaagagaaactttgagtgggtggcagacagagtagagctcctgctgaagtcaaacagccaaggtagggtggtggtgctgatgggatccatttctgacctggcacactgcgaaaagataaagaaatcctgtgcaaactatggcattccctgtgagctgagagtgacttctgcacacaaaggcccggatgaaaccctgcgtatcaagtctgagtacgatggtgatggcattcctacagtcttcatagcagtggctggcagaagcaacggtttgggaccggtcatgtctggaaacactgcttatcccgtgatcaactgcccccctctcactgcagattggggtgcacaggatgtgtggtcgtccctccgaatgcccagtgggcttggatgttccaccgttctctcaccagaagctgcagctcagtttgctgctcaaatctttggcttaaacaaccacctagtgtggtgcaagctccgctcctgcaccctgaacacctggatatctctcaagcaagcggacatgaagctgagggagtgcagcatctga

SEQ ID NO: 52448 - protein, 425 aa, Xenopus laevis
MESYAELKLGKKLNEGKTKEVYELPEHPGCVLMKSKDLITAGDAVRKDHMEGKASISNKTTSCVFKLLQEAGIKTAFVRKCSDAAFIPTHCEMIPIEWVCRRIATGSFLKRNPGVKEGYKFLPPKVETFFKDDANHDPQWSEEQLISAKLSCAGLVIGQAEVDIMTHSTAAIFEILEKAWMTQECTLVDMKIEFGVDVTKKEIVLADVIDNDSWRLWPAGDKSQQKDKQTYRELKEVTPEALQMVKRNFEWVADRVELLLKSNSQGRVVVLMGSISDLAHCEKIKKSCANYGIPCELRVTSAHKGPDETLRIKSEYDGDGIPTVFIAVAGRSNGLGPVMSGNTAYPVINCPPLTADWGAQDVWSSLRMPSGLGCSTVLSPEAAAQFAAQIFGLNNHLVWCKLRSCTLNTWISLKQADMKLRECSI

SEQ ID NO: 52449 - DNA, 405 bp, Salmonella typhi
  CDS (1)..(405): transl_table=11
atgagcgactgggctaccatgcaattcgccgccgaaatttttgaaattctggatgtcccgcaccatgtagaagtggtttccgcccatcgcacccccgataaactgttcagcttcgccgaaacggcggaagagaacggatatcaagtgattattgccggcgcgggcggcgcggcacacctgccgggaatgattgcggcaaaaacgctggtcccggtactcggcgtgccggtacaaagcgctgcgctcagcggcgtggatagcctctactccatcgtgcagatgccgcgcggcattccggtgggtacgctggcgatcggtaaagccggggcggcgaacgccgcactgctggcagcgcaaattttggctacgcatgatagcgcgctgcatcggcgcatcgccgactag

SEQ ID NO: 52450 - protein, 134 aa, Salmonella typhi
MSDWATMQFAAEIFEILDVPHHVEVVSAHRTPDKLFSFAETAEENGYQVIIAGAGGAAHLPGMIAAKTLVPVLGVPVQSAALSGVDSLYSIVQMPRGIPVGTLAIGKAGAANAALLAAQILATHDSALHRRIAD

SEQ ID NO: 52451 - DNA, 405 bp, Salmonella enterica subsp
  CDS (1)..(405): transl_table=11
atgagcgactgggctaccatgcaattcgccgccgaaatttttgaaattctggatgtcccgcaccatgtagaagtggtttccgcccatcgcacccccgataaactgttcagcttcgccgaaacggcggaagagaacggatatcaagtgattattgccggcgcgggcggcgcggcgcacctgccgggaatgattgcggcaaaaacgctggtcccggtactcggcgtgccggtacaaagcgctgcgctcagcggcgtggatagcctctactccatcgtgcagatgccgcgcggcattccggtgggtacactggcgatcggtaaagccggtgccgctaacgccgccctgctcgccgcacagattctggcgcaacacgacgcggaactgcatcagcgcatcgccgactag

SEQ ID NO: 52452 - protein, 134 aa, Salmonella enterica subsp
MSDWATMQFAAEIFEILDVPHHVEVVSAHRTPDKLFSFAETAEENGYQVIIAGAGGAAHLPGMIAAKTLVPVLGVPVQSAALSGVDSLYSIVQMPRGIPVGTLAIGKAGAANAALLAAQILAQHDAELHQRIAD

SEQ ID NO: 52453 - DNA, 1905 bp, Vigna unguiculata
  CDS (1)..(1905)
atgcttcacagtgcacgcgtagtattgtcaggccactccaccatcccagcttttgccttcagaccctctaatccctgtattaagacaacctcttcacttggtttctacatggagcaatctccttctttaaagctaaaacagtgtcaccagccccatcttgcctgtcaagcgacatcacgggatgatgatgatgcttctctaaggaatgatgaaccacctgttcatggaatatctgaagtggttgttggggttctgggaggtgggcaacttggtcgtatgatgtgtcaagccgcttctcagatggccattaaagtcatggttttggatccgcaagaaaattgccctgctagttctctctcttatcatcatatggtcggaagctttgacgaaagcactaaagtggaggaatttgccaagagatgtggagtattgaccgttgaaattgaacatgttgatgttgatacattggaaaaacttgagaaacagggagttgactgccagcccaaagcctctacagtcagaattattcaggataagtatcaacaaaaggttcacttctccaagcatggcattccacttcctgaatttatgaagatagatgatcttgaaagtgctaagaaagttggggaactctttgggtatcctcttatgattaagagtaggagactagcttatgatgggcgaggaaattttgttgctaaaagtgaagaggaactttcatctgctgtggatgctctaggaggatttgatcgaggtttatatgctgaaaaatgggcaccttttgtcaaggaactagctgttattgtggcaagaggaagagacaattcaatttcatgttatcctgttgttgaaactattcacagggacaatatatgccacatagttaaggctccggctaatgtgaaatggaagacgagggagcttgccactgaagttgctgttaatgctgttaagtccctggaaggtgccggtgtgtttgcagttgaattgtttttgactaatgatggagagattttattaaatgaagtagcacctagacctcacaacagtgggcatcatacaatagaatcttgccatacctcgcaatttgagcaacatttgcgggctgttgttggtcttccccttggtgatccatcattgaaaactccagctgctatcatgtacaacatattaggtgaagaagagggggaacttggttttcaattagcacatgaattgatgaaaagggcactggccatccctggtgcttctgttcattggtatgataagccagaaatgagaaagcaacggaagatgggccatataactatcgttgggccctcccttaacaatattgaaagcaatcttgcaattctgctggaagggaaaagattacatgataagactgctgttgctccacgtgtggggattataatgggttctgattcagatctgcctgttatgaaaagtgctgctgaaatcttggagatgtttggtgtgcctcatgaggtaagaatagtttcagcccacaggactccagaattgatgttttcttatgcctcatctgctcatgaacgaggcatacaagtcattattgctggtgctggtggtgcagctcacttgcctggtatggttgctgccctcactcccttgcctgttgttggcgttcctgtgcgtgcttctaccttggatggacttgattcactcttgtcaattgtccagatgccgagaggtgttccagttgccactgttgcagttaataatgcaactaatgctggattgctggcagtgaggatattgggtgttgccaacgataatcttctgtcaaggatgagtcaatatcaagaggaccaaaaagaaatcgtcttgaacaaaggagataaattagaaaaacatggctgggaatcctacttaaaaaatagttag

SEQ ID NO: 52454 - protein, 634 aa, Vigna unguiculata
MLHSARVVLSGHSTIPAFAFRPSNPCIKTTSSLGFYMEQSPSLKLKQCHQPHLACQATSRDDDDASLRNDEPPVHGISEVVVGVLGGGQLGRMMCQAASQMAIKVMVLDPQENCPASSLSYHHMVGSFDESTKVEEFAKRCGVLTVEIEHVDVDTLEKLEKQGVDCQPKASTVRIIQDKYQQKVHFSKHGIPLPEFMKIDDLESAKKVGELFGYPLMIKSRRLAYDGRGNFVAKSEEELSSAVDALGGFDRGLYAEKWAPFVKELAVIVARGRDNSISCYPVVETIHRDNICHIVKAPANVKWKTRELATEVAVNAVKSLEGAGVFAVELFLTNDGEILLNEVAPRPHNSGHHTIESCHTSQFEQHLRAVVGLPLGDPSLKTPAAIMYNILGEEEGELGFQLAHELMKRALAIPGASVHWYDKPEMRKQRKMGHITIVGPSLNNIESNLAILLEGKRLHDKTAVAPRVGIIMGSDSDLPVMKSAAEILEMFGVPHEVRIVSAHRTPELMFSYASSAHERGIQVIIAGAGGAAHLPGMVAALTPLPVVGVPVRASTLDGLDSLLSIVQMPRGVPVATVAVNNATNAGLLAVRILGVANDNLLSRMSQYQEDQKEIVLNKGDKLEKHGWESYLKNS

SEQ ID NO: 52455 - DNA, 1752 bp, Dipodascus magnusii
  CDS (1)..(1752)
atggactctagaactgttggaattctcggtggtggccagctgggtcgtatgcttgttgaagcagccaacagattgaacatcacgaccgccattctggacgctgaaaactcaccagctactcagatcaactcggttggacctcacgtcagcggctctttcaaagatgctgtcagcattgccaagtttgctgaaaagtgcgacgtcttgactgtagagatcgagcacgtcaatgcagacattttacaagatcttttggaccagaagaaagtgaaggaaatccatccatctcctgccactatcaagttgattcaagacaagtatacccagaagcttcattatcttaaacacaaattaccgactcctgctgttttggacgttcctaatgccactcaggaatccgttgctgctgtcggtcaaaagtttggttatccatttgttctcaaggctagaactaatgcttatgatggtcgcggaaactatgttgtcaagaccgctgaggatattcctgaagccttaaaagcccttaaagatactcctttatatgccgaaaagtttgccagatttgaccgtgaattggctgttatggttatccgtactaaggatggtcaaactatttcataccctgctgttgaaaccgttcaagaaaacaatgtttgtcatactgtttatgctcctgccagactttctgattctattcaacaacaagccagaaacgttgccgaaaacgctgtcaagactttagatggtgctggtatttatggtgttgaaatgttccttatgaatggtgacaatgaagaaaccaattctgatttgattcttctcaacgaaattgctcctcgtcctcacaactctggtcattatactcaagacggttgtgccgtttctcaatttgatgctcatattcgtgcagttcttggcttacctattcctcctcttaccatgtctacacctagcacctacacaatcatgctcaacattttgggcgccaaagaagccaatggcgaacttgaagtgtgtaaaagagctcttgaagttccaggctgcactatccatttgtatggaaaaactactagacctggcagaaagatgggtcatatcaacatcactgctggaagcatgcgtgaagctgaagcaaaattagctgccatttcaggtgctacctctaaaaataccatcgaacaaactattcctaaagaagtcgctattgctggaacatcttctactcccaccgttggcatcattatgggttcagattccgatcttcccgtcatgagtgcagcttgcaaggttcttactgaattcaatgttccctacgaagtcaagatcgttagtgctcatcgtacacccagtcgtatgtacagctacgccatcaacggcgtgaaccgtggtttacgcgtcattattgcaggcgccggcggtgctgctcatcttcctggtatggtcgctgctcttactcctttacctgtaattggtgttcctgttaagggttctacactcgatggtgttgattctcttcatagtattgttcaaatgccccgtggcgttcctgtcgctactgttgctattaataatgccatgaacgccggtcttttggctgtcagaatcttggccactggtagcgaaaccaaagatgctgtcttgcttgctaagcttgaaaagtatattcaaaatatggaaaacgaagtgttggcaaagacggaaaagttggaaaccattggctatgaaaagtatttagaagaaaagaagaattaa

SEQ ID NO: 52456 - protein, 583 aa, Dipodascus magnusii
MDSRTVGILGGGQLGRMLVEAANRLNITTAILDAENSPATQINSVGPHVSGSFKDAVSIAKFAEKCDVLTVEIEHVNADILQDLLDQKKVKEIHPSPATIKLIQDKYTQKLHYLKHKLPTPAVLDVPNATQESVAAVGQKFGYPFVLKARTNAYDGRGNYVVKTAEDIPEALKALKDTPLYAEKFARFDRELAVMVIRTKDGQTISYPAVETVQENNVCHTVYAPARLSDSIQQQARNVAENAVKTLDGAGIYGVEMFLMNGDNEETNSDLILLNEIAPRPHNSGHYTQDGCAVSQFDAHIRAVLGLPIPPLTMSTPSTYTIMLNILGAKEANGELEVCKRALEVPGCTIHLYGKTTRPGRKMGHINITAGSMREAEAKLAAISGATSKNTIEQTIPKEVAIAGTSSTPTVGIIMGSDSDLPVMSAACKVLTEFNVPYEVKIVSAHRTPSRMYSYAINGVNRGLRVIIAGAGGAAHLPGMVAALTPLPVIGVPVKGSTLDGVDSLHSIVQMPRGVPVATVAINNAMNAGLLAVRILATGSETKDAVLLAKLEKYIQNMENEVLAKTEKLETIGYEKYLEEKKN

SEQ ID NO: 52457 - DNA, 480 bp, Thermoplasma volcanium
  CDS (1)..(480): transl_table=11
ttgcgattcatgccaaaggttgcagtaatcatggggagttcaagcgattacgaagtaatgaaagccgccatagatacactcaacgagttcggtgtagatgtaatctcgaaagtggtctctgcacataggactccagagtttatgatgcagtttgcaaaggaggcagcttcctctggaatagaagctataatagctggagcaggcggagctgcacacctgcctggcatggttgctgcgatgactccattgccggtgattggagtgccagttcctacgaaaaacctaggagggatggattccctgctatcaatagtgcaaatgccttctggtgtgccagtagctactgttgctattggcaattcgaagaatgcagctctgttggcaattcgaatactgtcaataaaatatcccgatcttatggccaaaatgtctgaatttatggaatctgaaaaacagcgggttcttcaagaaaagatctga

SEQ ID NO: 52458 - protein, 159 aa, Thermoplasma volcanium
MRFMPKVAVIMGSSSDYEVMKAAIDTLNEFGVDVISKVVSAHRTPEFMMQFAKEAASSGIEAIIAGAGGAAHLPGMVAAMTPLPVIGVPVPTKNLGGMDSLLSIVQMPSGVPVATVAIGNSKNAALLAIRILSIKYPDLMAKMSEFMESEKQRVLQEKI

SEQ ID NO: 52459 - DNA, 1875 bp, Nicotiana tabacum
  CDS (1)..(1875)
atgggtcctcagagaagcagttttgcctctccaattttagctgtcaatcctcaaaaaagtatcagcttccttaaaaatcacagctttgtgttttcatcatctttaatgagacaacagtctgaacacaccccaactatgttatcttgcaaagcttctttggaagttgtaacggactcacccggcggtttagaagtccatggaatatcggaaatggttgtgggtgttttgggaggagggcagctgggtcgtatgctgtgtgaagcggcatcccagatggcgatcaaagtgattgtcttggacccaatgaataattgtcctgctagtgcactggcacatcaacatgtggtaggaagctatgatgacagtgccactgttgaagaatttgggaaaaggtgtggagtactaaccgttgagatcgagcatgttgatgttgtcacacttgagaagcttgagcaacaaggtgtggattgccaacccaaggcctctactattcgtataatccaggataaatatcttcagaaggtccacttttctcgtcatgctatcccacttcctaagtttatgcagattgatgatcttgaaagtgctagacgagcaggggacctgtttggttatcctcttatgataaagagcaggaggttggcatatgatgggcgtggcaacgctgtcgctaaaagcgaggaggagctctcctctgctgttaatgcacttggaggatatggtcgtggtttatatgttgagaaatgggcgccatttgtgaaggagctctctgtgattgtgccgaggggaagggatggttcaattgcatgttaccctgctgtagaaactattcacagggataacatttgtcatatcgtaaagtcacctgctaatgtatcttggaagagtatgaaacttgcaacggacgttgcgcacagagctgttagttcattagaaggtgcaggagtctttgctgttgagttgtttttgacagaagatggtcagattttactaaatgaagtagctcccagacctcataatagtgggcatcacaccattgaggcttgcttcacttcacaattcgagcaacatttgcgggctgtggttggccttccacttggtgatccatcaatgaaaactcctgctgcagtcatgtataacatattgggggaagacgatggcgaacctggatttcttttagctaatcaacttattgaaaaagcattgggaatcccgggggtatctgttcattggtatgacaaaccagagatgcgaaggcaacgcaagatgggacacatcacaatagttggcccttctatgggcattgtggaagctcagctaagggtgattctaaatgaagaaagtgttaatggccatcctgcagttgcaccacgtgttgggatcataatgggatctgattcagatcttcctgttatgaaggatgctgccaagattttaaatgagtttgatgtgcctgctgaagtaaaaatagtttcagcccaccgtacacctgagatgatgttttcttatgctttgtctgcacgggaacgtggcatccaagtaataattgctggtgctggtggtgccgcccacttacctggaatggttgctgcatttactccactacctgttattggcgttccagtacgcgcttccacattagatggacttgactccctattgtccattgttcagatgccaagaggggtcccagttgcaacagttgcaattaacaacgccacaaatgctggtctactggcagtaagattgttagggatcagcgacataaagttgcaagctaggatggcccagtaccaagaggacagaagagatgaggttttggtcaagggggagagactagaaaagattggctttgaagaatatctgaactcttaa

SEQ ID NO: 52460 - protein, 624 aa, Nicotiana tabacum
MGPQRSSFASPILAVNPQKSISFLKNHSFVFSSSLMRQQSEHTPTMLSCKASLEVVTDSPGGLEVHGISEMVVGVLGGGQLGRMLCEAASQMAIKVIVLDPMNNCPASALAHQHVVGSYDDSATVEEFGKRCGVLTVEIEHVDVVTLEKLEQQGVDCQPKASTIRIIQDKYLQKVHFSRHAIPLPKFMQIDDLESARRAGDLFGYPLMIKSRRLAYDGRGNAVAKSEEELSSAVNALGGYGRGLYVEKWAPFVKELSVIVPRGRDGSIACYPAVETIHRDNICHIVKSPANVSWKSMKLATDVAHRAVSSLEGAGVFAVELFLTEDGQILLNEVAPRPHNSGHHTIEACFTSQFEQHLRAVVGLPLGDPSMKTPAAVMYNILGEDDGEPGFLLANQLIEKALGIPGVSVHWYDKPEMRRQRKMGHITIVGPSMGIVEAQLRVILNEESVNGHPAVAPRVGIIMGSDSDLPVMKDAAKILNEFDVPAEVKIVSAHRTPEMMFSYALSARERGIQVIIAGAGGAAHLPGMVAAFTPLPVIGVPVRASTLDGLDSLLSIVQMPRGVPVATVAINNATNAGLLAVRLLGISDIKLQARMAQYQEDRRDEVLVKGERLEKIGFEEYLNS

SEQ ID NO: 52461 - DNA, 489 bp, Streptococcus suis
  CDS (1)..(489): transl_table=11
atgaatattccaatttccatcatcatgggctctagttccgactggaaaaccatgaaaaaagcagccgatgtgctggacaaatttggcgtagcctatgaaaagaaagtggtttttgcccaccgcaccccagacctcgtgttccgtcatgccgaagaggcgcgtggtcgtggtattaaggttattatcgcgggagcgggtggtgcggctcatttgccaggtatggtagcagccaagaccaccctgcctgttatcggtgttcctgtccaatcccgtgccctcagcggtgtggattcgctctattctatcgtgcaaatgccaggcggcgtacctgtggcaacgatggcaattggagaagcgggagcaaccaatgcggctttgactgccctgcgtatcctgtccatcgaagatagcggtatagcagatcaactggccagctttgctattgaacaaggaaaaatcgcggaggctatgagcgatgaactcaactaa

SEQ ID NO: 52462 - protein, 162 aa, Streptococcus suis
MNIPISIIMGSSSDWKTMKKAADVLDKFGVAYEKKVVFAHRTPDLVFRHAEEARGRGIKVIIAGAGGAAHLPGMVAAKTTLPVIGVPVQSRALSGVDSLYSIVQMPGGVPVATMAIGEAGATNAALTALRILSIEDSGIADQLASFAIEQGKIAEAMSDELN

SEQ ID NO: 52463 - DNA, 483 bp, Thermoplasma acidophilum
  CDS (1)..(483): transl_table=11
gtgagtcttatgcctagggttgcggttataatgggcagttcaagcgactacgagaccatgaagcccgctgtggatttcctcagatccatgcacatagatgttgtgctcaagattgtctcagcgcacaggacacctgaatatatgtttcagttcgcgtccagcgccagagatcaaggcatagaggttataattgctggggcaggcggtgcagcgcatcttccgggtatggttgcatcgatgacaacgctgcctgttataggcgtccctgttccgagcaggaatttaaatgggctggattcgcttctttccatagtgcagatgccatccggaatacctgttgccacggtcgcgatagggaattcgaaaaatgccgccatactggcatgcaggatactctccataaagtatcctgagatcgagaaagccattaagaagtacatggatgacgagcgagacagggtgcttaacgaaaagcttgaatga

SEQ ID NO: 52464 - protein, 160 aa, Thermoplasma acidophilum
MSLMPRVAVIMGSSSDYETMKPAVDFLRSMHIDVVLKIVSAHRTPEYMFQFASSARDQGIEVIIAGAGGAAHLPGMVASMTTLPVIGVPVPSRNLNGLDSLLSIVQMPSGIPVATVAIGNSKNAAILACRILSIKYPEIEKAIKKYMDDERDRVLNEKLE

SEQ ID NO: 52465 - DNA, 1719 bp, Candida boidinii
  CDS (1)..(1719)
atggattcaaagacaattggtatcttaggtggtggtcaacttggccgtatgttagttgaggctgctagtagattaaacatcaaaacagttattcttgaaaatggtgatcaatcaccagctaaacaaattaatgcttcttctactcacatagatggatctttcaatgatccagaagctattgctaaattagctgctgcttgtgatatcatgacagtagaaattgaacatgttaatacagaagccttacaaaaaatttcagattcaacaggtttaccaatttatccaactcctgctacattgtctgtcatcaaagataaatatttacaaaaagaacatttaataaaacatggtattgcagttgctgaatctgttgctgttgaatcaaatgaggaatcattattaaaagttggtgaacaatttggttaccctttcatgcttaaggctagaactttagcttatgacggaagaggtaattttgtcgttaaatctcaagataaaataaaagaagctatcgaattcttaggtgatagacctttatacgctgaaaaatgggctccatttactaaagaattagctgtcatggttgttagatccgttgatggtaacgtttactcttacccaacagttgaaacaatccatcgtgataatatctgtcatacagtctttgctccagctagagttcaagattctatcttaaagaaagctcaaatcttagctgataacgcagttaagtcatttgatggtgctggtatctttggtgttgaaatgttcttattaccttcaggtgatttattagttaatgaaattgccccaagaccacataactcaggtcattacacaattgacgcttgcgttacttcacaatttgaagctcttattagagctttagccggtttaccaatgccagataatttcactaaattctcaactccacaaacaaatgccattatgttaaacgttttaggtactgatatcccaaattctgaatttgaattatgtagacgtgctttagaaactccaaattcttctgtttatttatacggtaaaacaacaagacctaagagaaaaatgggtcacattaatattgtttcaggttctatgcaagattgtgaacgtcgtttaagatatatcgaaggtgaaacagatgaaaaacctgctgctgccaactcaaagaccaacgctgtcgctggtacttctgaaaaacctttggtcggtgttatcatgggttcagattctgatttacctgttatgtcattaggctgtaatatactgaaacaatttggtgtcccatttgaagtcactattgtatcagctcacagaaccccagaacgtatggctaaatacgcagctgacgctccagcaagaggtattaaagctataatagcaggtgctggtggtgctgctcacttaccaggtatggtcgctgccatgaccccattaccagtcattggtgtcccagttaaaggatcaactttagatggtgttgattctttacactcaattgttcaaatgccaagaggtatcccagttgctacagttgctattaataatgctacaaatgcggctttattagctattagaatattaggtgcttctgatagtaaatggtttacagaaatggatgcttatatgaaaggtatggaaaaagaagttttacaaaaagctgaaaaacttgaaaaaggcggttatgaagattacttatcaacctacaaaaaataa

SEQ ID NO: 52466 - protein, 572 aa, Candida boidinii
MDSKTIGILGGGQLGRMLVEAASRLNIKTVILENGDQSPAKQINASSTHIDGSFNDPEAIAKLAAACDIMTVEIEHVNTEALQKISDSTGLPIYPTPATLSVIKDKYLQKEHLIKHGIAVAESVAVESNEESLLKVGEQFGYPFMLKARTLAYDGRGNFVVKSQDKIKEAIEFLGDRPLYAEKWAPFTKELAVMVVRSVDGNVYSYPTVETIHRDNICHTVFAPARVQDSILKKAQILADNAVKSFDGAGIFGVEMFLLPSGDLLVNEIAPRPHNSGHYTIDACVTSQFEALIRALAGLPMPDNFTKFSTPQTNAIMLNVLGTDIPNSEFELCRRALETPNSSVYLYGKTTRPKRKMGHINIVSGSMQDCERRLRYIEGETDEKPAAANSKTNAVAGTSEKPLVGVIMGSDSDLPVMSLGCNILKQFGVPFEVTIVSAHRTPERMAKYAADAPARGIKAIIAGAGGAAHLPGMVAAMTPLPVIGVPVKGSTLDGVDSLHSIVQMPRGIPVATVAINNATNAALLAIRILGASDSKWFTEMDAYMKGMEKEVLQKAEKLEKGGYEDYLSTYKK

SEQ ID NO: 52467 - DNA, 1713 bp, Zygosaccharomyces rouxii
  CDS (1)..(1713)
atgaattcgcaaactgttggtatacttggtggtggccaattgggtcgtatggttgttgaagctgctaatagattaaacatcaagactattatattagatgcaccaaattccccagctaagcaaattaatgcgttaaatgaacatgtagatggttcattctcaaatccagctgatattgaaaaattagctgaaaaatgtgatgtcttgacagttgaaattgaacatgtcgatgtgcccactttgaagaaactacaatcaaaacatcctaacctaaaaatttatccatctccagaaaccattggtttaattcaagataagtatgtccaaaaaaaccatttagtggccaataatattgcagtagcagaatctatacccattgaatccacaactagtgaaggtttagctctagctggtagacaattgggatacccctacatgttaaaatcaagaacaatggcttacgatggtagaggaaattttgtagttaagagcgaggaatcaattccaaaagcccttgagtttttgaaagatagaccattatatgccgaaaaatgggctccatttactaaagaattggctgttatgattgtgcgttccattgatggtcgtgtgttttcatacccaaccgtagagacaattcataaggataacatctgtttcctatgttatgcaccagcaagagttcccgattccgttcaattaaaggccaaactattagcagaaaatgcagttagagcttttcccggttgtggtatctttggtgttgaaatgttctatttagaaacaggggaattgctcatcaacgaaattgcaccaagacctcataattctggtcactatacgattgatgcctgtattacttcacaatttgaagcacacctaagagctatcctagacttaccaatgcccaaggatttctcctctctttctacatcttgcaccaacgccattatgctcaacgtgcttggagaagatgtaaagaatcaagaattacagacttgcgaaagagcgttagagaccccaggtgcctctgtgtacctgtacggtaaggaatcaagacctaagcgcaaattaggtcacattaatgtggttacttcatccatggaggagtgtgaaagacgtctttcattcattactggcgagacttctgagccagttaagatcactgtagctcaaaagatagattcggaatccaatgggaaacctgttgtcggcattattatgggttccgattcagacctaccagtaatgtccaaggcatgtgctattcttgaagaatttgaggtcccattcgaagtgacaatcgtttctgctcacagaacccctcaaagaatgaacaaatatgcatcagaagcctcttctcgtggtctaaaggccatcattgcaggtgcaggtggtgctgcccatctacctggtatggttgccgctatgactcctctaccagttatcggtgtaccagtgaaaggctcctccctagatggtgtcgattccctacattccattgtacaaatgcctagaggggtgcctgtagctacagtggcaatcaacaatagcaccaacgcagccctgctggcagtcaggttcatcggtgctttcgaaccaaagtaccataagaaaatgcaacagtacctgttaaaacaagaggtagaagtgctagaaaaggctaaaaaattggaaaattctggttacaagaattacatgggccttgagtaa

SEQ ID NO: 52468 - protein, 570 aa, Zygosaccharomyces rouxii
MNSQTVGILGGGQLGRMVVEAANRLNIKTIILDAPNSPAKQINALNEHVDGSFSNPADIEKLAEKCDVLTVEIEHVDVPTLKKLQSKHPNLKIYPSPETIGLIQDKYVQKNHLVANNIAVAESIPIESTTSEGLALAGRQLGYPYMLKSRTMAYDGRGNFVVKSEESIPKALEFLKDRPLYAEKWAPFTKELAVMIVRSIDGRVFSYPTVETIHKDNICFLCYAPARVPDSVQLKAKLLAENAVRAFPGCGIFGVEMFYLETGELLINEIAPRPHNSGHYTIDACITSQFEAHLRAILDLPMPKDFSSLSTSCTNAIMLNVLGEDVKNQELQTCERALETPGASVYLYGKESRPKRKLGHINVVTSSMEECERRLSFITGETSEPVKITVAQKIDSESNGKPVVGIIMGSDSDLPVMSKACAILEEFEVPFEVTIVSAHRTPQRMNKYASEASSRGLKAIIAGAGGAAHLPGMVAAMTPLPVIGVPVKGSSLDGVDSLHSIVQMPRGVPVATVAINNSTNAALLAVRFIGAFEPKYHKKMQQYLLKQEVEVLEKAKKLENSGYKNYMGLE

SEQ ID NO: 52469 - DNA, 486 bp, Lactococcus lactis
  CDS (1)..(486): transl_table=11
atggcagaagtagcaattatcatgggttgcagctcagattgggcgacaatgaaagaaacagcaaaaattttagatgactttggtttagcttatgaaaaaaaggtcgtatcagcacaccgaacaccagctttgatggctgaattttcgagccaagcccgtgagcgaggttataaagttatcatcgcaggtgctggtggagccgctcatttgccaggaatggtatctgctcagactctcgttccagtcattggcgttccaataaaatcacgcgctttatctggtctggattcactttattcaattgttcaaatgccggcaggggttcctgtagcgacaatggcaattggagaggctggagcaaaaaatgctgctttatttgctttgcaacttttggcgaatacaaacgagaatttaatccaaaaattgttggtctatcgggctgctgcgcaagaaatggttgaggaatcaaacaaagcattactttaa

SEQ ID NO: 52470 - protein, 161 aa, Lactococcus lactis
MAEVAIIMGCSSDWATMKETAKILDDFGLAYEKKVVSAHRTPALMAEFSSQARERGYKVIIAGAGGAAHLPGMVSAQTLVPVIGVPIKSRALSGLDSLYSIVQMPAGVPVATMAIGEAGAKNAALFALQLLANTNENLIQKLLVYRAAAQEMVEESNKALL

SEQ ID NO: 52471 - DNA, 504 bp, Aquifex aeolicus
  CDS (1)..(504): transl_table=11
atgaaaccactcgttggcgtaataatgggaagtatttccgactgggagtatatgaaaaaggctgttgaagttttaaaggaattcggagttcctcacgaggttaaagtggtctccgcacacagaacgcccgaactcatgtatgaatacgcaaaaaccgcaagggagaggggaatagaggtgataatagcgggagcgggaggctccgcccatcttccgggaatgaccgcctctatgactacacttcccgttataggcgttcccatacccactaaaaacctcggaggagtggactcgttgtactcgatagtccagatgccagcgggtattcccgtggctacggtggctataggaaacgcaacaaatgccgggctcttagcggtaagaattctctcaataaagtaccccgagtatgctaagaaattggacgagtacacggaaaaactgaaggagaaagtggctaaaatgaacgaagaactgcaaaaggaggtggaaaatggaatttga

SEQ ID NO: 52472 - protein, 167 aa, Aquifex aeolicus
MKPLVGVIMGSISDWEYMKKAVEVLKEFGVPHEVKVVSAHRTPELMYEYAKTARERGIEVIIAGAGGSAHLPGMTASMTTLPVIGVPIPTKNLGGVDSLYSIVQMPAGIPVATVAIGNATNAGLLAVRILSIKYPEYAKKLDEYTEKLKEKVAKMNEELQKEVENGI

SEQ ID NO: 52473 - DNA, 543 bp, Archaeoglobus fulgidus
  CDS (1)..(543): transl_table=11
atgtctcaattcctgagcttaaggaactgcttgaggcttacgataaggttgttgaggcaatttcgaagaggtgaagggatgaaggcggtaataattatgggttcgaaatctgacctggattactcgaagaagatagcttcaaagctcgcagattttggcattgatgctgtaatgagaatcgcttcagcccacaaaactcccgagaaggttctggaaatcataaaggagtacgagaaggaggatgtggtcttcgtcaccgtagcgggaaggagcaacgctctgagcggttttgttgacgcaaacacctcaaagccggtaatagcgtctcccccctacagcgacaagtttggaggggcagacatcttctcaagcataaggatgccttcaggcgttgcgccaatgctcgttcttgaggctgagaacgctgccttagcggttgcaaagattttcgctcttaaggatgagggggtcagggagaaagttgtccagttccaggagaacaagaggagagaaatttataaagcggatgaggaactgaggtga

SEQ ID NO: 52474 - protein, 180 aa, Archaeoglobus fulgidus
MSQFLSLRNCLRLTIRLLRQFRRGEGMKAVIIMGSKSDLDYSKKIASKLADFGIDAVMRIASAHKTPEKVLEIIKEYEKEDVVFVTVAGRSNALSGFVDANTSKPVIASPPYSDKFGGADIFSSIRMPSGVAPMLVLEAENAALAVAKIFALKDEGVREKVVQFQENKRREIYKADEELR

SEQ ID NO: 52475 - DNA, 489 bp, Bacillus subtilis
  CDS (1)..(489): transl_table=11
atgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaagaccttgcccgtaagctggatgagagaagagaaaatacaaaacagacagtgttagaaagcagtgatcagcttgtctaa

SEQ ID NO: 52476 - protein, 162 aa, Bacillus subtilis
MQPLVGIIMGSTSDWETMKHACDILDELNVPYEKKVVSAHRTPDFMFEYAETARERGIKVIIAGAGGAAHLPGMTAAKTTLPVIGVPVQSKALNGMDSLLSIVQMPGGVPVATTSIGKAGAVNAGLLAAQILSAFDEDLARKLDERRENTKQTVLESSDQLV

SEQ ID NO: 52477 - DNA, 489 bp, Brucella melitensis
  CDS (1)..(489)
atgagcgttgatgtcgccattatcatgggaagccagtccgattgggaaaccatgcaccatgcagccgacacattggaggcgctcggcatctccttcgacgcacggatcgtttccgcccatcgcacccctgacaggctggtcgccttcgccaagggggcgaaagcggaaggcttcaaggtcatcatcgcaggcgccggcggcgcggcccacctgcccggcatggccgctgccatgacaccgcttcccgtctttggcgttccagttcaatccaaggcgctttcgggccaggattcgctactctccatcgtacagatgccagcgggtattcccgtcggcactctcgccatcggccgtgcaggcgcggtcaatgccgcccttctcgccgccgccgttctggcgctatatgatgaagcacttgccgcccgtcttgatgaatggcgcaaggcgcagaccgaaagcgttgcagaacgcccctcgaacgaagcctga

SEQ ID NO: 52478 - protein, 162 aa, Brucella melitensis
MSVDVAIIMGSQSDWETMHHAADTLEALGISFDARIVSAHRTPDRLVAFAKGAKAEGFKVIIAGAGGAAHLPGMAAAMTPLPVFGVPVQSKALSGQDSLLSIVQMPAGIPVGTLAIGRAGAVNAALLAAAVLALYDEALAARLDEWRKAQTESVAERPSNEA

SEQ ID NO: 52479 - DNA, 489 bp, Brucella suis
  CDS (1)..(489): transl_table=11
atgagcgttgatgtcgccattatcatgggaagccagtccgattgggaaaccatgcgccatgcagcccacacattggaggcgctcggcatctccttcgacgcacggatcgtttccgcccatcgcacccctgacaggctggtcgccttcgccaagggggcgaaagcggaaggcttcaaggtcatcatcgcaggcgccggcggcgcggcccacctgcccggcatggccgctgccatgacaccgcttcccgtctttggcgttccagttcaatccaaggcgctttcgggccaggattcgctactctccatcgtacagatgccagcgggtattcccgtcggcactctcgccatcggccgtgcaggcgcggtcaatgccgcccttctcgccgccgccgttctggcgctatatgatgaagcacttgccgcccgtcttgatgaatggcgcaaggcgcagaccgaaagcgttgcagaacgcccctcgaacgaagcctga

SEQ ID NO: 52480 - protein, 162 aa, Brucella suis
MSVDVAIIMGSQSDWETMRHAAHTLEALGISFDARIVSAHRTPDRLVAFAKGAKAEGFKVIIAGAGGAAHLPGMAAAMTPLPVFGVPVQSKALSGQDSLLSIVQMPAGIPVGTLAIGRAGAVNAALLAAAVLALYDEALAARLDEWRKAQTESVAERPSNEA

SEQ ID NO: 52481 - DNA, 1272 bp, Caenorhabditis elegans
  CDS (1)..(1272)
atgtcgtcgttggctgaaatcgcgtcgagacccgaaaacttggagcttcttgctgaaggaaaaaccaagcaaatctttgatattaaaggagaaaaggattatgtgctcattcgttccaaagatagcttgaccgcattcaacgctgtccgtaaaaatgagcttgaaggaaagtctagaatcgcaagtaaaaccacatcaaacgtgtttgaatatcttcaacttctcggtctaccaacacactttgaaaaaagcatctctgaaactgaatttgtcgcccgtaaatgcaccatgattccgattgaatgggtggcacgacgtgttgcgacaggatccttcttgaagagaaatcctggagttaaagagggtttcagatttaatgatctgaaattggagacatttttcaaagacgacgctaatgatgatccacaatggactgatgaacaaattgtgtcgaatggtttgatgattgatcatttgaaaattggaagagaagagatttcattgatgaagaagatgacaaagttggtgtttagagcattggagaaaggatgggctctttcaaatagtgctctgattgatatgaagatcgaattcggagtcacagttgaaggagaaattctcctggccgacgtgattgacaatgactcgtggagagtttggcctgaaaatgatagacgtctgcagttggataagcaagtttacagggatatgaaggaagtgacagaagaggggttggctctcgttttgaagaattatacaaaggttatggatatcactgccaccttctcaaaacaccagcaaaaatgccatgttcttgtgatcatgggatctggttcggatggcgtattcgcacggaaaatctctgatgaagccaagaaatttggactggaaactacgctgaaagtaagctcagctcataaaactacctcggacactctggaagttatcgctgatttcgaagaaagtggagttccgacagttgtgattgcagtagctggaagatccaatggactcggtccagttattgctggaaactcgtctcttccggtgatcaactgcccgccaccaagtgaatcaacgagtcttgacatttggtcatcactccgaatgccgaatggaatcgggtgtactacagtgttggacccatcggaggccgcgcttgccgccgcaaaaatcctcgcgtctcacaatcatattgtgtttggaaaagtgctcactgcacagctcaagaatcaaatcaacatttacaacgccaatcgcaaacttgaatag

SEQ ID NO: 52482 - protein, 423 aa, Caenorhabditis elegans
MSSLAEIASRPENLELLAEGKTKQIFDIKGEKDYVLIRSKDSLTAFNAVRKNELEGKSRIASKTTSNVFEYLQLLGLPTHFEKSISETEFVARKCTMIPIEWVARRVATGSFLKRNPGVKEGFRFNDLKLETFFKDDANDDPQWTDEQIVSNGLMIDHLKIGREEISLMKKMTKLVFRALEKGWALSNSALIDMKIEFGVTVEGEILLADVIDNDSWRVWPENDRRLQLDKQVYRDMKEVTEEGLALVLKNYTKVMDITATFSKHQQKCHVLVIMGSGSDGVFARKISDEAKKFGLETTLKVSSAHKTTSDTLEVIADFEESGVPTVVIAVAGRSNGLGPVIAGNSSLPVINCPPPSESTSLDIWSSLRMPNGIGCTTVLDPSEAALAAAKILASHNHIVFGKVLTAQLKNQINIYNANRKLE

SEQ ID NO: 52483 - DNA, 1707 bp, Candida albicans
  CDS (1)..(1707): transl_table=12
atggatagcaaaactgttggtattttaggaggtggccaattaggtcgtatgattgttgaagcagcacatagattgaatatcaagaccgtaattttggacgcagccaaatcaccagctaaacagatcaatgctctagacgatcacgttgatggatcgttcacaaactatgattcgattgtgaaattagctgaaaaggcagacgtattaactgttgaaatcgaacatgttgatgttgatgctttaatcaaagttcaagagaaattccctaaagttgaaatatatccattacctgaaaccataagattgattcaagataaatatttacagaaaaatcatttaatcaaacacgatgttgcagttacagaatctgttgcagttgaaaccaacacagtcgatgacttgttacacattggggaaaagtttggatacccttatatgttaaaatcgagaactttggcgtatgatggtagaggtaactttgttgtcaaagacaagtcatactgtgagaaagctttagaatttttaaaagaccgtccattatatgctgaaaaatggtgtcctttcaccaaagaattggctgtgatggttgtcagatcattagaaggggaagtctttgcttacccaactgttgaaactattcatgaaaacaatatttggcatttagtgtatgctcctgccaggatcccagatactttgggccaaaaggcatctatattagccaaaaatgcagttaagtcattccccgggtgtggtattttcggtgttgaaatgttcttgttggaaaacaacgaattattgatcaatgaaattgcaccaagacctcacaactctggtcattataccattgatgcatgtgtcacttcacaatttgaagctcatgttcgtgctgtcacaggattacctatgccaaaggggttcactgaattctccacttccatcaccaatgctattatgttgaatgtcttgggtgataaggcaaccccaaataaagaactggagatttgtcgccgtgctttggaaactccacatgcgtcagtgtatctttatggtaaagctactagaccagagcgaaagatgggtcatatcaatgttgtcacatcttccatgcaagatgccgagagtagattaagttatatattgggtgataccactgaaattcctaaatctttagctaccgacaaggaatctccattggtgggaataataatgggttccgattcggatctaccagttatggcagttggtgctcgtattttgaaacaattcggtgtgccatttgaactcacaatcgtaagtgcacacagaactcctcatagaatgtctgagtatgctattgaagcaccaaagcgtggcttgaaatgtatcattgctggtgcaggtggtgctgctcatttgccaggtatggtggcggccatgaccccattgcctgtcattggtgttccagttaagggatctacattagatggggttgattcgttacactctatagtacagatgccaagaggtattcctgttgcaactgttgctattaacaatagtactaatgctgcattgttggcaatcagaatattaggcgcctatgactcaaaatggttgactgagatgaaccaatatatgttgaacatggaaactgaagtattaggtaaagcagaaactttagaagaaattggatatgaagactatttaactgataaattgaaaaaatag

SEQ ID NO: 52484 - protein, 568 aa, Candida albicans
MDSKTVGILGGGQLGRMIVEAAHRLNIKTVILDAAKSPAKQINALDDHVDGSFTNYDSIVKLAEKADVLTVEIEHVDVDALIKVQEKFPKVEIYPLPETIRLIQDKYLQKNHLIKHDVAVTESVAVETNTVDDLLHIGEKFGYPYMLKSRTLAYDGRGNFVVKDKSYCEKALEFLKDRPLYAEKWCPFTKELAVMVVRSLEGEVFAYPTVETIHENNIWHLVYAPARIPDTLGQKASILAKNAVKSFPGCGIFGVEMFLLENNELLINEIAPRPHNSGHYTIDACVTSQFEAHVRAVTGLPMPKGFTEFSTSITNAIMLNVLGDKATPNKESEICRRALETPHASVYLYGKATRPERKMGHINVVTSSMQDAESRLSYILGDTTEIPKSLATDKESPLVGIIMGSDSDLPVMAVGARILKQFGVPFELTIVSAHRTPHRMSEYAIEAPKRGLKCIIAGAGGAAHLPGMVAAMTPLPVIGVPVKGSTLDGVDSLHSIVQMPRGIPVATVAINNSTNAALLAIRILGAYDSKWLTEMNQYMLNMETEVLGKAETLEEIGYEDYLTDKLKK

SEQ ID NO: 52485 - DNA, 1713 bp, Candida glabrata
  CDS (1)..(1713)
atggactctagaactgtcggtattttgggtggaggccagttgggccgtatgattgtcgaggctgcaaaccgcttgaatatcaagactttgatacttgacgcaccaaattcacctgcgaagcaaattacgaatgcatctgatcatgtcgatggatcatttgcaaataaggaggatatcgaggccttggctgccaagtgtgatgttatgacagttgaaatcgagcatgtggatgttaatgcattgaaggaagtccaaaaacaattccccaaattggaaatctaccctacgcctgaaaccattggtttgatccaggataagtatgtgcaaaaacaacatttagttaagaatagaattcccgtagtaccgagcatcactgttgaaaattcgaaggaatccttaattaaaacaggatcctcattgggttacccatttgtcttgaaatcaagaacattagcctacgatggaagaggcaactttgttgttaaatctgaagaagacattgagaaaggacttgaatttttggcgaacagaccactatacgctgaaaaatgggcttcctttaagaaggaattatctgtaatgattatcagatcattggatggaagagtatattcataccctattgttgaaacaattcacaaaaacaatgtgtgccacttgtgctatgttccggctcgtgtaccagactcagtacaacacaaggccaaattaatggcggaaaatgcaatcaagtcattcccaggttgtggtatatttggtgtagaaatgtttttgttggatgatgactctatcgtcttgaatgaaattgcacccagacctcataactcaggtcattacaccattaatgcttgtgttgtatctcaatttgaagcacacttgagagccatattagatttacccatgcccaagaactttacttccttaagtactaactctacaaatgctataatgctaaacctattaggagatcctgaaactaaagacaaggaacttcaaatatgtgagagggccttgaatacgcctggcgcatctgtatacctatacggcaaagagtccaagcctaacagaaaggtcggtcatatcaatattgtatgttcgagtatgaaggaatgtgacaagagattacagtttattatgggtctaaaaaccgacccaattaagcattcagttatggaaattttaaatgcggaggaagtaagaaaacctttagttggtgttataatgggatccgattctgatttacccgtaatgtcagcagcttgtaaaatgttggagcaattcgaggtcccatttgaggtcactatagtctcagcacacagaactccttacagaatgaataaatatgcttcagaagcagtatcccgtggtattaaagttatcattgcaggtgcgggtggagcagcacatcttccaggtatggtagcagctatgacacctgtaccagttattggagtacctgtcaagggctctactttagatggtgtagactcactacattctattgttcaaatgccaagaggtgtaccagtagccacagtagccataaataacagcactaacgcaggtattctggctgttaggatgttaggaatacataattatgactatgttaagaaaatggaggaatttttgaacaaacaggaagaggaagtacttcagaaagcagccaaactcgaaagcattggatatgaaaagtacctagagtccaaatag

SEQ ID NO: 52486 - protein, 570 aa, Candida glabrata
MDSRTVGILGGGQLGRMIVEAANRLNIKTLILDAPNSPAKQITNASDHVDGSFANKEDIEALAAKCDVMTVEIEHVDVNALKEVQKQFPKLEIYPTPETIGLIQDKYVQKQHLVKNRIPVVPSITVENSKESLIKTGSSLGYPFVLKSRTLAYDGRGNFVVKSEEDIEKGLEFLANRPLYAEKWASFKKELSVMIIRSLDGRVYSYPIVETIHKNNVCHLCYVPARVPDSVQHKAKLMAENAIKSFPGCGIFGVEMFLLDDDSIVLNEIAPRPHNSGHYTINACVVSQFEAHLRAILDLPMPKNFTSLSTNSTNAIMLNLLGDPETKDKELQICERALNTPGASVYLYGKESKPNRKVGHINIVCSSMKECDKRLQFIMGLKTDPIKHSVMEILNAEEVRKPLVGVIMGSDSDLPVMSAACKMLEQFEVPFEVTIVSAHRTPYRMNKYASEAVSRGIKVIIAGAGGAAHLPGMVAAMTPVPVIGVPVKGSTLDGVDSLHSIVQMPRGVPVATVAINNSTNAGILAVRMLGIHNYDYVKKMEEFLNKQEEEVLQKAAKLESIGYEKYLESK

SEQ ID NO: 52487 - DNA, 534 bp, Corynebacterium ammoniagenes
  CDS (1)..(534): transl_table=11
atgactgcaccgctagttgggctcatcatgggctctgattctgattggccaaccgttgaaccagcagctgaggttctcgacgaattcggtgttccttttgaggtgggcgtggtctctgcgcaccgcacgccggaaaagatgctggattacgccaagcaagcccacactcgcggcatcaaggtgattgttgcttgtgccggtggggcagcgcacctaccaggcatggtggctgcagcaactcctttgccagttattggtattccacgtgccttgaaagatttggaaggtctggactctttgctgtctatcgtgcagatgccagctggggttccggttgcgaccgtgtctatcggcggcgctaagaatgctggcttgctcgccatccgtaccctgggcgtgcagtactcagaattggttgaacgcatggccgattaccaagaaaatatggccgattaccaaccgaaaatatggccaaggaagttgagcaaaaagacgccaatcttcgcgccaagctcatgggggactagaccttag

SEQ ID NO: 52488 - protein, 177 aa, Corynebacterium ammoniagenes
MTAPLVGLIMGSDSDWPTVEPAAEVLDEFGVPFEVGVVSAHRTPEKMLDYAKQAHTRGIKVIVACAGGAAHLPGMVAAATPLPVIGIPRALKDLEGLDSLLSIVQMPAGVPVATVSIGGAKNAGLLAIRTLGVQYSELVERMADYQENMADYQPKIWPRKLSKKTPIFAPSSWGTRP

SEQ ID NO: 52489 - DNA, 1749 bp, Cryptococcus neoformans
  CDS (1)..(1749)
atggcccccagaaagactgtcggtatcctcggcggtggccagctcggccggatgcttacccaccctgcggcccttctcggcattcctctccttatcctcgactctggctcctacacgcccgccaaacagactcttcttcctcctcctcctcattctcaccctgatggtcccttcacttcggaaactcatattcgcaaacttgcctctgcgtgcgacatcctgacagtggagatcgagcacgttaacgccgatgtccttgaggctgtagaaaaggaaggtctttgtgaagtccagcccagtccccaaactatcagattgatccagaacaagtacgaccaaaagaagtaccttgctgaaagaggtgtggctgttgcaccttttgaggagcttcccgcaaacccgacggaagaggattttaaggctatcgcaggtcgattgggtttgcctttgatgctcaaagctaagacccttgcctacgatggacgtgggaactcacctcttaaatccgcatcttcaggggacattcaggcttccttgaaattccttggtgacaggcctctttatgctgaaggatgggcgccctttgtcaaggaagttgcggttatggtcgttaggaataaggagggcgaagtccgaagttacgacgccgtcgagactattcacagggagagcattttacgagtctgtttggcccccctcagaggtgaaaagggtgtgaatcagagggctagggaattagctgagaaggcggttggacaccttgagggtgctggtatctttggggttgagatgttcctcatgcctgatggtgaacttcttctgaacgagattgctcctcgtcctcataactctggtcatcacactattgaggcctgtcttacttcccaatttgagaaccaccttcgagccattctctccttgcctcttggttctactgctcttcgtgttccctccgctgccatggtcaacattctcggtgcctcgtcgactatggacgccatcgacaaaatggcagacaatgctctcactgttcctggtgctgccgtgcatctctacggcaaagctgagagccgaaaggcccgtaagatgggccacatcacggtgactgccgaaagcgatgctgagctcaatgagcgccttagagccctcttattcgcccagcctgatgcccatgccgactggatcgacctcatcgcccctccttcccctgctcccgctcattcccacgccaaaccccttgttggtatcatcatgggtagcgactctgacttgcccgttatgcaccctgctaccaagatcctcgaaaaattcggtgtcccctacgagctcaccataacttctgcccatcgcactcctgagcgaatggtgaagtatgcgaagactgctgcagaccgaggattgcgagccatcattgctggggctggcggtgctgcccatttaccaggtatggtcgccagcgagaccagtttgccagtcatcggtgtgcccgtcaaggccagtgtactggatggcgtggattcattgtatagtattgtgcaaatgccccgaggtattccatgcgccactgtgggtatcaacaactctacaaatgccgcgctacttgcagtccgtatccttggaacatctgtacccgcccttaacaaggctactgaggaatattccaaggcgctagaggaagaagttttggctaaagccgacattttggaggaggaaggctgggacaagtacatcgagaggctgaagaaataa

SEQ ID NO: 52490 - protein, 582 aa, Cryptococcus neoformans
MAPRKTVGILGGGQLGRMLTHPAALLGIPLLILDSGSYTPAKQTLLPPPPHSHPDGPFTSETHIRKLASACDILTVEIEHVNADVLEAVEKEGLCEVQPSPQTIRLIQNKYDQKKYLAERGVAVAPFEELPANPTEEDFKAIAGRLGLPLMLKAKTLAYDGRGNSPLKSASSGDIQASLKFLGDRPLYAEGWAPFVKEVAVMVVRNKEGEVRSYDAVETIHRESILRVCLAPLRGEKGVNQRARELAEKAVGHLEGAGIFGVEMFLMPDGELLLNEIAPRPHNSGHHTIEACLTSQFENHLRAILSLPLGSTALRVPSAAMVNILGASSTMDAIDKMADNALTVPGAAVHLYGKAESRKARKMGHITVTAESDAELNERLRALLFAQPDAHADWIDLIAPPSPAPAHSHAKPLVGIIMGSDSDLPVMHPATKILEKFGVPYELTITSAHRTPERMVKYAKTAADRGLRAIIAGAGGAAHLPGMVASETSLPVIGVPVKASVLDGVDSLYSIVQMPRGIPCATVGINNSTNAALLAVRILGTSVPALNKATEEYSKALEEEVLAKADILEEEGWDKYIERLKK

SEQ ID NO: 52491 - DNA, 1674 bp, Debaryomyces occidentalis
  CDS (1)..(1674)
atggataacaagatagttgggattttaggcggtggccaattaggtcgtatgatagttgaagcagctaacaggctaaacatcaaaaccgtcgtattagatgtaccaaactcacctgcaaagcaaattaattcaaatgaacatgttgatggatcattcacagatttaaaatctattattcaattagctgaaaaatgtgacattttaaccgttgaaattgaacatgttgatgttgaagctttaaaatatgttaaggaaaaatttggcgttgaaatttatccattgccagacacaattaaattaattcaagataaatatttacagaaggagcatttgattcaacatggaatttctgtaactgaatcggtagcagtgccatccaatgatgaacaatccttaattgagatcggtaataaatttaattatcccttcatgttgaaatcgagaactttagcctatgatggaagaggtaactacgttgttaaaacaaaagaatcaattcctgaagctcttgagtttttaaaagacagacctttgtatgctgaaaaatggtgtccgtttaacaaagaattagcagtaatggttgttagatcaattgaaggtgaagtatttgcatatcctactgttgaaactatccataaaaataatatctgtcatgtagtgtatgctcctgcaagggtttcagactccatagcagtgaaagcttcagtattagctaaaaacgctgttaaatctttcccaggttgtggtatttttggtgttgaaatgttcttattaccaaacaatgaaatattaattaatgagattgctccaagacctcataactctggacattacactatcgatgcttgtgtcacatcacaatttgaagctcatgtcagagcagttgttggattaccaatgccaaagaactttaccagtctctctacaactacaacaaatgcaattatgttaaatgtgttaggtgacgaagaatcaaataaagaattagaaatttgtcgtagagctttggaaactccaaatgcttctgtttatctctacgggaagtcaactagaccaaacagaaaaatgggtcatattaacattgtctcatcttcaatggaagattgtgagagtagattggactatattataggcaaatcatcaaaaatcccagaaaatttaattccaaaagaaaaacccttagtcagtataataatgggttcagattcagacttgccagttatgtctgttggtgcaaacattttaaagaggtttggagttccatttgaattaactatcgttagtgcgcatagaacacctcatagaatgacacaatatgctattgaagcaccaaagagaggcttaaaagtcataattgctggtgcaggtggtgctgctcatttaccaggtatggttgctgccatgacaccattaccagttattggcgttcctgtgaaaggctcgactttagatggtgttgattcattgcattcaatcgttcaaatgccaaggggtattcctgttgcaactgtcgcaattaataacagtactaatgctgccttgttggcagtccgtattttgggagcctacgactacaagtggttaaatgagatgaaccagtatatgaataacatggaaaacgaagtgttagctaaagctgaaagattggaagaagttggttatgaaaaatattaa

SEQ ID NO: 52492 - protein, 557 aa, Debaryomyces occidentalis
MDNKIVGILGGGQLGRMIVEAANRLNIKTVVLDVPNSPAKQINSNEHVDGSFTDLKSIIQLAEKCDILTVEIEHVDVEALKYVKEKFGVEIYPLPDTIKLIQDKYLQKEHLIQHGISVTESVAVPSNDEQSLIEIGNKFNYPFMLKSRTLAYDGRGNYVVKTKESIPEALEFLKDRPLYAEKWCPFNKELAVMVVRSIEGEVFAYPTVETIHKNNICHVVYAPARVSDSIAVKASVLAKNAVKSFPGCGIFGVEMFLLPNNEILINEIAPRPHNSGHYTIDACVTSQFEAHVRAVVGLPMPKNFTSLSTTTTNAIMLNVLGDEESNKELEICRRALETPNASVYLYGKSTRPNRKMGHINIVSSSMEDCESRLDYIIGKSSKIPENLIPKEKPLVSIIMGSDSDLPVMSVGANILKRFGVPFELTIVSAHRTPHRMTQYAIEAPKRGLKVIIAGAGGAAHLPGMVAAMTPLPVIGVPVKGSTLDGVDSLHSIVQMPRGIPVATVAINNSTNAALLAVRILGAYDYKWLNEMNQYMNNMENEVLAKAERLEEVGYEKY

SEQ ID NO: 52493 - DNA, 495 bp, Haemophilus influenzae
  CDS (1)..(495): transl_table=11
atgtcaaaaactgcacaaattgccgttgtaatgggttccaaaagcgattgggctactatgcaagaggcaactcagattttagatgaattaaacgtgccttatcatgtggaagtcgtctcggctcatcgtacgcctgataaactttttgaatttgctgaaaatgcacaaaaaaatggctataaagtaattattgctggtgcagggggggcggcacatttacccggtatgatcgcagcgaaaacacttgtgccagtgctgggggtgccagtaaaaagttctatgttaagtggtgtggatagcctttattcaattgtgcaaatgccaaaagggattcctgtcggaacattagcgattggccctgcgggtgcggcaaatgctgggttgttagcagcccaaattctagcaggttgggatgatgcgttattcactcgcctacaagcattccgcgaaaatcaaaccaatatggtattggacaatcctgatccacgcacataa

SEQ ID NO: 52494 - protein, 164 aa, Haemophilus influenzae
MSKTAQIAVVMGSKSDWATMQEATQILDELNVPYHVEVVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILAGWDDALFTRLQAFRENQTNMVLDNPDPRT

SEQ ID NO: 52495 - DNA, 474 bp, Methanococcus jannaschii
  CDS (1)..(474): transl_table=11
atgatatgtataatcatgggtagtgaaagcgatttaaaaatagctgaaaaagcagttaatattttaaaagaatttggtgtagagtttgaggttagagttgcctctgcccatagaacaccagagttagttgaggagattgttaaaaattcaaaggctgatgtatttatagctatagctggattagccgctcatctaccgggagttgtagcaagcttaacaacaaaaccagttattgctgttcctgttgatgcaaagttagatggtttagacgctttacttagctcagtccagatgcctcctggaattcctgttgctactgttggaattgatagaggagaaaacgctgctatattagccttagaaatcttagctttaaaagatgaaaatattgcaaaaaaattgattgaatatagagagaagatgaagaagaaagtttatgcatcagatgaaaaagttaaggaaatgtttaaataa

SEQ ID NO: 52496 - protein, 157 aa, Methanococcus jannaschii
MICIIMGSESDLKIAEKAVNILKEFGVEFEVRVASAHRTPELVEEIVKNSKADVFIAIAGLAAHLPGVVASLTTKPVIAVPVDAKLDGLDALLSSVQMPPGIPVATVGIDRGENAAILALEILALKDENIAKKLIEYREKMKKKVYASDEKVKEMFK

SEQ ID NO: 52497 - DNA, 1020 bp, Methanobrevibacter smithii
  CDS (1)..(1020): transl_table=11
atgacaccaaaagtaatgataattctgggaagtgggtcagatattgctatcgctgaaaaaagtatgaagattttggaaaaacttgaaataccatatagtttgaaaatagcttcagcacatagaacacctgatcttgtaagagaacttgttgtacagggaaccaatgcaggtataaaagtatttattggaattgcaggattagctgctcatcttccaggagcaatagctgcatatactcacaaaccggttattggagttcctgtagatgttaaagttagcggactggatgcactatattcttcagttcaaatgccttatccctctcctgtagccactgttggaattgataggggagataatggagctattttagctgcacgaatcctagggctttatgacgaggaaatacgcaaaaaagtattggaatcaaaagaaggatatagacagaaagtcattaaaaacaatgaagaaattgtccaaaaaatagacaatccacatattaccaatgactttttaaggattaaaaacctcgaattaaatgaaactacagaagaatttaatggaagctacattaataaaaatgctgaggtagtcattattgttggaagacatactgatttaattactggaaaaaaagtaagtgttacactagacagacttaaaatacctcatgatatgcaagtaatttgcccgattagatcaggaaaaaaattcagagcatatgtaaacactatgaaaaatgctaaaatatttattggaattaattccaactcttcccaggtaagtggaggtcttgtaggtcttactgaaaagcctgttattggagttccatgtgaaaatgaacttggaaataattacctgctttcaactgtaaatatgccaccaggagtacctgtagctactgttggtgttaataatggtcgtaatgctgctgttttaagtggtgaaatactttctattaacaatcctgttcttttagagcttttagaaaaattaaaaaataaaaaaatcaacatataa

SEQ ID NO: 52498 - protein, 339 aa, Methanobrevibacter smithii
MTPKVMIILGSGSDIAIAEKSMKILEKLEIPYSLKIASAHRTPDLVRELVVQGTNAGIKVFIGIAGLAAHLPGAIAAYTHKPVIGVPVDVKVSGLDALYSSVQMPYPSPVATVGIDRGDNGAILAARILGLYDEEIRKKVLESKEGYRQKVIKNNEEIVQKIDNPHITNDFLRIKNLELNETTEEFNGSYINKNAEVVIIVGRHTDLITGKKVSVTLDRLKIPHDMQVICPIRSGKKFRAYVNTMKNAKIFIGINSNSSQVSGGLVGLTEKPVIGVPCENELGNNYLLSTVNMPPGVPVATVGVNNGRNAAVLSGEILSINNPVLLELLEKLKNKKINI

SEQ ID NO: 52499 - DNA, 1005 bp, Methanobacterium thermoautotrophicum
  CDS (1)..(1005): transl_table=11
atgaagcccagagtgatgatactccttggaagtgcatctgatttcaggatagccgaaaaggcaatggaaatctttgaggaactcaggataccctatgacctgagggttgcctcagcccacaggacacatgaaaaggtaaaggcaatagtctcagaggccgtgaaggcgggtgttgaggtattcataggaatagcaggactatcagcccatcttccaggcatgatatctgcaaacacccacagacccgtcataggggtccctgttgacgttaaacttggagggctcgacgccctctttgcatgttcacagatgcccttccctgcccccgtcgccactgtgggggtagacaggggagaaaacgccgcaatactcgctgcccagataatagggataggagatcccggggtaagggaaagggttgcagatctaaggagaggtttctatgaacgcgtgcggagagatgaatgtcaggtgctcaacagcatagaggggtcctactatgcacccctggaggttgaaatgcctcccattggtgataaggtcccgtcagattcccaggatgaccccatggtatctgtgatacctggcagctactctgacatgaagatagccaagaagaccaccatgttcctcgaaaggatgggtataagctatgatctgaacgtcatatcacccataaggtaccctgaaagatttgagaggtaccttgagaagatggagaacgtgaagctcttcatagccataagcggcctctctgcacatgttacgggtgctgttgttgccctcagcgacaggccggtgataggggttccctgccccctcaagatgaacggctgggactcactcctctcaatgatcaacatgccgccgggtgtacctgttggaacggtgggggtaggtaacggtggtaacgccgcaatactggctgctgaaatgcttggaatatacgatgaaaagatagaatcgaggataaagaggataaagagccgttccgttaagttctaa

SEQ ID NO: 52500 - protein, 334 aa, Methanobacterium thermoautotrophicum
MKPRVMILLGSASDFRIAEKAMEIFEELRIPYDLRVASAHRTHEKVKAIVSEAVKAGVEVFIGIAGLSAHLPGMISANTHRPVIGVPVDVKLGGLDALFACSQMPFPAPVATVGVDRGENAAILAAQIIGIGDPGVRERVADLRRGFYERVRRDECQVLNSIEGSYYAPLEVEMPPIGDKVPSDSQDDPMVSVIPGSYSDMKIAKKTTMFLERMGISYDLNVISPIRYPERFERYLEKMENVKLFIAISGLSAHVTGAVVALSDRPVIGVPCPLKMNGWDSLLSMINMPPGVPVGTVGVGNGGNAAILAAEMLGIYDEKIESRIKRIKSRSVKF

SEQ ID NO: 52501 - DNA, 516 bp, Mycobacterium leprae
  CDS (1)..(516): transl_table=11
atgaccaggcagccccgagtcggggtgatcatgggcagcgacagcgactggtcggtgatgcaagatgcggcccatgcactggcggagtttgacatcccgatcgaggttcgggtggtgtcggcgcatcgcacccctgctgagatgttcgactatgcgcgcaatgctgtcgaccgcagcatcgcggtgatcattgccggcgccggcggcgcagctcacctgcctggaatggtcgcttccgcgactccgctgccggtgatcggggtgccggtgccgctggccaggctcgacggcctggactcgctgctgtcgatcgtgcagatgccagcgggagttccggttgccacagtgtctatcggtggtgcccgcaacgcgggtttgttggcggtgcgtattttgggatcgtcggacctgcagcttcgagcgcagctggtcgcgttccaggaccggttggccgataccgtgcgggccaaggatgcggatttacagcggtttcgaggtaagttaatcggcgactaa

SEQ ID NO: 52502 - protein, 171 aa, Mycobacterium leprae
MTRQPRVGVIMGSDSDWSVMQDAAHALAEFDIPIEVRVVSAHRTPAEMFDYARNAVDRSIAVIIAGAGGAAHLPGMVASATPLPVIGVPVPLARLDGLDSLLSIVQMPAGVPVATVSIGGARNAGLLAVRILGSSDLQLRAQLVAFQDRLADTVRAKDADLQRFRGKLIGD

SEQ ID NO: 52503 - DNA, 525 bp, Mycobacterium tuberculosis
  CDS (1)..(525): transl_table=11
atgactcctgccggcgagcggccccgggtcggggtgatcatgggcagcgacagcgactggccggtgatggccgacgctgcggcggcgctggccgagttcgacattccggccgaggttcgggttgtttcggcccatcgcacccctgaggcgatgttcagttatgcgcgcggcgcggccgagcgcggtctcgaggtgatcatcgccggagcgggcggggccgcgcacttgcccggtatggtcgccgccgcgacgccgctgccggtgatcggggtgccggtaccgctgggcaggctggacggccttgactccctgctgtcgatcgtgcaaatgccggccggggttccggtggccacggtgtccatcgggggcgccggtaatgccggactgctggcggtgcggatgctgggagccgccaacccccagctgagggcccggatcgtcgcattccaggaccggctggccgacgtcgtggcggccaaggatgcggaactgcagcggcttgcgggtaagttaacccgcgactag

SEQ ID NO: 52504 - protein, 174 aa, Mycobacterium tuberculosis
MTPAGERPRVGVIMGSDSDWPVMADAAAALAEFDIPAEVRVVSAHRTPEAMFSYARGAAERGLEVIIAGAGGAAHLPGMVAAATPLPVIGVPVPLGRLDGLDSLLSIVQMPAGVPVATVSIGGAGNAGLLAVRMLGAANPQLRARIVAFQDRLADVVAAKDAELQRLAGKLTRD

SEQ ID NO: 52505 - DNA, 1632 bp, Pichia methanolica
  CDS (1)..(1632)
atggactcgcaaactgtcgggattttaggtggtggccaacttggtcgtatgatcgttgaagctgcacacagattgaatatcaaaactgtgattctcgaaaatggagaccaggctccagcaaagcaaatcaacgctttagatgaccatattgacggctcattcaatgatccaaaagcaattgccgaattggctgccaagtgtgatgttttaaccgttgagattgaacatgttgacactgatgcgttggttgaagttcaaaaggcaactggcatcaaaatcttcccatcaccagaaactatttcattgatcaaagataaatacttgcaaaaagagcatttgattaagaatggcattgctgttgccgaatcttgtagtgttgaaagtagcgcagcatctttagaagaagttggtgccaaatacggcttcccatacatgctaaaatctagaacaatggcctatgacggaagaggtaattttgttgtcaaagacaagtcatatatacctgaagctttgaaagttttagatgacaggccgttatacgccgagaaatgggctccattttcaaaggagttagctgttatggttgtgagatcaatcgatggccaagtttattcctacccaactgttgaaaccatccaccaaaacaacatctgtcacactgtctttgctccagctagagttaacgatactgtccaaaagaaggcccaaattttggctgacaacgctgtcaaatctttcccaggtgctggtatctttggtgttgaaatgtttttattacaaaatggtgacttattagtcaacgaaattgccccaagacctcacaattctggtcactataccatcgacgcttgtgtcacctcgcaatttgaagctcatgttagggccattactggtctacccatgccgaagaacttcacttgtttgtcgactccatctacccaagctattatgttgaacgttttaggtggcgatgagcaaaacggtgagttcaagatgtgtaaaagagcactagaaactcctcatgcttctgtttacttatacggtaagactacaagaccaggcagaaaaatgggtcacattaatatagtttctcaatcaatgactgactgtgagcgtagattacattacatagaaggtacgactaacagcatccctctcgaagaacagtacactacagattccattccgggcacttcaagcaagccattagtcggtgtcatcatgggttccgattcggacctaccagtcatgtctctaggttgtaatatattgaagcaatttaacgttccatttgaagtcactatcgtttccgctcatagaaccccacaaagaatggccaagtatgccattgatgctccaaagagagggttgaagtgcatcattgctggtgctggtggtgccgctcatttaccgggaatggttgcggcgatgacgccgctgcctgttattggtgtccctgttaaaggctctactttggatggtgttgattcactacactccatcgttcaaatgccaagaggtattcctgttgctactgtggctattaacaatgctactaacgctgccttgctagctatcacaatcttaggtgccggcgatccaaatacttgtctgcaatggaagtttatatga

SEQ ID NO: 52506 - protein, 543 aa, Pichia methanolica
MDSQTVGILGGGQLGRMIVEAAHRLNIKTVILENGDQAPAKQINALDDHIDGSFNDPKAIAELAAKCDVLTVEIEHVDTDALVEVQKATGIKIFPSPETISLIKDKYLQKEHLIKNGIAVAESCSVESSAASLEEVGAKYGFPYMLKSRTMAYDGRGNFVVKDKSYIPEALKVLDDRPLYAEKWAPFSKELAVMVVRSIDGQVYSYPTVETIHQNNICHTVFAPARVNDTVQKKAQILADNAVKSFPGAGIFGVEMFLLQNGDLLVNEIAPRPHNSGHYTIDACVTSQFEAHVRAITGLPMPKNFTCLSTPSTQAIMLNVLGGDEQNGEFKMCKRALETPHASVYLYGKTTRPGRKMGHINIVSQSMTDCERRLHYIEGTTNSIPLEEQYTTDSIPGTSSKPLVGVIMGSDSDLPVMSLGCNILKQFNVPFEVTIVSAHRTPQRMAKYAIDAPKRGLKCIIAGAGGAAHLPGMVAAMTPLPVIGVPVKGSTLDGVDSLHSIVQMPRGIPVATVAINNATNAALLAITILGAGDPNTCLQWKFI

SEQ ID NO: 52507 - DNA, 492 bp, Pseudomonas aeruginosa
  CDS (1)..(492): transl_table=11
atgagcgcactggttggcgtgatcatgggttccaaatcggactggagcaccctcagtcacaccgcggacatgctggacaagctgggcatcccctacgaagtgaaggtggtttccgcccaccgcaccccggacctgctcttccagtacgccgaggaagccgaaggccgcggcctcgaagtgatcatcgccggcgctggcggcgccgcccacctgccgggcatgtgcgcggccaagacccacctgccggtactcggcgtgccggtacagtcgtcgatgctgtcgggtgtcgactcgctgctctccatcgtgcagatgcccgccggcgtaccggtcgccaccctggccatcggcaaggccggcgcggtcaacgcggcgctgctctcggcgagcatcctcggcgccaagcacccgcagtaccacgaggcgctgaagcagttccgcgccaaccagaccgaaaccgtgctggacaatcccgacccgcgcgatgcgtga

SEQ ID NO: 52508 - protein, 163 aa, Pseudomonas aeruginosa
MSALVGVIMGSKSDWSTLSHTADMLDKLGIPYEVKVVSAHRTPDLLFQYAEEAEGRGLEVIIAGAGGAAHLPGMCAAKTHLPVLGVPVQSSMLSGVDSLLSIVQMPAGVPVATLAIGKAGAVNAALLSASILGAKHPQYHEALKQFRANQTETVLDNPDPRDA

SEQ ID NO: 52509 - DNA, 525 bp, Pyrococcus abyssi
  CDS (1)..(525): transl_table=11
ttggtgaaggttgggatgcctaaggtagggataataatgggtagcgattctgacctcccagtaatgaaagaggccgcaaaggttctcgaagactttgaagttgattacgagatgaaggtgatctcagcgcacagaacaccagaaaggttacacgagtacgcaagaacagcagaagagaggggaatagaagttataatcgcaggagctggaggcgctgcccatctcccaggagttttagctgcgctaacgatgattccagttataggggttcccataaaaagcaaagcactaaacggtcttgactcgctcctatcgatagtccaaatgcccccaggaattccagttgcaactgtaggaatagatggagcaaagaacgccgcactcttagctttggagattttatcaataaagtatcctgagataaaggagaagctgaagaagtacagagaagacatgaagagaaaggtagaagaaaaatccaaaaagttggaagagctaggatggaggaaatacttggagggctag

SEQ ID NO: 52510 - protein, 174 aa, Pyrococcus abyssi
MVKVGMPKVGIIMGSDSDLPVMKEAAKVLEDFEVDYEMKVISAHRTPERLHEYARTAEERGIEVIIAGAGGAAHLPGVLAALTMIPVIGVPIKSKALNGLDSLLSIVQMPPGIPVATVGIDGAKNAALLALEILSIKYPEIKEKLKKYREDMKRKVEEKSKKLEELGWRKYLEG

SEQ ID NO: 52511 - DNA, 534 bp, Pyrococcus horikoshii
  CDS (1)..(534): transl_table=11
gtggtgataagcatgaaaagtgaaaagccactcgttggaattataatgggtagtgactctgatttaccagtaatgaaagaggccgcaaggattttggaagagtttggggttccgtatgagataacgataatatcggcccataggactccagagagagcttatgaatacgcaaagaaagcggaggaaaggggaatagaagtaataatagctggagctggaggagcggcccacctcccagggattattgcatcactaacggttctacccgttattggagtgccaataaagagtaaagccttgaatggtctcgactccttgttatcgatagttcaaatgccaagtgggatcccggttgctaccgtagctatagataacgcgaagaacgctgcacttttagccctgaggatcctgggaataaaataccccgagatcaaagaaaagcttagaaggtacatgaaagatatgaaaaggaaagtcgaagaaaaggcaaaaagattagaagagatgggatgggaaaggtatctatcggagtaa

SEQ ID NO: 52512 - protein, 177 aa, Pyrococcus horikoshii
MVISMKSEKPLVGIIMGSDSDLPVMKEAARILEEFGVPYEITIISAHRTPERAYEYAKKAEERGIEVIIAGAGGAAHLPGIIASLTVLPVIGVPIKSKALNGLDSLLSIVQMPSGIPVATVAIDNAKNAALLALRILGIKYPEIKEKLRRYMKDMKRKVEEKAKRLEEMGWERYLSE

SEQ ID NO: 52513 - DNA, 1659 bp, Schizosaccharomyces pombe
  CDS (1)..(1659)
atgagcgaaaaacaggttgtagggatccttggaggtggtcaattgggccgaatgatggtagaggcagcccatcgcttaaacatcaaatgcatcatcttggatgcagcaaattctcctgccaaacaaattgatggaggacgtgagcacattgatgcatcatttactgaccccgatgcaattgttgaactgtctaagaagtgcacgttattaacaactgaaattgagcatattaacactgatgccttggcagccgttacgaaatctgttgctgttgaaccctctcctgcaactctgcgatgcattcaagacaaatatcttcaaaaacagcatttacaggtttttaagattgcacttcctgaattttgcgatgcacctgaccaggaaagtgttgaaaaagcaggccaagagtttggttatccttttgtactgaaaagtaaaacattggcttacgacggtcgtggaaattacgttgttcatcaaccatctgagattcctactgccatcaaagcacttggtgatcgtccgctttatgttgaaaagttcgttcctttctccatggaaattgcagtgatggtagtacgcagtttagacggaaaagtttatgcttatcctacaactgagaccattcaaaaggataatgtttgtcatttagtatatgcccctgctcgtcttcccttctcaattcaacagcgtgctcaaacccttgccatggatgcggtgcgcacttttgaaggcgctggtatatatggtgtagagatgtttgttttgcaagatggtgagaccattttactcaacgaaattgctcctcggcctcacaattcaggtcactacaccattgaagcttgcccaacttctcagtttgaagctcacttacgggccatatgtggtcttcctttcagcgaaatcaacacccaactctcgacttccacaactcatgcgttgatggtaaatattttaggtactgatgatcctgattatgtttcaaagatcgctaaacgttctctgtccattcccggtgcaactttgcatctttatggtaaagctgaatctagaaagggtcgcaagatgggacacgttaccatcatttctgattcacctcaagaatgtgaacgtaggtatcagatgcttcttgacgtcaaagatcctgtcgaatcacctgttgttggtattatcatgggttcggattctgatttaagcaagatgaaagatgctgccgtcattttagatgaattcaaggtgccttacgaacttactattgtttcagctcaccgcacaccagatcgcatggttacttatgctcgtaccgcagcttcaagagggttgcgtgtgattattgctggtgctggtggtgccgctcatttgcctggtatggttgctgcaatgacacctcttccagtaatcggcgttcctgtaaaaggaagcactcttgacggagttgactctcttcactctattgttcagatgcctcgaggtgtccctgtcgccactgttgctatcaataatagccaaaatgccggtattttagcctgtcgtatacttgctacatttcaaccctcccttttggctgctatggagagctttatggacaatatgaaagagattgttttagaaaaggctgataaattagaaaaagttggttggaaaaattattctgcatag

SEQ ID NO: 52514 - protein, 552 aa, Schizosaccharomyces pombe
MSEKQVVGILGGGQLGRMMVEAAHRLNIKCIILDAANSPAKQIDGGREHIDASFTDPDAIVELSKKCTLLTTEIEHINTDALAAVTKSVAVEPSPATLRCIQDKYLQKQHLQVFKIALPEFCDAPDQESVEKAGQEFGYPFVLKSKTLAYDGRGNYVVHQPSEIPTAIKALGDRPLYVEKFVPFSMEIAVMVVRSLDGKVYAYPTTETIQKDNVCHLVYAPARLPFSIQQRAQTLAMDAVRTFEGAGIYGVEMFVLQDGETILLNEIAPRPHNSGHYTIEACPTSQFEAHLRAICGLPFSEINTQLSTSTTHALMVNILGTDDPDYVSKIAKRSLSIPGATLHLYGKAESRKGRKMGHVTIISDSPQECERRYQMLLDVKDPVESPVVGIIMGSDSDLSKMKDAAVILDEFKVPYELTIVSAHRTPDRMVTYARTAASRGLRVIIAGAGGAAHLPGMVAAMTPLPVIGVPVKGSTLDGVDSLHSIVQMPRGVPVATVAINNSQNAGILACRILATFQPSLLAAMESFMDNMKEIVLEKADKLEKVGWKNYSA

SEQ ID NO: 52515 - DNA, 477 bp, Sulfolobus solfataricus
  CDS (1)..(477): transl_table=11
gtgccaaaagtagctgtaattatgggaagtaaaaatgactgggaatatatgagagaagctgtagagattttgaaacaattcgggatagactatgaggctagagtggtttcagctcatagaacaccagaatttatgatgcaatacgctaaagaagcagaaaaaagaggaatagaagtaattattgctggggctggtggagcagctcatttgccaggcatggttgcttcacttacaagtcttccagttattggtgttcctattccctcaaagaatctaaatggtcttgactcgcttctttcaatagtgcaaatgccctatggagtcccagtagctactgtggcaataggtggtgccaaaaacgctgcgctactggcaattaggattttaggaataaaatataaggaattagcagataaaattaaaaaattctcagaggatatgaggaacgatgttctcagtactagactggaagcctaa

SEQ ID NO: 52516 - protein, 158 aa, Sulfolobus solfataricus
MPKVAVIMGSKNDWEYMREAVEILKQFGIDYEARVVSAHRTPEFMMQYAKEAEKRGIEVIIAGAGGAAHLPGMVASLTSLPVIGVPIPSKNLNGLDSLLSIVQMPYGVPVATVAIGGAKNAALLAIRILGIKYKELADKIKKFSEDMRNDVLSTRLEA

SEQ ID NO: 52517 - DNA, 531 bp, Synechocystis sp
  CDS (1)..(531): transl_table=11
atgacttccccctctcccctggtcggcatcatcatgggaagcgattccgatctccccaccatggcagcggcgatcgccgtctgtgaagaatttgccgtaccaacggaggtggccattatctctgcccatcgcaccccggaaagaatggtggagtatgcccaaactgcccaccagcggggcttgcggataattattgccggggctgggggagcggcccatttaccgggcatggtggcggccctgacccctttaccagtcatcggtgtgccggtgcagactaaaaccttacagggagtggattccctctattccattgtgcaaatgccggggggaatacctgtagctaccgtggcgatcggtaatgccaaaaatgcggggttattggcggtgcaaatactggctagccataatcccgtgctgttggaaaaagtacagcaatatcgccaaagtctagaaaccatggttttggacaaacaagcggagttggagcgactgggctacagggcctatctggaccagcaaaatcagtga

SEQ ID NO: 52518 - protein, 176 aa, Synechocystis sp
MTSPSPLVGIIMGSDSDLPTMAAAIAVCEEFAVPTEVAIISAHRTPERMVEYAQTAHQRGLRIIIAGAGGAAHLPGMVAALTPLPVIGVPVQTKTLQGVDSLYSIVQMPGGIPVATVAIGNAKNAGLLAVQILASHNPVLLEKVQQYRQSLETMVLDKQAELERLGYRAYLDQQNQ

SEQ ID NO: 52519 - DNA, 516 bp, Thermotoga maritima
  CDS (1)..(516): transl_table=11
gtgccaagggtaggaatcatcatgggaagtgactccgatcttcctgtaatgaagcaggcagctgaaattttggaagaattcggaatagattacgagattacgatcgtttccgctcacaggacaccggatcgcatgttcgagtacgcaaagaacgccgaagaacggggaatagaagtgatcattgcgggagcggggggagcggctcaccttccaggaatggtggcaagcatcacccaccttcctgtgataggtgttcccgtgaaaacatccacactgaacggtctggattctcttttctccatagttcagatgccagggggtgtgcccgttgccaccgttgccataaacaacgcgaagaacgcgggaatccttgctgcgtctattctgggaatcaaatatccggagatcgcaaggaaggtaaaagagtataaagaaagaatgaaacgggaagttctggaaaaagcccaaagattagaacaaattggttacaaagaatatctgaaccagaaagagtaa

SEQ ID NO: 52520 - protein, 171 aa, Thermotoga maritima
MPRVGIIMGSDSDLPVMKQAAEILEEFGIDYEITIVSAHRTPDRMFEYAKNAEERGIEVIIAGAGGAAHLPGMVASITHLPVIGVPVKTSTLNGLDSLFSIVQMPGGVPVATVAINNAKNAGILAASILGIKYPEIARKVKEYKERMKREVLEKAQRLEQIGYKEYLNQKE

SEQ ID NO: 52521 - DNA, 486 bp, Vibrio cholerae
  CDS (1)..(486): transl_table=11
atgacagtcggtattatcatgggttccaagtcagactggccaaccatgaaacacgcagcagagatgcttgaccagtttggtgtggcttacgagactaaagtggtttctgcgcaccgaactcctcatcttttggccgactatgcctctagcgccaaagaacgcggtttacaagtgatcatcgctggagcgggcggcgctgcgcatcttcccggaatgaccgccgcattcactagcttgccagtgttaggcgtgcccgttcaatctcgcgctctgtctgggctcgactcgttatactccattgtgcagatgccaaaaggcattgcggtgggtacgctcgccattggtgaagctggtgccgctaatgcaggattacttgccgcacaaatcatcggcattcataacccagaagtgatgagtaaagtggaagctttccgcgctaagcagactcaatctgtgttggataacccaaatccggctgaggagtaa

SEQ ID NO: 52522 - protein, 161 aa, Vibrio cholerae
MTVGIIMGSKSDWPTMKHAAEMLDQFGVAYETKVVSAHRTPHLLADYASSAKERGLQVIIAGAGGAAHLPGMTAAFTSLPVLGVPVQSRALSGLDSLYSIVQMPKGIAVGTLAIGEAGAANAGLLAAQIIGIHNPEVMSKVEAFRAKQTQSVLDNPNPAEE

SEQ ID NO: 52523 - DNA, 486 bp, Vibrio fischeri
  CDS (1)..(486): transl_table=11
atgaaagtcggtattatcatgggttcaaaatcagactggccaacaatgaaactagccgctgagatgcttgaccgctttaatgtgccttatgagacaaaagtggtttctgctcatagaacacctcagttacttgccgattatgcaactcaagcaaaagatcgtggcatcaaagtaattatcgcaggtgcgggtggtgcagcacaccttcctggaatggcagcagcattcacaagtgttcctgttttaggtgttccagtacaatctcgtgcacttaaaggtatggattcattactttcaattgtacagatgccaaaaggtattgctgttggtactcttgcgataggtgaagcgggagcggctaatgcaggtatccttgcagctcaaatcattggaacatcaaacgaagaagtaatggctgcggttgaagctttccgtaaagaacaaactgaaatggtgttagagaacccagatccatcagaggattaa

SEQ ID NO: 52524 - protein, 161 aa, Vibrio fischeri
MKVGIIMGSKSDWPTMKLAAEMLDRFNVPYETKVVSAHRTPQLLADYATQAKDRGIKVIIAGAGGAAHLPGMAAAFTSVPVLGVPVQSRALKGMDSLLSIVQMPKGIAVGTLAIGEAGAANAGILAAQIIGTSNEEVMAAVEAFRKEQTEMVLENPDPSED

SEQ ID NO: 52525 - DNA, 486 bp, Vibrio parahaemolyticus
  CDS (1)..(486): transl_table=11
atgaaagtcggtatcatcatgggttctaaatccgattggccaaccatgaaactagcagcagacatgctggatcaatttggcgtgtcttacgaaacaaaggtggtgtcagctcaccgtactcctcaactattagccgattacgctagcagcgcgaaagaacgcggcatcaaagtgatcatcgcaggtgccggtggtgcagctcacctaccgggaatggcggcagccttcaccagtttgcctgtacttggtgttccggttcaatctcgcgctctaaaaggcatggactctttgctatctattgtacaaatgccaaaaggcattgcagtcggcacgttagcgattggcgaagcgggcgctgcaaacgcgggcatcttagcggcacaaatcctaggcactcatgacgaaagcatcatggcgaaggtagaagcgttccgcaatgaacagacggaaaccgtactggctaacccaaatccagctgaggattaa

SEQ ID NO: 52526 - protein, 161 aa, Vibrio parahaemolyticus
MKVGIIMGSKSDWPTMKLAADMLDQFGVSYETKVVSAHRTPQLLADYASSAKERGIKVIIAGAGGAAHLPGMAAAFTSLPVLGVPVQSRALKGMDSLLSIVQMPKGIAVGTLAIGEAGAANAGILAAQILGTHDESIMAKVEAFRNEQTETVLANPNPAED

SEQ ID NO: 52527 - DNA, 486 bp, Vibrio vulnificus
  CDS (1)..(486): transl_table=11
atgaaagtcggtatcatcatgggttctaaatcagattggccaaccatgaaactggcagcagaaatgctggacagatttggcgtggaatacgaaaccaaagtggtttcagcacatcgaactcctcatctcctcgctgaatatgcctcaaccgccaaagagcgtgggttgaaagtgattattgccggtgcaggtggcgcggcgcatttgccgggcatggcagcggcatttaccagcttgcccgttttgggcgtacccgtgcaatcacgtgctttatcagggctcgactctctctactctattgtgcaaatgccaaaaggcatcgcagtaggtacattggccattggtgaagccggtgccgcgaacgcgggtcttctcgctgcgcaaatccttggaactcacgacgaaaatatcatggccaaagttgaagccttccgcagtgagcaaactgaaagcgtcctcgctaacccaaatcctgcagaggactaa

SEQ ID NO: 52528 - protein, 161 aa, Vibrio vulnificus
MKVGIIMGSKSDWPTMKLAAEMLDRFGVEYETKVVSAHRTPHLLAEYASTAKERGLKVIIAGAGGAAHLPGMAAAFTSLPVLGVPVQSRALSGLDSLYSIVQMPKGIAVGTLAIGEAGAANAGLLAAQILGTHDENIMAKVEAFRSEQTESVLANPNPAED

SEQ ID NO: 52529 - DNA, 1677 bp, Vigna aconitifolia
  CDS (1)..(1677)
atgggcctatatgaagtggttgttggggttctgggaggtgggcaacttggtcgtatgatgtgtcaagctgcttcccagatggccattaaagtaatggttttggatccgcaagaaaattgccctgctagttctctctcttatcatcatatggtcggaagctttgatgaaagcactaaagtggaggaatttgccaagagatgtggagtattgactgttgaaattgaacacgtcgatgttgatacattggaaaaacttgagaaacagggagttgactgccagcccaaagcctctacagtcagaattattcaggataagtatcagcaaaaagttgcacttctgccagcatggattccacttcctgaatttatgaagatagatgacttgaaggctaagaagtgggactctttggatattcacttcatgattaagagtaggaggctagcttatgatgggcgaggaaattttgttgctaaaagtgaagaggagctttcttctgctgtggatgctctaggaggatttgatcgcggtttatatgctgaaaaatgggcaccttttgtcaaggaactagcggttattgtggcaagaggaagagacaattcaatctcatgttatcctgttgttgaactattcacaggacatatatgtcacatagttaagtctccggctaatgtaaattggaagacgagggagcttgccattgaagttgctttcaatgctgttaagtccctggaagtgcccggtgtgtttgcagttgaattgttcttgactaaggaaggagagattttattaaatgaagtagctcctagacctcacaatagtgggcatcacacaatagaatcttgccatacctcgcaatttgagcaacatttgccggctgttgttggtcttcctcttggtgatccatcaatgaaaactccagctgctatcatgtacaacatattaggtgaagaagagggggagcatggttttcaattagcacatcaattgatgaaaagggcaatgaccatccctggtgcttctgtccattggtatgataagccagaaatgagaaagcaacggaagatgtgccatataactattgttgggtcctctcttagcagtattgaaagcaatcttgcaatactgctggaagggaaaggattacatgataagactgctgtttgctccacgttgttgggattcataatgggttctgattcagatctgcctgttatgaaaagtgctgctgaaatgatggagatgtttggtgtgcctcatgaggtaagaatagtttcagcacacaggactccagaattgatgttttgttatgcctcatctgctcacgaacgaggctatcaagtcattattgctggtgctggtggtgcagctcacttgcctggtatggttgcatccctcactcccttgcctgttgttggcgttcctgtgcgtgcttctaccttggacggactcgattcactcttgtcaattgtccagatgccgagaggtgttccagttgccactgttgcagttaataatgcaactaatgctggattgctggcagtgaggatgttgggtgttgccaacgataatcttctgtcaaggatgagtcaatatcaagaggaccaaaaagaagccgtcttgagggaaggagataaattagaaaaacatggctgggaatcctacttaaaaaatagttag

SEQ ID NO: 52530 - protein, 558 aa, Vigna aconitifolia
MGLYEVVVGVLGGGQLGRMMCQAASQMAIKVMVLDPQENCPASSLSYHHMVGSFDESTKVEEFAKRCGVLTVEIEHVDVDTLEKLEKQGVDCQPKASTVRIIQDKYQQKVALLPAWIPLPEFMKIDDLKAKKWDSLDIHFMIKSRRLAYDGRGNFVAKSEEELSSAVDALGGFDRGLYAEKWAPFVKELAVIVARGRDNSISCYPVVELFTGHICHIVKSPANVNWKTRELAIEVAFNAVKSLEVPGVFAVELFLTKEGEILLNEVAPRPHNSGHHTIESCHTSQFEQHLPAVVGLPLGDPSMKTPAAIMYNILGEEEGEHGFQLAHQLMKRAMTIPGASVHWYDKPEMRKQRKMCHITIVGSSLSSIESNLAILLEGKGLHDKTAVCSTLLGFIMGSDSDLPVMKSAAEMMEMFGVPHEVRIVSAHRTPELMFCYASSAHERGYQVIIAGAGGAAHLPGMVASLTPLPVVGVPVRASTLDGLDSLLSIVQMPRGVPVATVAVNNATNAGLLAVRMLGVANDNLLSRMSQYQEDQKEAVLREGDKLEKHGWESYLKNS

SEQ ID NO: 52531 - DNA, 1716 bp, Saccharomyces cerevisiae
  CDS (1)..(1716)
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaagtaa

SEQ ID NO: 52532 - protein, 571 aa, Saccharomyces cerevisiae
MDSRTVGILGGGQLGRMIVEAANRLNIKTVILDAENSPAKQISNSNDHVNGSFSNPLDIEKLAEKCDVLTIEIEHVDVPTLKNLQVKHPKLKIYPSPETIRLIQDKYIQKEHLIKNGIAVTQSVPVEQASETSLLNVGRDLGFPFVLKSRTLAYDGRGNFVVKNKEMIPEALEVLKDRPLYAEKWAPFTKELAVMIVRSVNGLVFSYPIVETIHKDNICDLCYAPARVPDSVQLKAKLLAENAIKSFPGCGIFGVEMFYLETGELLINEIAPRPHNSGHYTIDACVTSQFEAHLRSILDLPMPKNFTSFSTITTNAIMLNVLGDKHTKDKELETCERALATPGSSVYLYGKESRPNRKVGHINIIASSMAECEQRLNYITGRTDIPIKISVAQKLDLEAMVKPLVGIIMGSDSDLPVMSAACAVLKDFGVPFEVTIVSAHRTPHRMSAYAISASKRGIKTIIAGAGGAAHLPGMVAAMTPLPVIGVPVKGSCLDGVDSLHSIVQMPRGVPVATVAINNSTNAALLAVRLLGAYDSSYTTKMEQFLLKQEEEVLVKAQKLETVGYEAYLENK

SEQ ID NO: 52533 - DNA, 22 bp, Artificial sequence
  (1)..(22): primer
atgtcttcccgcaataatccgg

SEQ ID NO: 52534 - DNA, 22 bp, Artificial sequence
  (1)..(22): primer
ttatgccgcacctcgcgggtcc

SEQ ID NO: 52535 - protein, 171 aa, Artificial sequence
  Variant (2)..(2): xaa in position 2 is any amino acid
  Variant (8)..(8): xaa in position 8 is any amino acid
  Variant (11)..(13): xaa in position 11 to 13 is any amino acid
  Variant (15)..(20): xaa in position 15 to 20 is any amino acid
  Variant (22)..(25): xaa in position 22 to 25 is any amino acid
  Variant (26)..(47): xaa in position 26 to 47 is any or no amino acid
  Variant (49)..(50): xaa in position 49 to 50 is any amino acid
  Variant (52)..(53): xaa in position 52 to 53 is any amino acid
  Variant (62)..(63): xaa in position 62 to 63 is any amino acid
  Variant (65)..(66): xaa in position 65 to 66 is any amino acid
  Variant (69)..(70): xaa in position 69 to 70 is any amino acid
  Variant (72)..(73): xaa in position 72 to 73 is any amino acid
  Variant (74)..(74): xaa in position 74 is any or no amino acid
  Variant (76)..(76): xaa in position 76 is any amino acid
  Variant (77)..(78): xaa in position 77 to 78 is any or no amino acid
  Variant (86)..(86): xaa in position 86 is any or no amino acid
  Variant (92)..(92): xaa in position 92 is any or no amino acid
  Variant (98)..(98): xaa in position 98 is any amino acid
  Variant (100)..(100): xaa in position 100 is any amino acid
  Variant (109)..(111): xaa in position 109 to 111 is any amino acid
  Variant (112)..(112): xaa in position 112 is any or no amino acid
  Variant (114)..(114): xaa in position 114 is any or no amino acid
  Variant (120)..(120): xaa in position 120 is any amino acid
  Variant (127)..(127): xaa in position 127 is any amino acid
  Variant (137)..(137): xaa in position 137 is any amino acid
  Variant (138)..(140): xaa in position 138 to 140 is any or no amino acid
  Variant (142)..(142): xaa in position 142 is any or no amino acid
  Variant (147)..(147): xaa in position 147 is any amino acid
  Variant (149)..(150): xaa in position 149 to 150 is any amino acid
  Variant (153)..(158): xaa in position 153 to 158 is any amino acid
  Variant (159)..(163): xaa in position 159 to 163 is any or no amino acid
  Variant (165)..(167): xaa in position 165 to 167 is any amino acid
  Variant (169)..(170): xaa in position 169 to 170 is any amino acid
VXIIMGSXSDXXXMXXXXXXLXXXXXXXXXXXXXXXXXXXXXXXXXXVXXEXXVVSAHRTPXXMXXYAXXAXXXGXXXIIAGAGGXAAHLPXGMVAAXTXLPVIGVPVXXXXLXGLDSLXSIVQMPXGIPVATVAIXXXXAXNAALXAXXILXXXXXXXXXXXLXXXLXXF

SEQ ID NO: 52536 - protein, 17 aa, Artificial sequence
  Variant (4)..(4): xaa in position 4 is any amino acid
  Variant (7)..(9): xaa in position 7 to 9 is any amino acid
  Variant (10)..(10): xaa in position 10 is Ile, Leu, Met or Val
  Variant (11)..(12): xaa in position 11 to 12 is any amino acid
  Variant (13)..(13): xaa in position 13 is Ala, Cys, Gly, Ser or Thr
  Variant (14)..(16): xaa in position 14 to 16 is any amino acid
MGSXSDXXXXXXXXXXL

SEQ ID NO: 52537 - protein, 6 aa, Artificial sequence
  (1)..(6): protein
SAHRTP

SEQ ID NO: 52538 - protein, 16 aa, Artificial sequence
  Variant (2)..(2): xaa in position 2 is Ile or Val
  Variant (4)..(4): xaa in position 4 is Ala, Cys or Gly
  Variant (7)..(7): xaa in position 7 is any amino acid
  Variant (14)..(14): xaa in position 14 is Ile, Leu, Met or Val
  Variant (15)..(15): xaa in position 15 is any amino acid
  Variant (16)..(16): xaa in position 16 is Ala or Ser
IXAXAGXAAHLPGXXX

SEQ ID NO: 52539 - protein, 6 aa, Artificial sequence
  Variant (3)..(3): xaa in position 3 is Ile or Leu
PVXGVP

SEQ ID NO: 52540 - protein, 34 aa, Artificial sequence
  Variant (2)..(2): xaa in position 2 is any amino acid
  Variant (4)..(4): xaa in position 4 is any amino acid
  Variant (8)..(8): xaa in position 8 is any amino acid
  Variant (11)..(11): xaa in position 11 is Ala, Cys or Val
  Variant (15)..(15): xaa in position 15 is any amino acid
  Variant (17)..(17): xaa in position 17 is any amino acid
  Variant (18)..(18): xaa in position 18 is Ala or Pro
  Variant (19)..(19): xaa in position 19 is Cys, Thr or Val
  Variant (20)..(20): xaa in position 20 is Ala or Gly
  Variant (22)..(22): xaa in position 22 is any amino acid
  Variant (23)..(23): xaa in position 23 is Ala, Gly or Ser
  Variant (24)..(24): xaa in position 24 is Ile or Val
  Variant (25)..(25): xaa in position 25 is Asp, Gly or Asn
  Variant (26)..(26): xaa in position 26 is any amino acid
  Variant (27)..(27): xaa in position 27 is Ala, Asp, Gly, Asn, Pro or Ser
  Variant (28)..(28): xaa in position 28 is any amino acid
  Variant (29)..(29): xaa in position 29 is Ala, Gly, Asn or Ser
  Variant (30)..(32): xaa in position 30 to 32 is any amino acid
  Variant (33)..(33): xaa in position 33 is Ala, Gly or Leu
  Variant (34)..(34): xaa in position 34 is Ala, Ile, Leu or Val
LXGXDSLXSIXQMPXGXXXXTXXXXXXXXXXXXX

SEQ ID NO: 52541 - DNA, 2106 bp, Escherichia coli; identical to SEQ ID NO: 36422
  CDS (1)..(2106)

SEQ ID NO: 52542 - protein, 701 aa, Escherichia coli; identical to SEQ ID NO: 36423

SEQ ID NO: 52543 - DNA, 1779 bp, Pyrococcus abyssi GE5; identical to SEQ ID NO: 36424
  CDS (1)..(1779): transl_table=11

SEQ ID NO: 52544 - protein, 592 aa, Pyrococcus abyssi GE5; identical to SEQ ID NO: 36425

SEQ ID NO: 52545 - DNA, 1815 bp, Aeropyrum pernix K1; identical to SEQ ID NO: 36426
  CDS (1)..(1815): transl_table=11

SEQ ID NO: 52546 - protein, 604 aa, Aeropyrum pernix K1; identical to SEQ ID NO: 36427

SEQ ID NO: 52547 - DNA, 1485 bp, Vibrio cholerae O1 biovar eltor str. N16961; identical to SEQ ID NO: 36428
  CDS (1)..(1485): transl_table=11

SEQ ID NO: 52548 - protein, 494 aa, Vibrio cholerae O1 biovar eltor str. N16961; identical to SEQ ID NO: 36429

SEQ ID NO: 52549 - DNA, 1743 bp, Bacillus halodurans C-125; identical to SEQ ID NO: 36430
  CDS (1)..(1743): transl_table=11

SEQ ID NO: 52550 - protein, 580 aa, Bacillus halodurans C-125; identical to SEQ ID NO: 36431

SEQ ID NO: 52551 - DNA, 1545 bp, Pasteurella multocida subsp. multocida str. Pm70; identical to SEQ ID NO: 36432
  CDS (1)..(1545): transl_table=11

SEQ ID NO: 52552 - protein, 514 aa, Pasteurella multocida subsp. multocida str. Pm70; identical to SEQ ID NO: 36433

SEQ ID NO: 52553 - DNA, 2067 bp, Pseudomonas aeruginosa PAO1; identical to SEQ ID NO: 36434
  CDS (1)..(2067): transl_table=11

SEQ ID NO: 52554 - protein, 688 aa, Pseudomonas aeruginosa PAO1; identical to SEQ ID NO: 36435

SEQ ID NO: 52555 - DNA, 2355 bp, Lactococcus lactis subsp. lactis Il1403; identical to SEQ ID NO: 36436
  CDS (1)..(2355): transl_table=11

SEQ ID NO: 52556 - protein, 784 aa, Lactococcus lactis subsp. lactis Il1403; identical to SEQ ID NO: 36437

SEQ ID NO: 52557 - DNA, 2082 bp, Neisseria meningitidis MC58; identical to SEQ ID NO: 36438
  CDS (1)..(2082): transl_table=11

SEQ ID NO: 52558 - protein, 693 aa, Neisseria meningitidis MC58; identical to SEQ ID NO: 36439

SEQ ID NO: 52559 - DNA, 2112 bp, Campylobacter jejuni subsp. jejuni NCTC 11168; identical to SEQ ID NO: 36440
  CDS (1)..(2112): transl_table=11

SEQ ID NO: 52560 - protein, 703 aa, Campylobacter jejuni subsp. jejuni NCTC 11168; identical to SEQ ID NO: 36441

SEQ ID NO: 52561 - DNA, 2082 bp, Neisseria meningitidis Z2491; identical to SEQ ID NO: 36442
  CDS (1)..(2082): transl_table=11

SEQ ID NO: 52562 - protein, 693 aa, Neisseria meningitidis Z2491; identical to SEQ ID NO: 36443

SEQ ID NO: 52563 - DNA, 2166 bp, Escherichia coli O157:H7; identical to SEQ ID NO: 36444
  CDS (1)..(2166): transl_table=11

SEQ ID NO: 52564 - protein, 721 aa, Escherichia coli O157:H7; identical to SEQ ID NO: 36445

SEQ ID NO: 52565 - DNA, 2277 bp, Mycobacterium tuberculosis CDC1551; identical to SEQ ID NO: 36446
  CDS (1)..(2277): transl_table=11

SEQ ID NO: 52566 - protein, 758 aa, Mycobacterium tuberculosis CDC1551; identical to SEQ ID NO: 36447

SEQ ID NO: 52567 - DNA, 1779 bp, Clostridium acetobutylicum ATCC 824; identical to SEQ ID NO: 36448
  CDS (1)..(1779): transl_table=11

SEQ ID NO: 52568 - protein, 592 aa, Clostridium acetobutylicum ATCC 824; identical to SEQ ID NO: 36449

SEQ ID NO: 52569 - DNA, 2067 bp, Yersinia pestis CO92; identical to SEQ ID NO: 36450
  CDS (1)..(2067): transl_table=11

SEQ ID NO: 52570 - protein, 688 aa, Yersinia pestis CO92; identical to SEQ ID NO: 36451

SEQ ID NO: 52571 - DNA, 2151 bp, Salmonella typhimurium LT2; identical to SEQ ID NO: 36452
  CDS (1)..(2151): transl_table=11

SEQ ID NO: 52572 - protein, 716 aa, Salmonella typhimurium LT2; identical to SEQ ID NO: 36453

SEQ ID NO: 52573 - DNA, 2061 bp, Ralstonia solanacearum GMI1000; identical to SEQ ID NO: 36454
  CDS (1)..(2061): transl_table=11

SEQ ID NO: 52574 - protein, 686 aa, Ralstonia solanacearum GMI1000; identical to SEQ ID NO: 36455

SEQ ID NO: 52575 - DNA, 1857 bp, Pyrobaculum aerophilum str. IM2; identical to SEQ ID NO: 36456
  CDS (1)..(1857): transl_table=11

SEQ ID NO: 52576 - protein, 618 aa, Pyrobaculum aerophilum str. IM2; identical to SEQ ID NO: 36457

SEQ ID NO: 52577 - DNA, 1452 bp, Clostridium perfringens str. 13; identical to SEQ ID NO: 36458
  CDS (1)..(1452): transl_table=11

SEQ ID NO: 52578 - protein, 483 aa, Clostridium perfringens str. 13; identical to SEQ ID NO: 36459

SEQ ID NO: 52579 - DNA, 2280 bp, Corynebacterium glutamicum ATCC 13032; identical to SEQ ID NO: 36460
  CDS (1)..(2280): transl_table=11

SEQ ID NO: 52580 - protein, 759 aa, Corynebacterium glutamicum ATCC 13032; identical to SEQ ID NO: 36461

SEQ ID NO: 52581 - DNA, 1425 bp, Fusobacterium nucleatum subsp. nucleatum ATCC 25586; identical to SEQ ID NO: 36462
  CDS (1)..(1425): transl_table=11

SEQ ID NO: 52582 - protein, 474 aa, Fusobacterium nucleatum subsp. nucleatum ATCC 25586; identical to SEQ ID NO: 36463

SEQ ID NO: 52583 - DNA, 1440 bp, Methanosarcina acetivorans C2A; identical to SEQ ID NO: 36464
  CDS (1)..(1440): transl_table=11

SEQ ID NO: 52584 - protein, 479 aa, Methanosarcina acetivorans C2A; identical to SEQ ID NO: 36465

SEQ ID NO: 52585 - DNA, 1797 bp, Thermoanaerobacter tengcongensis MB4; identical to SEQ ID NO: 36466
  CDS (1)..(1797): transl_table=11

SEQ ID NO: 52586 - protein, 598 aa, Thermoanaerobacter tengcongensis MB4; identical to SEQ ID NO: 36467

SEQ ID NO: 52587 - DNA, 2073 bp, Xanthomonas axonopodis pv. citri str. 306; identical to SEQ ID NO: 36468
  CDS (1)..(2073): transl_table=11

SEQ ID NO: 52588 - protein, 690 aa, Xanthomonas axonopodis pv. citri str. 306; identical to SEQ ID NO: 36469

SEQ ID NO: 52589 - DNA, 1485 bp, Streptococcus agalactiae 2603V/R; identical to SEQ ID NO: 36470
  CDS (1)..(1485): transl_table=11

SEQ ID NO: 52590 - protein, 494 aa, Streptococcus agalactiae 2603V/R; identical to SEQ ID NO: 36471

SEQ ID NO: 52591 - DNA, 1734 bp, Oceanobacillus iheyensis HTE831; identical to SEQ ID NO: 36472
  CDS (1)..(1734): transl_table=11

SEQ ID NO: 52592 - protein, 577 aa, Oceanobacillus iheyensis HTE831; identical to SEQ ID NO: 36473

SEQ ID NO: 52593 - DNA, 1425 bp, Oceanobacillus iheyensis HTE831; identical to SEQ ID NO: 36474
  CDS (1)..(1425): transl_table=11

SEQ ID NO: 52594 - protein, 474 aa, Oceanobacillus iheyensis HTE831; identical to SEQ ID NO: 36475

SEQ ID NO: 52595 - DNA, 2400 bp, Bifidobacterium longum NCC2705; identical to SEQ ID NO: 36476
  CDS (1)..(2400): transl_table=11

SEQ ID NO: 52596 - protein, 799 aa, Bifidobacterium longum NCC2705; identical to SEQ ID NO: 36477

SEQ ID NO: 52597 - DNA, 2106 bp, Leptospira interrogans serovar Lai str. 56601; identical to SEQ ID NO: 36478
  CDS (1)..(2106): transl_table=11

SEQ ID NO: 52598 - protein, 701 aa, Leptospira interrogans serovar Lai str. 56601; identical to SEQ ID NO: 36479

SEQ ID NO: 52599 - DNA, 2067 bp, Pseudomonas putida KT2440; identical to SEQ ID NO: 36480
  CDS (1)..(2067): transl_table=11

SEQ ID NO: 52600 - protein, 688 aa, Pseudomonas putida KT2440; identical to SEQ ID NO: 36481

SEQ ID NO: 52601 - DNA, 2166 bp, Escherichia coli CFT073; identical to SEQ ID NO: 36482
  CDS (1)..(2166): transl_table=11

SEQ ID NO: 52602 - protein, 721 aa, Escherichia coli CFT073; identical to SEQ ID NO: 36483

SEQ ID NO: 52603 - DNA, 1485 bp, Vibrio vulnificus CMCP6; identical to SEQ ID NO: 36484
  CDS (1)..(1485): transl_table=11

SEQ ID NO: 52604 - protein, 494 aa, Vibrio vulnificus CMCP6; identical to SEQ ID NO: 36485

SEQ ID NO: 52605 - DNA, 1467 bp, Clostridium tetani E88; identical to SEQ ID NO: 36486
  CDS (1)..(1467): transl_table=11

SEQ ID NO: 52606 - protein, 488 aa, Clostridium tetani E88; identical to SEQ ID NO: 36487

SEQ ID NO: 52607 - DNA, 1179 bp, Shewanella oneidensis MR-1; identical to SEQ ID NO: 36488
  CDS (1)..(1179): transl_table=11

SEQ ID NO: 52608 - protein, 392 aa, Shewanella oneidensis MR-1; identical to SEQ ID NO: 36489

SEQ ID NO: 52609 - DNA, 2076 bp, Pseudomonas syringae pv. tomato str. DC3000; identical to SEQ ID NO: 36490
  CDS (1)..(2076): transl_table=11

SEQ ID NO: 52610 - protein, 691 aa, Pseudomonas syringae pv. tomato str. DC3000; identical to SEQ ID NO: 36491

SEQ ID NO: 52611 - DNA, 1485 bp, Vibrio parahaemolyticus RIMD 2210633; identical to SEQ ID NO: 36492
  CDS (1)..(1485): transl_table=11

SEQ ID NO: 52612 - protein, 494 aa, Vibrio parahaemolyticus RIMD 2210633; identical to SEQ ID NO: 36493

SEQ ID NO: 52613 - DNA, 1431 bp, Bacteroides thetaiotaomicron VPI-5482; identical to SEQ ID NO: 36494
  CDS (1)..(1431): transl_table=11

SEQ ID NO: 52614 - protein, 476 aa, Bacteroides thetaiotaomicron VPI-5482; identical to SEQ ID NO: 36495

SEQ ID NO: 52615 - DNA, 2067 bp, Bacillus cereus ATCC 14579; identical to SEQ ID NO: 36496
  CDS (1)..(2067): transl_table=11

SEQ ID NO: 52616 - protein, 688 aa, Bacillus cereus ATCC 14579; identical to SEQ ID NO: 36497

SEQ ID NO: 52617 - DNA, 2073 bp, Nitrosomonas europaea ATCC 19718; identical to SEQ ID NO: 36498
  CDS (1)..(2073): transl_table=11

SEQ ID NO: 52618 - protein, 690 aa, Nitrosomonas europaea ATCC 19718; identical to SEQ ID NO: 36499

SEQ ID NO: 52619 - DNA, 2277 bp, Mycobacterium bovis AF2122/97; identical to SEQ ID NO: 36500
  CDS (1)..(2277): transl_table=11

SEQ ID NO: 52620 - protein, 758 aa, Mycobacterium bovis AF2122/97; identical to SEQ ID NO: 36501

SEQ ID NO: 52621 - DNA, 2172 bp, Helicobacter hepaticus ATCC 51449; identical to SEQ ID NO: 36502
  CDS (1)..(2172): transl_table=11

SEQ ID NO: 52622 - protein, 723 aa, Helicobacter hepaticus ATCC 51449; identical to SEQ ID NO: 36503

SEQ ID NO: 52623 - DNA, 1905 bp, Rhodopirellula baltica SH 1; identical to SEQ ID NO: 36504
  CDS (1)..(1905): transl_table=11

SEQ ID NO: 52624 - protein, 634 aa, Rhodopirellula baltica SH 1; identical to SEQ ID NO: 36505

SEQ ID NO: 52625 - DNA, 1587 bp, Haemophilus ducreyi 35000HP; identical to SEQ ID NO: 36506
  CDS (1)..(1587): transl_table=11

SEQ ID NO: 52626 - protein, 528 aa, Haemophilus ducreyi 35000HP; identical to SEQ ID NO: 36507

SEQ ID NO: 52627 - DNA, 2067 bp, Chromobacterium violaceum ATCC 12472; identical to SEQ ID NO: 36508
  CDS (1)..(2067): transl_table=11

SEQ ID NO: 52628 - protein, 688 aa, Chromobacterium violaceum ATCC 12472; identical to SEQ ID NO: 36509

SEQ ID NO: 52629 - DNA, 1809 bp, Chromobacterium violaceum ATCC 12472; identical to SEQ ID NO: 36510
  CDS (1)..(1809): transl_table=11

SEQ ID NO: 52630 - protein, 602 aa, Chromobacterium violaceum ATCC 12472; identical to SEQ ID NO: 36511

SEQ ID NO: 52631 - DNA, 1704 bp, Wolinella succinogenes DSM 1740; identical to SEQ ID NO: 36512
  CDS (1)..(1704): transl_table=11

SEQ ID NO: 52632 - protein, 567 aa, Wolinella succinogenes DSM 1740; identical to SEQ ID NO: 36513

SEQ ID NO: 52633 - DNA, 1455 bp, Photorhabdus luminescens subsp. laumondii TTO1; identical to SEQ ID NO: 36514
  CDS (1)..(1455): transl_table=11

SEQ ID NO: 52634 - protein, 484 aa, Photorhabdus luminescens subsp. laumondii TTO1; identical to SEQ ID NO: 36515

SEQ ID NO: 52635 - DNA, 1803 bp, Photorhabdus luminescens subsp. laumondii TTO1; identical to SEQ ID NO: 36516
  CDS (1)..(1803): transl_table=11

SEQ ID NO: 52636 - protein, 600 aa, Photorhabdus luminescens subsp. laumondii TTO1; identical to SEQ ID NO: 36517

SEQ ID NO: 52637 - DNA, 1485 bp, Vibrio vulnificus YJ016; identical to SEQ ID NO: 36518
  CDS (1)..(1485): transl_table=11

SEQ ID NO: 52638 - protein, 494 aa, Vibrio vulnificus YJ016; identical to SEQ ID NO: 36519

SEQ ID NO: 52639 - DNA, 2286 bp, Corynebacterium diphtheriae NCTC 13129; identical to SEQ ID NO: 36520
  CDS (1)..(2286): transl_table=11

SEQ ID NO: 52640 - protein, 761 aa, Corynebacterium diphtheriae NCTC 13129; identical to SEQ ID NO: 36521

SEQ ID NO: 52641 - DNA, 1929 bp, Geobacter sulfurreducens PCA; identical to SEQ ID NO: 36522
  CDS (1)..(1929): transl_table=11

SEQ ID NO: 52642 - protein, 642 aa, Geobacter sulfurreducens PCA; identical to SEQ ID NO: 36523

SEQ ID NO: 52643 - DNA, 2244 bp, Mycobacterium avium subsp. paratuberculosis K-10; identical to SEQ ID NO: 36524
  CDS (1)..(2244): transl_table=11

SEQ ID NO: 52644 - protein, 747 aa, Mycobacterium avium subsp. paratuberculosis K-10; identical to SEQ ID NO: 36525

SEQ ID NO: 52645 - DNA, 1455 bp, Treponema denticola ATCC 35405; identical to SEQ ID NO: 36526
  CDS (1)..(1455): transl_table=11

SEQ ID NO: 52646 - protein, 484 aa, Treponema denticola ATCC 35405; identical to SEQ ID NO: 36527

SEQ ID NO: 52647 - DNA, 2106 bp, Leptospira interrogans serovar Copenhageni str. Fiocruz L1-130; identical to SEQ ID NO: 36528
  CDS (1)..(2106): transl_table=11

SEQ ID NO: 52648 - protein, 701 aa, Leptospira interrogans serovar Copenhageni str. Fiocruz L1-130; identical to SEQ ID NO: 36529

SEQ ID NO: 52649 - DNA, 1422 bp, Desulfovibrio vulgaris subsp. vulgaris str. Hildenborough; identical to SEQ ID NO: 36530
  CDS (1)..(1422): transl_table=11

SEQ ID NO: 52650 - protein, 473 aa, Desulfovibrio vulgaris subsp. vulgaris str. Hildenborough; identical to SEQ ID NO: 36531

SEQ ID NO: 52651 - DNA, 1422 bp, Desulfovibrio vulgaris subsp. vulgaris str. Hildenborough; identical to SEQ ID NO: 36532
  CDS (1)..(1422): transl_table=11

SEQ ID NO: 52652 - protein, 473 aa, Desulfovibrio vulgaris subsp. vulgaris str. Hildenborough; identical to SEQ ID NO: 36533

SEQ ID NO: 52653 - DNA, 1443 bp, Bacillus anthracis str. Sterne; identical to SEQ ID NO: 36534
  CDS (1)..(1443): transl_table=11

SEQ ID NO: 52654 - protein, 480 aa, Bacillus anthracis str. Sterne; identical to SEQ ID NO: 36535

SEQ ID NO: 52655 - DNA, 1443 bp, Bacillus thuringiensis serovar konkukian str. 97-27; identical to SEQ ID NO: 36536
  CDS (1)..(1443): transl_table=11

SEQ ID NO: 52656 - protein, 480 aa, Bacillus thuringiensis serovar konkukian str. 97-27; identical to SEQ ID NO: 36537

SEQ ID NO: 52657 - DNA, 2106 bp, Acinetobacter sp. ADP1; identical to SEQ ID NO: 36538
  CDS (1)..(2106): transl_table=11

SEQ ID NO: 52658 - protein, 701 aa, Acinetobacter sp. ADP1; identical to SEQ ID NO: 36539

SEQ ID NO: 52659 - DNA, 2154 bp, Erwinia carotovora subsp. atroseptica SCRI1043; identical to SEQ ID NO: 36540
  CDS (1)..(2154): transl_table=11

SEQ ID NO: 52660 - protein, 717 aa, Erwinia carotovora subsp. atroseptica SCRI1043; identical to SEQ ID NO: 36541

SEQ ID NO: 52661 - DNA, 2064 bp, Erwinia carotovora subsp. atroseptica SCRI1043; identical to SEQ ID NO: 36542
  CDS (1)..(2064): transl_table=11

SEQ ID NO: 52662 - protein, 687 aa, Erwinia carotovora subsp. atroseptica SCRI1043; identical to SEQ ID NO: 36543

SEQ ID NO: 52663 - DNA, 2286 bp, Propionibacterium acnes KPA171202; identical to SEQ ID NO: 36544
  CDS (1)..(2286): transl_table=11

SEQ ID NO: 52664 - protein, 761 aa, Propionibacterium acnes KPA171202; identical to SEQ ID NO: 36545

SEQ ID NO: 52665 - DNA, 1431 bp, Desulfotalea psychrophila LSv54; identical to SEQ ID NO: 36546
  CDS (1)..(1431): transl_table=11

SEQ ID NO: 52666 - protein, 476 aa, Desulfotalea psychrophila LSv54; identical to SEQ ID NO: 36547

SEQ ID NO: 52667 - DNA, 1818 bp, Yersinia pseudotuberculosis IP 32953; identical to SEQ ID NO: 36548
  CDS (1)..(1818): transl_table=11

SEQ ID NO: 52668 - protein, 605 aa, Yersinia pseudotuberculosis IP 32953; identical to SEQ ID NO: 36549

SEQ ID NO: 52669 - DNA, 2067 bp, Yersinia pseudotuberculosis IP 32953; identical to SEQ ID NO: 36550
  CDS (1)..(2067): transl_table=11

SEQ ID NO: 52670 - protein, 688 aa, Yersinia pseudotuberculosis IP 32953; identical to SEQ ID NO: 36551

SEQ ID NO: 52671 - DNA, 1776 bp, Symbiobacterium thermophilum IAM 14863; identical to SEQ ID NO: 36552
  CDS (1)..(1776): transl_table=11

SEQ ID NO: 52672 - protein, 591 aa, Symbiobacterium thermophilum IAM 14863; identical to SEQ ID NO: 36553

SEQ ID NO: 52673 - DNA, 1797 bp, Bacillus licheniformis ATCC 14580; identical to SEQ ID NO: 36554
  CDS (1)..(1797): transl_table=11

SEQ ID NO: 52674 - protein, 598 aa, Bacillus licheniformis ATCC 14580; identical to SEQ ID NO: 36555

SEQ ID NO: 52675 - DNA, 1503 bp, Mannheimia succiniciproducens MBEL55E; identical to SEQ ID NO: 36556
  CDS (1)..(1503): transl_table=11

SEQ ID NO: 52676 - protein, 500 aa, Mannheimia succiniciproducens MBEL55E; identical to SEQ ID NO: 36557

SEQ ID NO: 52677 - DNA, 1428 bp, Bacteroides fragilis YCH46; identical to SEQ ID NO: 36558
  CDS (1)..(1428): transl_table=11

SEQ ID NO: 52678 - protein, 475 aa, Bacteroides fragilis YCH46; identical to SEQ ID NO: 36559

SEQ ID NO: 52679 - DNA, 2079 bp, Burkholderia pseudomallei K96243; identical to SEQ ID NO: 36560
  CDS (1)..(2079): transl_table=11

SEQ ID NO: 52680 - protein, 692 aa, Burkholderia pseudomallei K96243; identical to SEQ ID NO: 36561

SEQ ID NO: 52681 - DNA, 2076 bp, Methylococcus capsulatus str. Bath; identical to SEQ ID NO: 36562
  CDS (1)..(2076): transl_table=11

SEQ ID NO: 52682 - protein, 691 aa, Methylococcus capsulatus str. Bath; identical to SEQ ID NO: 36563

SEQ ID NO: 52683 - DNA, 2277 bp, Nocardia farcinica IFM 10152; identical to SEQ ID NO: 36564
  CDS (1)..(2277): transl_table=11

SEQ ID NO: 52684 - protein, 758 aa, Nocardia farcinica IFM 10152; identical to SEQ ID NO: 36565

SEQ ID NO: 52685 - DNA, 1527 bp, Photobacterium profundum SS9; identical to SEQ ID NO: 36566
  CDS (1)..(1527): transl_table=11

SEQ ID NO: 52686 - protein, 508 aa, Photobacterium profundum SS9; identical to SEQ ID NO: 36567

SEQ ID NO: 52687 - DNA, 1896 bp, Haloarcula marismortui ATCC 43049; identical to SEQ ID NO: 36568
  CDS (1)..(1896): transl_table=11

SEQ ID NO: 52688 - protein, 631 aa, Haloarcula marismortui ATCC 43049; identical to SEQ ID NO: 36569

SEQ ID NO: 52689 - DNA, 2076 bp, Geobacillus kaustophilus HTA426; identical to SEQ ID NO: 36570
  CDS (1)..(2076): transl_table=11

SEQ ID NO: 52690 - protein, 691 aa, Geobacillus kaustophilus HTA426; identical to SEQ ID NO: 36571

SEQ ID NO: 52691 - DNA, 2151 bp, Salmonella enterica subsp. enterica serovar Paratyphi A str. ATCC; identical to SEQ ID NO: 36572
  CDS (1)..(2151): transl_table=11

SEQ ID NO: 52692 - protein, 716 aa, Salmonella enterica subsp. enterica serovar Paratyphi A str. ATCC; identical to SEQ ID NO: 36573

SEQ ID NO: 52693 - DNA, 1680 bp, Idiomarina loihiensis L2TR; identical to SEQ ID NO: 36574
  CDS (1)..(1680): transl_table=11

SEQ ID NO: 52694 - protein, 559 aa, Idiomarina loihiensis L2TR; identical to SEQ ID NO: 36575

SEQ ID NO: 52695 - DNA, 1626 bp, Bacillus clausii KSM-K16; identical to SEQ ID NO: 36576
  CDS (1)..(1626): transl_table=11

SEQ ID NO: 52696 - protein, 541 aa, Bacillus clausii KSM-K16; identical to SEQ ID NO: 36577

SEQ ID NO: 52697 - DNA, 1458 bp, Bacillus clausii KSM-K16; identical to SEQ ID NO: 36578
  CDS (1)..(1458): transl_table=11

SEQ ID NO: 52698 - protein, 485 aa, Bacillus clausii KSM-K16; identical to SEQ ID NO: 36579

SEQ ID NO: 52699 - DNA, 2112 bp, Campylobacter jejuni RM1221; identical to SEQ ID NO: 36580
  CDS (1)..(2112): transl_table=11

SEQ ID NO: 52700 - protein, 703 aa, Campylobacter jejuni RM1221; identical to SEQ ID NO: 36581

SEQ ID NO: 52701 - DNA, 1740 bp, Thermococcus kodakarensis KOD1; identical to SEQ ID NO: 36582
  CDS (1)..(1740): transl_table=11

SEQ ID NO: 52702 - protein, 579 aa, Thermococcus kodakarensis KOD1; identical to SEQ ID NO: 36583

SEQ ID NO: 52703 - DNA, 1467 bp, Vibrio fischeri ES114; identical to SEQ ID NO: 36584
  CDS (1)..(1467): transl_table=11

SEQ ID NO: 52704 - protein, 488 aa, Vibrio fischeri ES114; identical to SEQ ID NO: 36585

SEQ ID NO: 52705 - DNA, 2082 bp, Neisseria gonorrhoeae FA 1090; identical to SEQ ID NO: 36586
  CDS (1)..(2082): transl_table=11

SEQ ID NO: 52706 - protein, 693 aa, Neisseria gonorrhoeae FA 1090; identical to SEQ ID NO: 36587

SEQ ID NO: 52707 - DNA, 2151 bp, Salmonella enterica subsp. enterica serovar Choleraesuis str; identical to SEQ ID NO: 36588
  CDS (1)..(2151): transl_table=11

SEQ ID NO: 52708 - protein, 716 aa, Salmonella enterica subsp. enterica serovar Choleraesuis str; identical to SEQ ID NO: 36589

SEQ ID NO: 52709 - DNA, 2076 bp, Pseudomonas syringae pv. syringae B728a; identical to SEQ ID NO: 36590
  CDS (1)..(2076): transl_table=11

SEQ ID NO: 52710 - protein, 691 aa, Pseudomonas syringae pv. syringae B728a; identical to SEQ ID NO: 36591

SEQ ID NO: 52711 - DNA, 2073 bp, Xanthomonas campestris pv. campestris str. 8004; identical to SEQ ID NO: 36592
  CDS (1)..(2073): transl_table=11

SEQ ID NO: 52712 - protein, 690 aa, Xanthomonas campestris pv. campestris str. 8004; identical to SEQ ID NO: 36593

SEQ ID NO: 52713 - DNA, 1602 bp, Haemophilus influenzae 86-028NP; identical to SEQ ID NO: 36594
  CDS (1)..(1602): transl_table=11

SEQ ID NO: 52714 - protein, 533 aa, Haemophilus influenzae 86-028NP; identical to SEQ ID NO: 36595

SEQ ID NO: 52715 - DNA, 2067 bp, Pseudomonas fluorescens Pf-5; identical to SEQ ID NO: 36596
  CDS (1)..(2067): transl_table=11

SEQ ID NO: 52716 - protein, 688 aa, Pseudomonas fluorescens Pf-5; identical to SEQ ID NO: 36597

SEQ ID NO: 52717 - DNA, 1680 bp, Psychrobacter arcticum 273-4; identical to SEQ ID NO: 36598
  CDS (1)..(1680): transl_table=11

SEQ ID NO: 52718 - protein, 559 aa, Psychrobacter arcticum 273-4; identical to SEQ ID NO: 36599

SEQ ID NO: 52719 - DNA, 2076 bp, Pseudomonas syringae pv. phaseolicola 1448A; identical to SEQ ID NO: 36600
  CDS (1)..(2076): transl_table=11

SEQ ID NO: 52720 - protein, 691 aa, Pseudomonas syringae pv. phaseolicola 1448A; identical to SEQ ID NO: 36601

SEQ ID NO: 52721 - DNA, 1815 bp, Dechloromonas aromatica RCB; identical to SEQ ID NO: 36602
  CDS (1)..(1815): transl_table=11

SEQ ID NO: 52722 - protein, 604 aa, Dechloromonas aromatica RCB; identical to SEQ ID NO: 36603

SEQ ID NO: 52723 - DNA, 1800 bp, Thermobifida fusca YX; identical to SEQ ID NO: 36604
  CDS (1)..(1800): transl_table=11

SEQ ID NO: 52724 - protein, 599 aa, Thermobifida fusca YX; identical to SEQ ID NO: 36605

SEQ ID NO: 52725 - DNA, 2073 bp, Ralstonia eutropha JMP134; identical to SEQ ID NO: 36606
  CDS (1)..(2073): transl_table=11

SEQ ID NO: 52726 - protein, 690 aa, Ralstonia eutropha JMP134; identical to SEQ ID NO: 36607

SEQ ID NO: 52727 - DNA, 1458 bp, Staphylococcus saprophyticus subsp. saprophyticus ATCC 15305; identical to SEQ ID NO: 36608
  CDS (1)..(1458): transl_table=11

SEQ ID NO: 52728 - protein, 485 aa, Staphylococcus saprophyticus subsp. saprophyticus ATCC 15305; identical to SEQ ID NO: 36609

SEQ ID NO: 52729 - DNA, 2166 bp, Shigella sonnei Ss046; identical to SEQ ID NO: 36610
  CDS (1)..(2166): transl_table=11

SEQ ID NO: 52730 - protein, 721 aa, Shigella sonnei Ss046; identical to SEQ ID NO: 36611

SEQ ID NO: 52731 - DNA, 2400 bp, Bifidobacterium longum DJO10A; identical to SEQ ID NO: 36612
  CDS (1)..(2400)

SEQ ID NO: 52732 - protein, 799 aa, Bifidobacterium longum DJO10A; identical to SEQ ID NO: 36613

SEQ ID NO: 52733 - DNA, 2055 bp, Pseudomonas syringae pv. syringae B728a; identical to SEQ ID NO: 36614
  CDS (1)..(2055)

SEQ ID NO: 52734 - protein, 684 aa, Pseudomonas syringae pv. syringae B728a; identical to SEQ ID NO: 36615

SEQ ID NO: 52735 - DNA, 1470 bp, Desulfovibrio desulfuricans G20; identical to SEQ ID NO: 36616
  CDS (1)..(1470)

SEQ ID NO: 52736 - protein, 489 aa, Desulfovibrio desulfuricans G20; identical to SEQ ID NO: 36617

SEQ ID NO: 52737 - DNA, 1584 bp, Haemophilus somnus 2336; identical to SEQ ID NO: 36618
  CDS (1)..(1584)

SEQ ID NO: 52738 - protein, 527 aa, Haemophilus somnus 2336; identical to SEQ ID NO: 36619

SEQ ID NO: 52739 - DNA, 1587 bp, Actinobacillus pleuropneumoniae serovar 1 str. 4074; identical to SEQ ID NO: 36620
  CDS (1)..(1587)

SEQ ID NO: 52740 - protein, 528 aa, Actinobacillus pleuropneumoniae serovar 1 str. 4074; identical to SEQ ID NO: 36621

SEQ ID NO: 52741 - DNA, 2067 bp, Pseudomonas aeruginosa UCBPP-PA14; identical to SEQ ID NO: 36622
  CDS (1)..(2067)

SEQ ID NO: 52742 - protein, 688 aa, Pseudomonas aeruginosa UCBPP-PA14; identical to SEQ ID NO: 36623

SEQ ID NO: 52743 - DNA, 1425 bp, Fusobacterium nucleatum subsp. vincentii ATCC 49256; identical to SEQ ID NO: 36624
  CDS (1)..(1425): transl_table=11

SEQ ID NO: 52744 - protein, 474 aa, Fusobacterium nucleatum subsp. vincentii ATCC 49256; identical to SEQ ID NO: 36625

SEQ ID NO: 52745 - DNA, 1587 bp, Haemophilus influenzae R2846; identical to SEQ ID NO: 36626
  CDS (1)..(1587)

SEQ ID NO: 52746 - protein, 528 aa, Haemophilus influenzae R2846; identical to SEQ ID NO: 36627

SEQ ID NO: 52747 - DNA, 1587 bp, Haemophilus influenzae R2866; identical to SEQ ID NO: 36628
  CDS (1)..(1587)

SEQ ID NO: 52748 - protein, 528 aa, Haemophilus influenzae R2866; identical to SEQ ID NO: 36629

SEQ ID NO: 52749 - DNA, 2079 bp, Burkholderia cepacia R18194; identical to SEQ ID NO: 36630
  CDS (1)..(2079)

SEQ ID NO: 52750 - protein, 692 aa, Burkholderia cepacia R18194; identical to SEQ ID NO: 36631

SEQ ID NO: 52751 - DNA, 2091 bp, Bacillus cereus G9241; identical to SEQ ID NO: 36632
  CDS (1)..(2091): transl_table=11

SEQ ID NO: 52752 - protein, 696 aa, Bacillus cereus G9241; identical to SEQ ID NO: 36633

SEQ ID NO: 52753 - DNA, 2067 bp, Rubrivivax gelatinosus PM1; identical to SEQ ID NO: 36634
  CDS (1)..(2067)

SEQ ID NO: 52754 - protein, 688 aa, Rubrivivax gelatinosus PM1; identical to SEQ ID NO: 36635

SEQ ID NO: 52755 - DNA, 1989 bp, Pseudomonas fluorescens PfO-1; identical to SEQ ID NO: 36636
  CDS (1)..(1989)

SEQ ID NO: 52756 - protein, 662 aa, Pseudomonas fluorescens PfO-1; identical to SEQ ID NO: 36637

SEQ ID NO: 52757 - DNA, 2046 bp, Rhodospirillum rubrum; identical to SEQ ID NO: 36638
  CDS (1)..(2046)

SEQ ID NO: 52758 - protein, 681 aa, Rhodospirillum rubrum; identical to SEQ ID NO: 36639

SEQ ID NO: 52759 - DNA, 1812 bp, Rhodospirillum rubrum; identical to SEQ ID NO: 36640
  CDS (1)..(1812)

SEQ ID NO: 52760 - protein, 603 aa, Rhodospirillum rubrum; identical to SEQ ID NO: 36641

SEQ ID NO: 52761 - DNA, 2106 bp, Campylobacter lari RM2100; identical to SEQ ID NO: 36642
  CDS (1)..(2106): transl_table=11

SEQ ID NO: 52762 - protein, 701 aa, Campylobacter lari RM2100; identical to SEQ ID NO: 36643

SEQ ID NO: 52763 - DNA, 2112 bp, Campylobacter upsaliensis RM3195; identical to SEQ ID NO: 36644
  CDS (1)..(2112): transl_table=11

SEQ ID NO: 52764 - protein, 703 aa, Campylobacter upsaliensis RM3195; identical to SEQ ID NO: 36645

SEQ ID NO: 52765 - DNA, 2112 bp, Campylobacter coli RM2228; identical to SEQ ID NO: 36646
  CDS (1)..(2112): transl_table=11

SEQ ID NO: 52766 - protein, 703 aa, Campylobacter coli RM2228; identical to SEQ ID NO: 36647

SEQ ID NO: 52767 - DNA, 1728 bp, Brevibacterium linens BL2; identical to SEQ ID NO: 36648
  CDS (1)..(1728)

SEQ ID NO: 52768 - protein, 575 aa, Brevibacterium linens BL2; identical to SEQ ID NO: 36649

SEQ ID NO: 52769 - DNA, 2355 bp, Lactococcus lactis subsp. cremoris SK11; identical to SEQ ID NO: 36650
  CDS (1)..(2355): n means a or g or c or t/u, s means g or c

SEQ ID NO: 52770 - protein, 784 aa, Lactococcus lactis subsp. cremoris SK11; identical to SEQ ID NO: 36651
  Xaa in position 668 is unknown

SEQ ID NO: 52771 - DNA, 2355 bp, Lactococcus lactis subsp. cremoris SK11; identical to SEQ ID NO: 36652
  CDS (1)..(2355)

SEQ ID NO: 52772 - protein, 784 aa, Lactococcus lactis subsp. cremoris SK11; identical to SEQ ID NO: 36653

SEQ ID NO: 52773 - DNA, 2301 bp, Arthrobacter sp. FB24; identical to SEQ ID NO: 36654
  CDS (1)..(2301): transl_table=11

SEQ ID NO: 52774 - protein, 766 aa, Arthrobacter sp. FB24; identical to SEQ ID NO: 36655

SEQ ID NO: 52775 - DNA, 2058 bp, Azotobacter vinelandii AvOP; identical to SEQ ID NO: 36656
  CDS (1)..(2058): transl_table=11

SEQ ID NO: 52776 - protein, 685 aa, Azotobacter vinelandii AvOP; identical to SEQ ID NO: 36657

SEQ ID NO: 52777 - DNA, 2079 bp, Burkholderia vietnamiensis G4; identical to SEQ ID NO: 36658
  CDS (1)..(2079): transl_table=11

SEQ ID NO: 52778 - protein, 692 aa, Burkholderia vietnamiensis G4; identical to SEQ ID NO: 36659

SEQ ID NO: 52779 - DNA, 2079 bp, Burkholderia cenocepacia AU 1054; identical to SEQ ID NO: 36660
  CDS (1)..(2079): transl_table=11

SEQ ID NO: 52780 - protein, 692 aa, Burkholderia cenocepacia AU 1054; identical to SEQ ID NO: 36661

SEQ ID NO: 52781 - DNA, 2058 bp, Burkholderia pseudomallei 1655; identical to SEQ ID NO: 36662
  CDS (1)..(2058)

SEQ ID NO: 52782 - protein, 685 aa, Burkholderia pseudomallei 1655; identical to SEQ ID NO: 36663

SEQ ID NO: 52783 - DNA, 1758 bp, Chromohalobacter salexigens DSM 3043; identical to SEQ ID NO: 36664
  CDS (1)..(1758): transl_table=11

SEQ ID NO: 52784 - protein, 585 aa, Chromohalobacter salexigens DSM 3043; identical to SEQ ID NO: 36665

SEQ ID NO: 52785 - DNA, 2058 bp, Burkholderia pseudomallei 1710a; identical to SEQ ID NO: 36666
  CDS (1)..(2058)

SEQ ID NO: 52786 - protein, 685 aa, Burkholderia pseudomallei 1710a; identical to SEQ ID NO: 36667

SEQ ID NO: 52787 - DNA, 2049 bp, Solibacter usitatus Ellin6076; identical to SEQ ID NO: 36668
  CDS (1)..(2049): transl_table=11

SEQ ID NO: 52788 - protein, 682 aa, Solibacter usitatus Ellin6076; identical to SEQ ID NO: 36669

SEQ ID NO: 52789 - DNA, 1929 bp, Geobacter metallireducens GS-15; identical to SEQ ID NO: 36670
  CDS (1)..(1929): transl_table=11

SEQ ID NO: 52790 - protein, 642 aa, Geobacter metallireducens GS-15; identical to SEQ ID NO: 36671

SEQ ID NO: 52791 - DNA, 1848 bp, Geobacter metallireducens GS-15; identical to SEQ ID NO: 36672
  CDS (1)..(1848): transl_table=11

SEQ ID NO: 52792 - protein, 615 aa, Geobacter metallireducens GS-15; identical to SEQ ID NO: 36673

SEQ ID NO: 52793 - DNA, 1794 bp, Exiguobacterium sp. 255-15; identical to SEQ ID NO: 36674
  CDS (1)..(1794): transl_table=11

SEQ ID NO: 52794 - protein, 597 aa, Exiguobacterium sp. 255-15; identical to SEQ ID NO: 36675

SEQ ID NO: 52795 - DNA, 2271 bp, Frankia sp. CcI3; identical to SEQ ID NO: 36676
  CDS (1)..(2271): transl_table=11

SEQ ID NO: 52796 - protein, 756 aa, Frankia sp. CcI3; identical to SEQ ID NO: 36677

SEQ ID NO: 52797 - DNA, 2070 bp, Methylobacillus flagellatus KT; identical to SEQ ID NO: 36678
  CDS (1)..(2070): transl_table=11

SEQ ID NO: 52798 - protein, 689 aa, Methylobacillus flagellatus KT; identical to SEQ ID NO: 36679

SEQ ID NO: 52799 - DNA, 1821 bp, Moorella thermoacetica ATCC 39073; identical to SEQ ID NO: 36680
  CDS (1)..(1821): transl_table=11

SEQ ID NO: 52800 - protein, 606 aa, Moorella thermoacetica ATCC 39073; identical to SEQ ID NO: 36681

SEQ ID NO: 52801 - DNA, 1473 bp, Shewanella baltica OS155; identical to SEQ ID NO: 36682
  CDS (1)..(1473): transl_table=11

SEQ ID NO: 52802 - protein, 490 aa, Shewanella baltica OS155; identical to SEQ ID NO: 36683

SEQ ID NO: 52803 - DNA, 1434 bp, Shewanella amazonensis SB2B; identical to SEQ ID NO: 36684
  CDS (1)..(1434): transl_table=11

SEQ ID NO: 52804 - protein, 477 aa, Shewanella amazonensis SB2B; identical to SEQ ID NO: 36685

SEQ ID NO: 52805 - DNA, 2076 bp, Ralstonia metallidurans CH34; identical to SEQ ID NO: 36686
  CDS (1)..(2076): transl_table=11

SEQ ID NO: 52806 - protein, 691 aa, Ralstonia metallidurans CH34; identical to SEQ ID NO: 36687

SEQ ID NO: 52807 - DNA, 2124 bp, Rubrobacter xylanophilus DSM 9941; identical to SEQ ID NO: 36688
  CDS (1)..(2124): transl_table=11

SEQ ID NO: 52808 - protein, 707 aa, Rubrobacter xylanophilus DSM 9941; identical to SEQ ID NO: 36689

SEQ ID NO: 52809 - DNA, 2229 bp, Kineococcus radiotolerans SRS30216; identical to SEQ ID NO: 36690
  CDS (1)..(2229): transl_table=11

SEQ ID NO: 52810 - protein, 742 aa, Kineococcus radiotolerans SRS30216; identical to SEQ ID NO: 36691

SEQ ID NO: 52811 - DNA, 1473 bp, Shewanella denitrificans OS-217; identical to SEQ ID NO: 36692
  CDS (1)..(1473): transl_table=11

SEQ ID NO: 52812 - protein, 490 aa, Shewanella denitrificans OS-217; identical to SEQ ID NO: 36693

SEQ ID NO: 52813 - DNA, 1470 bp, Shewanella frigidimarina NCIMB 400; identical to SEQ ID NO: 36694
  CDS (1)..(1470): transl_table=11

SEQ ID NO: 52814 - protein, 489 aa, Shewanella frigidimarina NCIMB 400; identical to SEQ ID NO: 36695

SEQ ID NO: 52815 - DNA, 1461 bp, Shewanella frigidimarina NCIMB 400; identical to SEQ ID NO: 36696
  CDS (1)..(1461): transl_table=11

SEQ ID NO: 52816 - protein, 486 aa, Shewanella frigidimarina NCIMB 400; identical to SEQ ID NO: 36697

SEQ ID NO: 52817 - DNA, 1680 bp, Psychrobacter cryohalolentis K5; identical to SEQ ID NO: 36698
  CDS (1)..(1680): transl_table=11

SEQ ID NO: 52818 - protein, 559 aa, Psychrobacter cryohalolentis K5; identical to SEQ ID NO: 36699

SEQ ID NO: 52819 - DNA, 1644 bp, Prosthecochloris vibrioformis DSM 265; identical to SEQ ID NO: 36700
  CDS (1)..(1644): transl_table=11

SEQ ID NO: 52820 - protein, 547 aa, Prosthecochloris vibrioformis DSM 265; identical to SEQ ID NO: 36701

SEQ ID NO: 52821 - DNA, 1758 bp, Syntrophobacter fumaroxidans MPOB; identical to SEQ ID NO: 36702
  CDS (1)..(1758): transl_table=11

SEQ ID NO: 52822 - protein, 585 aa, Syntrophobacter fumaroxidans MPOB; identical to SEQ ID NO: 36703

SEQ ID NO: 52823 - DNA, 1845 bp, Pelobacter propionicus DSM 2379; identical to SEQ ID NO: 36704
  CDS (1)..(1845): transl_table=11

SEQ ID NO: 52824 - protein, 614 aa, Pelobacter propionicus DSM 2379; identical to SEQ ID NO: 36705

SEQ ID NO: 52825 - DNA, 2079 bp, Burkholderia ambifaria AMMD; identical to SEQ ID NO: 36706
  CDS (1)..(2079): transl_table=11

SEQ ID NO: 52826 - protein, 692 aa, Burkholderia ambifaria AMMD; identical to SEQ ID NO: 36707

SEQ ID NO: 52827 - DNA, 2061 bp, Rhodoferax ferrireducens DSM 15236; identical to SEQ ID NO: 36708
  CDS (1)..(2061): transl_table=11

SEQ ID NO: 52828 - protein, 686 aa, Rhodoferax ferrireducens DSM 15236; identical to SEQ ID NO: 36709

SEQ ID NO: 52829 - DNA, 1521 bp, Actinobacillus succinogenes 130Z; identical to SEQ ID NO: 36710
  CDS (1)..(1521)

SEQ ID NO: 52830 - protein, 506 aa, Actinobacillus succinogenes 130Z; identical to SEQ ID NO: 36711

SEQ ID NO: 52831 - DNA, 1749 bp, Escherichia coli; identical to SEQ ID NO: 36712
  CDS (1)..(1749): transl_table=11

SEQ ID NO: 52832 - protein, 582 aa, Escherichia coli; identical to SEQ ID NO: 36713

SEQ ID NO: 52833 - DNA, 2214 bp, Erwinia amylovora; identical to SEQ ID NO: 36714
  CDS (1)..(2214): transl_table=11

SEQ ID NO: 52834 - protein, 737 aa, Erwinia amylovora; identical to SEQ ID NO: 36715

SEQ ID NO: 52835 - DNA, 2166 bp, Escherichia coli; identical to SEQ ID NO: 36716
  CDS (1)..(2166): transl_table=11

SEQ ID NO: 52836 - protein, 721 aa, Escherichia coli; identical to SEQ ID NO: 36717

SEQ ID NO: 52837 - DNA, 2205 bp, Corynebacterium glutamicum; identical to SEQ ID NO: 36718
  CDS (1)..(2205): transl_table=11

SEQ ID NO: 52838 - protein, 734 aa, Corynebacterium glutamicum; identical to SEQ ID NO: 36719

SEQ ID NO: 52839 - DNA, 2304 bp, Pseudomonas putida; identical to SEQ ID NO: 36720
  CDS (1)..(2304): n means a or g or c or t/u, s means g or c

SEQ ID NO: 52840 - protein, 767 aa, Pseudomonas putida; identical to SEQ ID NO: 36721
  Xaa in positions 61, 65 and 78 is unknown

SEQ ID NO: 52841 - DNA, 1668 bp, Aquifex aeolicus; identical to SEQ ID NO: 36722
  CDS (1)..(1668): transl_table=11

SEQ ID NO: 52842 - protein, 555 aa, Aquifex aeolicus; identical to SEQ ID NO: 36723

SEQ ID NO: 52843 - DNA, 1797 bp, Bacillus subtilis; identical to SEQ ID NO: 36724
  CDS (1)..(1797): transl_table=11

SEQ ID NO: 52844 - protein, 598 aa, Bacillus subtilis; identical to SEQ ID NO: 36725

SEQ ID NO: 52845 - DNA, 2064 bp, Helicobacter pylori J99; identical to SEQ ID NO: 36726
  CDS (1)..(2064): transl_table=11

SEQ ID NO: 52846 - protein, 687 aa, Helicobacter pylori J99; identical to SEQ ID NO: 36727

SEQ ID NO: 52847 - DNA, 2064 bp, Helicobacter pylori; identical to SEQ ID NO: 36728
  CDS (1)..(2064): transl_table=11

SEQ ID NO: 52848 - protein, 687 aa, Helicobacter pylori; identical to SEQ ID NO: 36729

SEQ ID NO: 52849 - DNA, 2277 bp, Mycobacterium tuberculosis; identical to SEQ ID NO: 36730
  CDS (1)..(2277): transl_table=11

SEQ ID NO: 52850 - protein, 758 aa, Mycobacterium tuberculosis; identical to SEQ ID NO: 36731

SEQ ID NO: 52851 - DNA, 2166 bp, Escherichia coli; identical to SEQ ID NO: 36732
  CDS (1)..(2166): transl_table=11

SEQ ID NO: 52852 - protein, 721 aa, Escherichia coli; identical to SEQ ID NO: 36733

SEQ ID NO: 52853 - DNA, 25 bp, Artificial sequence
  (1)..(25): primer
atgaacaaatcagggaaatacctcg

SEQ ID NO: 52854 - DNA, 22 bp, Artificial sequence
  (1)..(22): primer
ttagtgtgcgccttttgcctgc

SEQ ID NO: 52855 - protein, 846 aa, Artificial sequence; identical to SEQ ID NO: 36736
  Variant (2)..(7): xaa in position 2 to 7 is any amino acid
  Variant (9)..(12): xaa in position 9 to 12 is any amino acid
  Variant (16)..(17): xaa in position 16 to 17 is any amino acid
  Variant (19)..(20): xaa in position 19 to 20 is any amino acid
  Variant (23)..(32): xaa in position 23 to 32 is any amino acid
  Variant (33)..(35): xaa in position 33 to 35 is any or no amino acid
  Variant (39)..(42): xaa in position 39 to 42 is any amino acid
  Variant (45)..(45): xaa in position 45 is any amino acid
  Variant (50)..(54): xaa in position 50 to 54 is any amino acid
  Variant (55)..(55): xaa in position 55 is any or no amino acid
  Variant (58)..(60): xaa in position 58 to 60 is any amino acid
  Variant (62)..(63): xaa in position 62 to 63 is any amino acid
  Variant (67)..(67): xaa in position 67 is any amino acid
  Variant (71)..(71): xaa in position 71 is any amino acid
  Variant (77)..(82): xaa in position 77 to 82 is any amino acid
  Variant (83)..(84): xaa in position 83 to 84 is any or no amino acid
  Variant (86)..(86): xaa in position 86 is any amino acid
  Variant (91)..(91): xaa in position 91 is any amino acid
  Variant (93)..(93): xaa in position 93 is any amino acid
  Variant (95)..(95): xaa in position 95 is any amino acid
  Variant (100)..(100): xaa in position 100 is any amino acid
  Variant (102)..(107): xaa in position 102 to 107 is any amino acid
  Variant (109)..(109): xaa in position 109 is any amino acid
  Variant (111)..(112): xaa in position 111 to 112 is any amino acid
  Variant (114)..(114): xaa in position 114 is any amino acid
  Variant (117)..(118): xaa in position 117 to 118 is any amino acid
  Variant (120)..(123): xaa in position 120 to 123 is any amino acid
  Variant (126)..(133): xaa in position 126 to 133 is any amino acid
  Variant (134)..(142): xaa in position 134 to 142 is any or no amino acid
  Variant (144)..(146): xaa in position 144 to 146 is any amino acid
  Variant (149)..(149): xaa in position 149 is any amino acid
  Variant (153)..(159): xaa in position 153 to 159 is any amino acid
  Variant (161)..(171): xaa in position 161 to 171 is any amino acid
  Variant (175)..(175): xaa in position 175 is any amino acid
  Variant (177)..(181): xaa in position 177 to 181 is any amino acid
  Variant (182)..(360): xaa in position 182 to 360 is any or no amino acid
  Variant (362)..(363): xaa in position 362 to 363 is any or no amino acid
  Variant (365)..(366): xaa in position 365 to 366 is any or no amino acid
  Variant (369)..(369): xaa in position 369 is any amino acid
  Variant (374)..(375): xaa in position 374 to 375 is any amino acid
  Variant (378)..(382): xaa in position 378 to 382 is any amino acid
  Variant (384)..(384): xaa in position 384 is any amino acid
  Variant (385)..(389): xaa in position 385 to 389 is any or no amino acid
  Variant (391)..(391): xaa in position 391 is any amino acid
  Variant (393)..(397): xaa in position 393 to 397 is any amino acid
  Variant (399)..(400): xaa in position 399 to 400 is any amino acid
  Variant (403)..(411): xaa in position 403 to 411 is any amino acid
  Variant (413)..(421): xaa in position 413 to 421 is any amino acid
  Variant (422)..(442): xaa in position 422 to 442 is any or no amino acid
  Variant (446)..(446): xaa in position 446 is any amino acid
  Variant (462)..(463): xaa in position 462 to 463 is any amino acid
  Variant (464)..(464): xaa in position 464 is any or no amino acid
  Variant (466)..(469): xaa in position 466 to 469 is any amino acid
  Variant (471)..(471): xaa in position 471 is any amino acid
  Variant (473)..(474): xaa in position 473 to 474 is any amino acid
  Variant (476)..(478): xaa in position 476 to 478 is any amino acid
  Variant (480)..(480): xaa in position 480 is any amino acid
  Variant (482)..(482): xaa in position 482 is any amino acid
  Variant (488)..(488): xaa in position 488 is any amino acid
  Variant (490)..(491): xaa in position 490 to 491 is any amino acid
  Variant (496)..(499): xaa in position 496 to 499 is any amino acid
  Variant (501)..(508): xaa in position 501 to 508 is any amino acid
  Variant (509)..(594): xaa in position 509 to 594 is any or no amino acid
  Variant (596)..(601): xaa in position 596 to 601 is any amino acid
  Variant (602)..(604): xaa in position 602 to 604 is any or no amino acid
  Variant (606)..(616): xaa in position 606 to 616 is any amino acid
  Variant (617)..(632): xaa in position 617 to 632 is any or no amino acid
  Variant (636)..(638): xaa in position 636 to 638 is any amino acid
  Variant (640)..(641): xaa in position 640 to 641 is any amino acid
  Variant (644)..(645): xaa in position 644 to 645 is any amino acid
  Variant (647)..(647): xaa in position 647 is any amino acid
  Variant (649)..(649): xaa in position 649 is any amino acid
  Variant (651)..(652): xaa in position 651 to 652 is any amino acid
  Variant (654)..(654): xaa in position 654 is any amino acid
  Variant (657)..(657): xaa in position 657 is any amino acid
  Variant (659)..(687): xaa in position 659 to 687 is any amino acid
  Variant (688)..(710): xaa in position 688 to 710 is any or no amino acid
  Variant (713)..(714): xaa in position 713 to 714 is any amino acid
  Variant (717)..(717): xaa in position 717 is any amino acid
  Variant (721)..(721): xaa in position 721 is any amino acid
  Variant (724)..(724): xaa in position 724 is any amino acid
  Variant (726)..(726): xaa in position 726 is any amino acid
  Variant (728)..(733): xaa in position 728 to 733 is any amino acid
  Variant (735)..(735): xaa in position 735 is any amino acid
  Variant (737)..(742): xaa in position 737 to 742 is any amino acid
  Variant (743)..(746): xaa in position 743 to 746 is any or no amino acid
  Variant (748)..(749): xaa in position 748 to 749 is any amino acid
  Variant (752)..(753): xaa in position 752 to 753 is any amino acid
  Variant (756)..(774): xaa in position 756 to 774 is any amino acid
  Variant (775)..(834): xaa in position 775 to 834 is any or no amino acid
  Variant (836)..(845): xaa in position 836 to 845 is any amino acid

SEQ ID NO: 52856 - protein, 88 aa, Artificial sequence; identical to SEQ ID NO: 36737
  Variant (3)..(3): xaa in position 3 is Ala or Ser
  Variant (4)..(7): xaa in position 4 to 7 is any amino acid
  Variant (8)..(8): xaa in position 8 is Asp or Asn
  Variant (9)..(9): xaa in position 9 is Asp or Gly
  Variant (10)..(10): xaa in position 10 is any amino acid
  Variant (11)..(11): xaa in position 11 is Asp, Glu or Asn
  Variant (12)..(12): xaa in position 12 is Phe, His or Tyr
  Variant (13)..(24): xaa in position 13 to 24 is any amino acid
  Variant (25)..(25): xaa in position 25 is Phe or Leu
  Variant (26)..(26): xaa in position 26 is Ala, Ile or Leu
  Variant (27)..(27): xaa in position 27 is Ala, Gly, Asn, Ser or Thr
  Variant (28)..(28): xaa in position 28 is Ile or Val
  Variant (29)..(29): xaa in position 29 is Ala or Ser
  Variant (30)..(30): xaa in position 30 is Ala or Gly
  Variant (31)..(31): xaa in position 31 is any amino acid
  Variant (34)..(34): xaa in position 34 is Ile, Leu, Met or Val
  Variant (35)..(35): xaa in position 35 is any amino acid
  Variant (37)..(40): xaa in position 37 to 40 is any or no amino acid
  Variant (42)..(43): xaa in position 42 to 43 is any amino acid
  Variant (45)..(49): xaa in position 45 to 49 is any amino acid
  Variant (50)..(50): xaa in position 50 is any or no amino acid
  Variant (52)..(52): xaa in position 52 is Ile or Leu
  Variant (53)..(53): xaa in position 53 is Gly, Ile, Leu or Val
  Variant (54)..(54): xaa in position 54 is any amino acid
  Variant (56)..(56): xaa in position 56 is Ala, Cys, Gly, Ser, Thr or Val
  Variant (57)..(57): xaa in position 57 is any amino acid
  Variant (58)..(58): xaa in position 58 is Phe, Ile, Leu, Met or Val
  Variant (59)..(59): xaa in position 59 is Ala, Gly, Ile or Val
  Variant (61)..(61): xaa in position 61 is Ala, Cys, Gly or Ser
  Variant (63)..(63): xaa in position 63 is any amino acid
  Variant (65)..(67): xaa in position 65 to 67 is any amino acid
  Variant (68)..(68): xaa in position 68 is Gly or Leu
  Variant (69)..(70): xaa in position 69 to 70 is any amino acid
  Variant (72)..(72): xaa in position 72 is any amino acid
  Variant (73)..(73): xaa in position 73 is Lys or Arg
  Variant (74)..(75): xaa in position 74 to 75 is any amino acid
  Variant (76)..(76): xaa in position 76 is Ala or Gly
  Variant (77)..(78): xaa in position 77 to 78 is any amino acid
  Variant (79)..(79): xaa in position 79 is Ile, Leu, Met or Val
  Variant (80)..(86): xaa in position 80 to 86 is any amino acid
  Variant (87)..(87): xaa in position 87 is Ile, Leu, Met or Val
  Variant (88)..(88): xaa in position 88 is Gly or Ser

SEQ ID NO: 52857 - protein, 23 aa, Artificial sequence
  Variant (2)..(4): xaa in position 2 to 4 is any amino acid
  Variant (5)..(5): xaa in position 5 is any or no amino acid
  Variant (7)..(7): xaa in position 7 is any amino acid
  Variant (8)..(8): xaa in position 8 is any or no amino acid
  Variant (11)..(11): xaa in position 11 is Ile or Val
  Variant (12)..(13): xaa in position 12 to 13 is any amino acid
  Variant (14)..(15): xaa in position 14 to 15 is Ile or Leu
  Variant (16)..(22): xaa in position 16 to 22 is any amino acid
  Variant (23)..(23): xaa in position 23 is Ala, Gly, Gln, Ser or Thr
YXXXXAXXLPXXXXXXXXXXXXX

SEQ ID NO: 52858 - protein, 44 aa, Artificial sequence; identical to SEQ ID NO: 36739
  Variant (3)..(3): xaa in position 3 is Ala, Ser or Thr
  Variant (7)..(7): xaa in position 7 is Ile, Leu or Val
  Variant (12)..(14): xaa in position 12 to 14 is any amino acid
  Variant (15)..(15): xaa in position 15 is any or no amino acid
  Variant (17)..(17): xaa in position 17 is Gly or Pro
  Variant (18)..(19): xaa in position 18 to 19 is any amino acid
  Variant (20)..(20): xaa in position 20 is Ala, Pro or Ser
  Variant (21)..(21): xaa in position 21 is His, Lys or Arg
  Variant (22)..(31): xaa in position 22 to 31 is any amino acid
  Variant (32)..(32): xaa in position 32 is Ile, Leu or Val
  Variant (33)..(33): xaa in position 33 is any amino acid
  Variant (34)..(34): xaa in position 34 is Phe or Tyr
  Variant (35)..(37): xaa in position 35 to 37 is any amino acid
  Variant (38)..(38): xaa in position 38 is Ile, Leu, Met or Val
  Variant (39)..(39): xaa in position 39 is any amino acid
  Variant (41)..(41): xaa in position 41 is Ala, Cys, Gly or Ser
  Variant (42)..(43): xaa in position 42 to 43 is any amino acid
  Variant (44)..(44): xaa in position 44 is Ala, Gly or Ser

SEQ ID NO: 52859 - protein, 20 aa, Artificial sequence
  Variant (2)..(4): xaa in position 2 to 4 is any or no amino acid
  Variant (6)..(6): xaa in position 6 is Ala, Ser or Thr
  Variant (7)..(7): xaa in position 7 is any amino acid
  Variant (9)..(9): xaa in position 9 is Ala, Ser or Thr
  Variant (10)..(10): xaa in position 10 is Ala or Gly
  Variant (11)..(11): xaa in position 11 is any amino acid
  Variant (13)..(14): xaa in position 13 to 14 is any amino acid
  Variant (16)..(18): xaa in position 16 to 18 is any amino acid
  Variant (19)..(19): xaa in position 19 is Ala, Glu, Gln, Ser or Thr
  Variant (20)..(20): xaa in position 20 is Asp or Glu
LXXXTXXDXXXRXXRXXXXX

SEQ ID NO: 52860 - protein, 39 aa, Artificial sequence; identical to SEQ ID NO: 36741
  Variant (2)..(3): xaa in position 2 to 3 is any amino acid
  Variant (5)..(5): xaa in position 5 is Ala, Gly, Ser or Thr
  Variant (6)..(6): xaa in position 6 is any amino acid
  Variant (7)..(7): xaa in position 7 is Ala, Gly, Asn, Ser or Thr
  Variant (9)..(11): xaa in position 9 to 11 is any amino acid
  Variant (12)..(12): xaa in position 12 is Ala, Gly or Ser
  Variant (13)..(15): xaa in position 13 to 15 is any amino acid
  Variant (17)..(22): xaa in position 17 to 22 is any amino acid
  Variant (23)..(23): xaa in position 23 is any or no amino acid
  Variant (25)..(36): xaa in position 25 to 36 is any amino acid
  Variant (37)..(38): xaa in position 37 to 38 is any or no amino acid

SEQ ID NO: 52861 - DNA, 984 bp, Escherichia coli
  CDS (1)..(984)
atgataatgattttcacgtcaagttgctgcgataatttatcaatagatgagattatcgaacgtgctgaaaaaggcgattgcgaggctcaatatattgttgggttttattataatcgcgatagcgcaattgattctccggacgacgaaaaagccttttactggctgaagctggccgctgagcaaggtcattgtgaagcacagtattccttagggcaaaagtataccgaggataaaagccgtcataaagataatgagcaagccatcttctggctgaaaaaagctgccctacaaggccatactttcgcttccaacgcccttggctggacactggatcgtggagaagcccccaattataaagaagcggttgtctggtatcagatagccgcggagagcggaatgtcttatgcgcaaaataatcttgggtggatgtacagaaatggcaacggagtcgcaaaagactatgcgctggcatttttctggtacaaacaagctgcattacaaggccatagtgacgcgcaaaacaatctggccgatctttatgaagacggaaaaggcgttgctcaaaacaagacactcgccgcattctggtatttgaaaagcgcacagcagggtaatcggcacgcccagtttcaaattgcatgggattataacgctggcgaaggggtggaccaggactataagcaagcgatgtactggtatctgaaggctgccgctcaggggagcgtcggcgcttacgtcaacatcggttatatgtataaacacggacaaggcgttgagaaagattatcaggctgcctttgaatggtttacgaaagccgctgaatgcaatgacgccactgcctggtataacctggccattatgtatcactacggagaaggaagacctgtcgatctccgacaggctctcgacctgtatcgtaaagttcagtcatccggaaccagagatgtcagtcaggaaattcgtgagactgaagatttactgtag

SEQ ID NO: 52862 - protein, 327 aa, Escherichia coli
MIMIFTSSCCDNLSIDEIIERAEKGDCEAQYIVGFYYNRDSAIDSPDDEKAFYWLKLAAEQGHCEAQYSLGQKYTEDKSRHKDNEQAIFWLKKAALQGHTFASNALGWTLDRGEAPNYKEAVVWYQIAAESGMSYAQNNLGWMYRNGNGVAKDYALAFFWYKQAALQGHSDAQNNLADLYEDGKGVAQNKTLAAFWYLKSAQQGNRHAQFQIAWDYNAGEGVDQDYKQAMYWYLKAAAQGSVGAYVNIGYMYKHGQGVEKDYQAAFEWFTKAAECNDATAWYNLAIMYHYGEGRPVDLRQALDLYRKVQSSGTRDVSQEIRETEDLL

SEQ ID NO: 52863 - DNA, 2067 bp, Rattus norvegicus
  CDS (1)..(2067)
atgaatcccttggctttgttagtagagatattgatcattattgaggtcacaactaaaaacagtgaagcagaaagatataacagaaaacaaaaagaagtgaatgtcaccacacaggtatcagtgagcaaagtcaagcagtttttatcgcatctactggaacaaggaaaagcaaataaaatagccaataaaagagaaaatcccttagaaaaaaagaagcatcaacataagttaaaaataaaaggaattcaaaataagaatctcctgaagagaaatcaaaactacttcaaaaagccagccaagaaaagtatcacagataaaggagatgagttatttaagatgggcaacaagattctccaggagtctaaaagtcaaaaacaaaaaacagaagcctacacattcttcaccagagcagccgacatgggaaatttgaaagctatggaaaaaatggctgacgctttgctatttggaagtttcggcatgcaaaacataacagcagctatccagttatacgagtccttggctaaagaaggatcatacaaagcccaaaatgcattgggatttttatcttcttatggaataggaatggaatatgaccaagccaaggcactgatatattatacctttggaagtgctggagggagcatgatgtcccagatgattctggggtacagatacttgtcaggaattaatgttctgcaaaattgtgaagttgctctaaatcattacaagaaagtggcagattatattgctgacaaattggaaaaaagtgaaggtattcccgtggaaaaagtgaggctaaccgagagacctgagaatctgagttccaacagtgagattttggattgggacatataccaatactataagtttttggcagaaagaggagatgttcagatacaagtatctcttggacaattgcatctaattgggagaaaaggtctagatcaagattacagtaaggcgttatactactttctaaaggcagcaaaagctgggagtgcaaatgccatggcatttataggaaagatgtatttagaggggaacgctgctgcaccacaaaataatgccactgccttcaaatacttctccatggcggccagcaagggcaatgcaattggtcttcatggactcggtctcctttacttccatggaaaaggtgttcctgtgaattatggcgaagcacttaaatacttccagaaagctgcagagaagggatggccaaacgcacagttccacctaggcttcatgtactactctggctctggagtatggaaggattataagcttgccttcaaatatttttacttggcatctcagagtgggcagcctctcgccatttattatctagccgagatgtacgcaactggcaccggagtgctgagatcctgcagaacggccgtggagccttataaaggagtctgtgaactaggccactgggctgagaaattcctgacagcctactttgcctataaggatggggacgtagattcttctctaattcagtacgcgttgcttgccgaaatgggatatgaagtagctcaaagcaattcagcattcattttggaatccaaaaaagctaaaattctggggaaagagaagatgtatccaatggcacttctgctatggaaccgagctgccattcaagggaatgcttttgctagagtgaaaattggagattaccattactatggctacgggactaagaaggactatgaaacagcagccacacactacagcatcgcagcagacaagcatcacagtgcgcaagccatgttcaacctggcatatatgtatgagcacggcttggggattgcacaggacattcacttggccagaagattatacgacatggccgctcagacaagcccagatgctcacatacccgtgttctttgcccttatgaaactggaaactatgcattttctccaagatatcctgttttttaattttaccacgaaatggaaatggctgaaactggacagcaccattggaccatactgggacttattagtgattggcctaattgttgttgtgctgatcttcctgcttagaaaccaccataggtag

SEQ ID NO: 52864 - protein, 688 aa, Rattus norvegicus
MNPLALLVEILIIIEVTTKNSEAERYNRKQKEVNVTTQVSVSKVKQFLSHLLEQGKANKIANKRENPLEKKKHQHKLKIKGIQNKNLLKRNQNYFKKPAKKSITDKGDELFKMGNKILQESKSQKQKTEAYTFFTRAADMGNLKAMEKMADALLFGSFGMQNITAAIQLYESLAKEGSYKAQNALGFLSSYGIGMEYDQAKALIYYTFGSAGGSMMSQMILGYRYLSGINVLQNCEVALNHYKKVADYIADKLEKSEGIPVEKVRLTERPENLSSNSEILDWDIYQYYKFLAERGDVQIQVSLGQLHLIGRKGLDQDYSKALYYFLKAAKAGSANAMAFIGKMYLEGNAAAPQNNATAFKYFSMAASKGNAIGLHGLGLLYFHGKGVPVNYGEALKYFQKAAEKGWPNAQFHLGFMYYSGSGVWKDYKLAFKYFYLASQSGQPLAIYYLAEMYATGTGVLRSCRTAVEPYKGVCELGHWAEKFLTAYFAYKDGDVDSSLIQYALLAEMGYEVAQSNSAFILESKKAKILGKEKMYPMALLLWNRAAIQGNAFARVKIGDYHYYGYGTKKDYETAATHYSIAADKHHSAQAMFNLAYMYEHGLGIAQDIHLARRLYDMAAQTSPDAHIPVFFALMKLETMHFLQDILFFNFTTKWKWLKLDSTIGPYWDLLVIGLIVVVLIFLLRNHHR

SEQ ID NO: 52865 - DNA, 2223 bp, Mus musculus
  CDS (1)..(2223)
atgcaggtccgcgtaaggctgtcgttgctgctgctctgcgcggtgctcctgggctcggcagccgcgacctcggatgacaaaactaaccaggatgactccttagattccaagagttctttgcccacagatgagtcagtgaaggaccacaccaccacgggcaaagtagttgctggccagatatttgttgattctgaagaagcagaagtggaatcccttcttcaggacgaggaagatagctccaagacccaggaggaagagatcagctttttagaatctccgaatccaagcagcaagacctacgaagaactaaagagagtgcggaagccagtcttgactgccattgaagctgaagaagatgctgccaaaagacgacagatgcaggaagcagagatgatctatcaggccgggatgaagatactgaatggaagcaataggaagagccaaaagagagaagcatatcggtaccttcagaaggcagcaggcatgaatcacaccaaagccctggagagagtgtcctatgctctcttgtttggtgattacctcacacagaatatccaggcagccaaagagatgtttgagaaactgactgaggaagggtctcccaaaggacagactggtcttggctttctctacgcttctgggcttggtgttaattcaagtcaggcaaaggctcttgtatattatactttcggagctcttggaggcaacctgatagcccatatgattttgggttaccgctactgggctggcatcggagtcctccagagttgtgagtcggcactgacccattatcgtcttgttgccaatcatgttgctagtgatatctccctaactggaggctctgtagtccagagaatacggctgcccgatgaagtggaaaacccggggatgaacagtgggatgctggaagaagacctgattcagtattaccagttcctagctgagaagggtgacgtccaagcacaggttggcctgggacagctgcatctgcatggagggcgtggagtagaacagaatcaccagagagcgtttgactacttcaacttagcagcaaatgctggcaattcacatgctatggccttcctgggaaagatgtattctgaaggaagtgacatcgtacctcagagtaatgagacggcacttcactactttaagaaagctgctgacatgggcaaccccgtgggacagagcgggcttggaatggcctacctctacggaagaggcgttcaagttaattatgacctggccctcaagtatttccagaaagctgctgagcaaggctgggtggacgggcagctgcagctcggctctatgtactacaatggcattggagtcaagagagattataagcaggccttgaagtattttaatctggcttctcaaggaggccatatcttggctttctataacctcgcacagatgcacgccagcggcacaggggtgatgcggtcctgtcacactgcagtggagttgtttaagaatgtgtgtgagcgaggtcgctggtcagagagactgatgactgcctacaacagctataaggatgaggactacaatgctgcagtggtccagtacctcctgctggctgagcagggctacgaggtggcgcagagcaacgcagccttcatcctcgaccagagagaagcaaccattgtaggtgagaatgaaacttaccccagagctttactgcattggaacagggccgcctcccaaggttacactgtggctagaattaagcttggagactaccacttctatggctttggcactgatgtggattatgagaccgcatttattcattaccgcctggcttctgagcagcagcacagcgcccaagctatgtttaacctgggctacatgcacgagaagggcctaggcattaaacaggacattcaccttgcaaaacgcttttatgacatggcagccgaagctagcccagatgcacaagtacctgtgttcctcgcactctgcaaattaggtgtcgtctatttcttacagtacatacgggaagcaaacattcgagatctattcacacaactggatatggaccagcttttgggacccgagtgggacctttacctcatgaccatcattgcactgctcttgggtacagtcatagcttacaggcagcgacagcaccaggacataccagttcccaggcccccagggccacggccggctcctccccagcaggaaggaccaccagagcagcagccaccacagtag

SEQ ID NO: 52866 - protein, 740 aa, Mus musculus
MQVRVRLSLLLLCAVLLGSAAATSDDKTNQDDSLDSKSSLPTDESVKDHTTTGKVVAGQIFVDSEEAEVESLLQDEEDSSKTQEEEISFLESPNPSSKTYEELKRVRKPVLTAIEAEEDAAKRRQMQEAEMIYQAGMKILNGSNRKSQKREAYRYLQKAAGMNHTKALERVSYALLFGDYLTQNIQAAKEMFEKLTEEGSPKGQTGLGFLYASGLGVNSSQAKALVYYTFGALGGNLIAHMILGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDEDYNAAVVQYLLLAEQGYEVAQSNAAFILDQREATIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIREANIRDLFTQLDMDQLLGPEWDLYLMTIIALLLGTVIAYRQRQHQDIPVPRPPGPRPAPPQQEGPPEQQPPQ

SEQ ID NO: 52867 - DNA, 1734 bp, Mesorhizobium loti MAFF303099
  CDS (1)..(1734): transl_table=11
atgacaatcctggatcggctgactggtctggccttcccggcggcggtattgcgtcgagcgatcaagcttgctgacagcggcaaggccgctgaagcctttccgcttatggcgaaagcggcccgcgcggggatcgtcgacgccgagtaccgggtcgcgcgttgctatctggaaggcgccggtgtgccaccgagccgtatggaaggcgcgcgatggctgctgcgggcggccgaccacgggagcgcggatgcgcaagcgctcctcgccgcactctacgtcaccgggctggtgacgtcggaagccgacggcaagggaccctcggagcacttattcaaacctgattccgctggaaaaccagacttcacggccgctttcgactttgccaccaaggcggccgaggcaggctcggccacgggacaggcgatcctcggttatatccttaccagcggccccgcatcgatgcgcgatgccgatgcggcccaccggtggtacgagaagtcggcttctgccggctgcgccgaagggtgccttggctttgccctgtcgctggctcgccgcggcaaacgcgaaaacagagttcggattgcggaagaggtaagacgtgcagccgacgccggcctgccgaccgcgacctatcttcttgcggtccttaccgagcacgggctcggcgtagcacgcgacatggcagcagccgctcaactgtatcaggctgctgcggagaagggcctgccctctgctcaattccggttgggattggcactgatcgacggtgcactcgtcggccaagatgtcgctgctggggaggcgtggatgcggcgtgctgccctggccggcaatatcgaggcagcctatctcctgggcgatcgccatgcgaagacgcagcggccggattttgcggaagccgcgaactggtatcggcgggcagccgaagcgggccaccaagccgccgcccgcgctttggcctcgctctatttgactggaaatggtgtggctgaggatgtcgaggaaggagcacgctggctgcgctcttccgcaagtgccggcaatcagcaggcacagacagacctcgccaatcttatcctcggaggggctggcgagccggacgacggtgcaagcgttgccggatggttcgaggcggccgcatcatcgggcgacctcatcgcggcattcaaccttgggctctgcttcgccaagggcgtcggcgttcgccaggacgaggggcaagcggcacactggctgcggcgcgcggccgaaggcgtcgccgaggcacaatatatgtatgcccgcctcctccaggatggacgcggcgtggcggccgacccaactcaggcccgcgtgtggtttgcgcgggcggccgacgccggcgtgctcgacgcacgcgtggcgctcgccgagatgctactcaatgggcgcggcggcatgcccgagcccgaggctgcaatgcagttgtttgaacaggccgccgccgacggtcacgccggggcgatgtttgcgattggcgcgctgtacggagccggccacggcctgccgctcgaccagacaacggcacagaaatggtacgctgccgctgccggacgtgggcatagccaagcccaattcatgctcggacgttatctcttgaaaggcctcgccggggagcgcgacccggttgccgctcgcctttggctcgaacgtgcggctgcgcacgggatcagtgaagccgccgacgaactgggggctgcgggcgggtccgactag

SEQ ID NO: 52868 - protein, 577 aa, Mesorhizobium loti MAFF303099
MTILDRLTGLAFPAAVLRRAIKLADSGKAAEAFPLMAKAARAGIVDAEYRVARCYLEGAGVPPSRMEGARWLLRAADHGSADAQALLAALYVTGLVTSEADGKGPSEHLFKPDSAGKPDFTAAFDFATKAAEAGSATGQAILGYILTSGPASMRDADAAHRWYEKSASAGCAEGCLGFALSLARRGKRENRVRIAEEVRRAADAGLPTATYLLAVLTEHGLGVARDMAAAAQLYQAAAEKGLPSAQFRLGLALIDGALVGQDVAAGEAWMRRAALAGNIEAAYLLGDRHAKTQRPDFAEAANWYRRAAEAGHQAAARALASLYLTGNGVAEDVEEGARWLRSSASAGNQQAQTDLANLILGGAGEPDDGASVAGWFEAAASSGDLIAAFNLGLCFAKGVGVRQDEGQAAHWLRRAAEGVAEAQYMYARLLQDGRGVAADPTQARVWFARAADAGVLDARVALAEMLLNGRGGMPEPEAAMQLFEQAAADGHAGAMFAIGALYGAGHGLPLDQTTAQKWYAAAAGRGHSQAQFMLGRYLLKGLAGERDPVAARLWLERAAAHGISEAADELGAAGGSD

SEQ ID NO: 52869 - DNA, 2151 bp, Mesorhizobium loti MAFF303099
  CDS (1)..(2151): transl_table=11
atgttgcgaaggagcttttccagctatttgaggcaaggcctcctgctcgcgttcctggcggcgttcagcgcactttggctcgcccaggcccacgccgagcggcgcgctgccattgtcgtcggcaacagcgaatatccgtttgccccgctgaccaatccccgcaacgacgccaagctcatcgccaataccttgaccgagctcaaattcgacgtcctgctcttttacgatgtcaagaaatcggcggagaaagacctgaacgacgcgatacgcgcgcatctcataggcgccgacatggcggtcttctattacgccggccatgccctgcagtataacggccagaacctgctgctccccgtggatacgcggatctcgtcggccaaggaggtcgcggccgacgccatgaggctcaacgacctgatcgatatcgtgaagaacgatccggtcggcgtgaaagtcttcatcctcgatgcctgccgcaacaatccggtggccaaggagaaggggttgcagcaaggcctcgcctacacagaggccggcagcggccaggtgctggtcgcctttgccaccagcgccggtgaggtcgcctatgacgggacgggcatcaacagcccctattcgtcggcgctcgccaacgccctgctcatgccgaatctcgatgtgtacgacacgttccgcacggtgcggggcgacgttcgccaggcgacaggcggctcccaaattccctggatcaccggctcgatcgaaacgaaattcgtcttccggcagggtgacgccggcaagcaggttgcgcaagccgagcacgccgccgaggcggacggcggcctgaccatcgatgaggtgttatggtccttcatcagcgacagccagaatccggaggacttcgagcgcttcgtgaaggtctttccgaacagccgctacgcggccgaggcgacggagaagagccgcttcaaggtggctgcgttgaccaagcgcggactctatgtcaacggcaatttggtctccagctcgatcgcggccacggcgccgatcggggcgagtgacaaggcgttgagcgaggagttcgtgttccagcaggccggcgagcgcgccgtcagcgagacctttcgtatttggccgagcaacttgcccgacacacagcgcggcatgcggacgatggtcacggattgcgatctctacgccgccgatcccaacgatccacagcgcgcggtgcctggtgtcaccaacgggctcgtcaacgttcgggacgcgttgcgcgcttgcgcttttgcactggcggccgacatcaacaacccgcgcctgcagttccagttcggccgtgttctggaaattgccaggcgctatagctgggccgagcatttctacgaattggccggcaatcagcaatacagcgccgcgctcatcaacatgggctacatggcgcgcgtcggcatggggcgcgagatcgactacggccgcgcgttcgacccttacgttcgggccgccgcgcttggcaatctcagagccaggaccgacatcggctccgcctatattgctggccaaggcgtaccaaagctgccggaggaaggcgttctttggtatcgcctggccgcatcaagcggctgggcgaatgcgatcaccgccctcggcgacgcgtaccgcctcggcactggcgtcaagcaagactacgtccaggcagcctccttgtattcagcagcagccgataccggccagatcgatgcgatggcaaatctgggacaggcttacctcgcgggcgaaggcgtgaaaaaggacgtaccccgaggactcgaactgctgcagcgcgcaaacgacatgggcaacaggtatgcaccctattttatggcacagctatatctgaaaggcgaccgcaagctgcctgccgatcctcgccgcgccctggccctccttgagctttccgcgaaccggggaaatgagtacgcctacgtccgtctcgcctgggggcatcgcgacggtgtattcaccggcggcaagcctgacctgcgacgagcttacttcgacgcctcgctcgccgcgaggcttcgggccgatcagggagaacaggcgaaggcagagatagccaagaaaatagaccccgcaacccgaaaagaaatagacggagaagttgaactatacatcaaacaaaatggtccgtaa

SEQ ID NO: 52870 - protein, 716 aa, Mesorhizobium loti MAFF303099
MLRRSFSSYLRQGLLLAFLAAFSALWLAQAHAERRAAIVVGNSEYPFAPLTNPRNDAKLIANTLTELKFDVLLFYDVKKSAEKDLNDAIRAHLIGADMAVFYYAGHALQYNGQNLLLPVDTRISSAKEVAADAMRLNDLIDIVKNDPVGVKVFILDACRNNPVAKEKGLQQGLAYTEAGSGQVLVAFATSAGEVAYDGTGINSPYSSALANALLMPNLDVYDTFRTVRGDVRQATGGSQIPWITGSIETKFVFRQGDAGKQVAQAEHAAEADGGLTIDEVLWSFISDSQNPEDFERFVKVFPNSRYAAEATEKSRFKVAALTKRGLYVNGNLVSSSIAATAPIGASDKALSEEFVFQQAGERAVSETFRIWPSNLPDTQRGMRTMVTDCDLYAADPNDPQRAVPGVTNGLVNVRDALRACAFALAADINNPRLQFQFGRVLEIARRYSWAEHFYELAGNQQYSAALINMGYMARVGMGREIDYGRAFDPYVRAAALGNLRARTDIGSAYIAGQGVPKLPEEGVLWYRLAASSGWANAITALGDAYRLGTGVKQDYVQAASLYSAAADTGQIDAMANLGQAYLAGEGVKKDVPRGLELLQRANDMGNRYAPYFMAQLYLKGDRKLPADPRRALALLELSANRGNEYAYVRLAWGHRDGVFTGGKPDLRRAYFDASLAARLRADQGEQAKAEIAKKIDPATRKEIDGEVELYIKQNGP

SEQ ID NO: 52871 - DNA, 1041 bp, Mesorhizobium loti MAFF303099
  CDS (1)..(1041): transl_table=11
gtggctccggtaaggcttccccttcaggccttgcttgcagcggtcatgatccagaccgccgccgccgaaaccatacccttgccgccgcccatgcctgaaaccggcgcacacaccgacaagccgatcgaaaagcagttgccgcagcccgccaccacggcggagcccgcaccgctgccctcggtcgacagcatcaatcccgaccgcttcggcgccaagccggcggacgccgcctatggcgccttccagcgcgggctctacaaaacggcctataatctggcgctgacccgcgcccagaatggcgacccggcggcgcagacattggtggccgagatcctgtcgcgtgggctcggcgtgccgttgaatgccgcggaagcctcgaaatggtatgcgctcgccgccgaacagggcgtgcctgaggcgcagttccagtatgcgctgatgctgctcgacggccgttacgtcaagaaggacccgaaagaggcctacgccctgatgcaggccgccgccgaagccggcaaccagctggcgcagttcaatttcgcgcagatgctggtccgccaggatcccggcgacacgggcctggccaaggcagtctcctattatgagcgcgccgccgcgaccggcctcgccgacgcgcaatacgccatgtcccagatctatgccaacggcgttggcggcaaaccacgcgacgacgcgcaggcaaggcgcttcctggcgcaggctgcgcggcagaactacgacaccgcgcagatcgatctcgccgcctggatgatcgagggccgcggcggcgcccgcgacctgaaatcggctttcggctggacgaagcaggccgccgagggcggcaacgtcgccgcgcagaaccggctggcaaaactctacatgcaaggcatcggcacagacccggacctggtgctcgccggcgcctggtacatcgtcgcccgccgcgccggtctcatcgatcccgacatggacgatttcctacaagggctgagcgacgaccagaccaaacaggccctgcaaaaggcgaaccgcctgccctaa

SEQ ID NO: 52872 - protein, 346 aa, Mesorhizobium loti MAFF303099
MAPVRLPLQALLAAVMIQTAAAETIPLPPPMPETGAHTDKPIEKQLPQPATTAEPAPLPSVDSINPDRFGAKPADAAYGAFQRGLYKTAYNLALTRAQNGDPAAQTLVAEILSRGLGVPLNAAEASKWYALAAEQGVPEAQFQYALMLLDGRYVKKDPKEAYALMQAAAEAGNQLAQFNFAQMLVRQDPGDTGLAKAVSYYERAAATGLADAQYAMSQIYANGVGGKPRDDAQARRFLAQAARQNYDTAQIDLAAWMIEGRGGARDLKSAFGWTKQAAEGGNVAAQNRLAKLYMQGIGTDPDLVLAGAWYIVARRAGLIDPDMDDFLQGLSDDQTKQALQKANRLP

SEQ ID NO: 52873 - DNA, 1815 bp, Arabidopsis thaliana
  CDS (1)..(1815)
atgagagtctcaggccagagtatcatagccatatctctattcacactctcactctacatccatcgtgttcaagcccgtcccttcgttctcgttctctccaacgaagatctcaacggaggttttaatgataacggcgcctacgaatcctccgatttcgatgagtttggtgaatccgaacccaaatccgaagaggagcttgatcccggttcatggcgtcgaatcttcgagacaaatgagtccaccgtccacgcctctgcgtcgccgcagtattactccggactccacaaaattctctcggctgcgagtgaaggaaacactacattgatggaggaagcggtttcagagatagattcgtctgcctcgtcaggagatccacacgcacaatcagtgatggggttcgtatacgggattgggatgatgcgtgagacgagccgaagcaaatcgattttgcatcatcatttcgcggctgcgggaggaaatatgcagtctaaaatggcacttgcttttagatatctaagacaaaatatgtatgataaagctgttgagttatatgctgaactagcagagacagcagtgaatagctttttgatatccaaggattctccaatggctgagccagttagaatccacattggaacagaggagaataaagatgcactaaggaagtcacgaggggaggaagatgaggattttcagatattggaataccaggcagagaaagggaattctgtagcaatgcacaaaattggactgttttattactttggtttgagaggattaaggcgtgatcacgctaaggcgttgtattggttttcgaaggcggagtttaatggccttggttacttgtatgtcaaaggctatggagtagataagagaaactacactaaggcgagagaatactttgagatggctgctaataatgaagatcctagcgggcattataaccttggagtgttgtatcttaaaggcactggagtcaagaaggatgtgaggcatgcaaccaaatatttctttgttgctgccaatgctggtcaaccaaaggctttttatcaactcgccaagatgttccatacaggcgttggacttacaaagaacttggaaatggcgacaactttttataagctagtagcagaaagaggaccatggagttctctctctagatgggctcttgaagcttacttgaaaggtgatgtgggaaaggcttttatattgtattcgagaatgtcagagctcggttatgaagtagcacaaagtaatgctgcctggatcgtcgataaatacggggaaagaagcatgtgcatgggagtgtatgggttttgcacagataaggagaggcacgatcgggctcattctttgtggtggcgtgcctctgaacagggaaacgaacatgctgcattgcttattggagatgcatattactacggtcggggtacagagagggatttcgtgcgtgcagcagaggcgtacatgtatgctaaatctcaatcaaatgcgcaagcaatgttcaacctcggttacatgcatgagcatggagaaggtcttccttttgatctccatcttgctaaacgttactacgaccaggccctccagagcgatactgctgccaaattgcccgtcacgcttgctcttgcgagtgtatgggtccgcagaaactatgctgatactgccctggtgcaagtactgaattccttaccagaagtgcatcaaaaggtggtggaatgggtagagaatgggatgttggaagaagtggttttggatcccgttggtgctaacgtggcacagcccctcgctgccccagtagcatttccccagtaa

SEQ ID NO: 52874 - protein, 604 aa, Arabidopsis thaliana
MRVSGQSIIAISLFTLSLYIHRVQARPFVLVLSNEDLNGGFNDNGAYESSDFDEFGESEPKSEEELDPGSWRRIFETNESTVHASASPQYYSGLHKILSAASEGNTTLMEEAVSEIDSSASSGDPHAQSVMGFVYGIGMMRETSRSKSILHHHFAAAGGNMQSKMALAFRYLRQNMYDKAVELYAELAETAVNSFLISKDSPMAEPVRIHIGTEENKDALRKSRGEEDEDFQILEYQAEKGNSVAMHKIGLFYYFGLRGLRRDHAKALYWFSKAEFNGLGYLYVKGYGVDKRNYTKAREYFEMAANNEDPSGHYNLGVLYLKGTGVKKDVRHATKYFFVAANAGQPKAFYQLAKMFHTGVGLTKNLEMATTFYKLVAERGPWSSLSRWALEAYLKGDVGKAFILYSRMSELGYEVAQSNAAWIVDKYGERSMCMGVYGFCTDKERHDRAHSLWWRASEQGNEHAALLIGDAYYYGRGTERDFVRAAEAYMYAKSQSNAQAMFNLGYMHEHGEGLPFDLHLAKRYYDQALQSDTAAKLPVTLALASVWVRRNYADTALVQVLNSLPEVHQKVVEWVENGMLEEVVLDPVGANVAQPLAAPVAFPQ

SEQ ID NO: 52875 - DNA, 771 bp, Helicobacter pylori 26695
  CDS (1)..(771): transl_table=11
atgggatacgcaagcaaattagccttgaagatttgtttggcaagtttatgtttatttagcgctcttggtgcagaacaccttgaacaaaaaaggaactatatttataaaggggaggaagcctataataataaggaatatgagcgggcggcttctttttataagagcgcgattaaaaatggcgagccgcttgcttatgttcttttagggatcatgtatgaaaatggtaggggtgtgcctaaagatgaaaagaaagcggctgaatattttcaaaaagcggttgataacgatatacctagagggtataacaatttaggcgtgatgtataaagagggtagaggtgtgcctaaagatgaaaagaaagccgtggagtattttagaatagctaccgagaagggctatactaacgcctatataaacttaggcatcatgtatatggagggtaggggagttccaagcaactatgtgaaagcgacagagtgctttagaaaagcgatgcataagggtaatgtagaagcttatatccttttaggggatatttattatagtgggaatgatcaattgggtattgagccagacaaagataaggcgattgtctattataaaatggcggctgatatgagctcttctagagcttatgaagggttagcagagtcttatcagtatgggttaggcgtggaaaaagataagaaaaaggctgaagaatacatgcaaaaagcatgcgattttgacattgataaaaattgtaagaaaaagaacacttcaagccgataa

SEQ ID NO: 52876 - protein, 256 aa, Helicobacter pylori 26695
MGYASKLALKICLASLCLFSALGAEHLEQKRNYIYKGEEAYNNKEYERAASFYKSAIKNGEPLAYVLLGIMYENGRGVPKDEKKAAEYFQKAVDNDIPRGYNNLGVMYKEGRGVPKDEKKAVEYFRIATEKGYTNAYINLGIMYMEGRGVPSNYVKATECFRKAMHKGNVEAYILLGDIYYSGNDQLGIEPDKDKAIVYYKMAADMSSSRAYEGLAESYQYGLGVEKDKKKAEEYMQKACDFDIDKNCKKKNTSSR

SEQ ID NO: 52877 - DNA, 771 bp, Helicobacter pylori J99
  CDS (1)..(771): transl_table=11
atgggatacgcaagcaaattagctttaaagatttgtttggtaggtttatgtttatttagcacccttggtgcagaacaccttgagcaaaaagggaattatatttataagggagaggaggcttataataataaggaatatgagcgagcggcttctttttataagagcgctattaaaaatggtgagtcgcttgcttatattcttttagggatcatgtatgaaaatggtaggggtgtacctaaagattacaagaaagcggttgaatatttccaaaaagctgttgataacgatatacctagagggtataacaatttgggcgtgatgtataaagagggtaagggagttcctaaagatgaaaagaaagcggtggaatattttagaatagctacagagaaaggttatactaacgcttatatcaacttaggcatcatgtatatggagggcaggggagttccaagtaactatgcgaaagcgacagaatgttttagaaaagcgatgcataagggcaatgtggaagcttatattctcctaggggatatttattatagcgggaatgatcaattgggtattgagccggacaaagataaggctgttgtctattataaaatggcggctgatgtgagttcttctagagcttatgaagggttgtcagagtcttatcggtatgggttaggcgtggaaaaagataaaaaaaaggctgaagaatacatgcaaaaagcatgcgattttgacattgataaaaattgtaagaaaaagaacacttcaagccgataa

SEQ ID NO: 52878 - protein, 256 aa, Helicobacter pylori J99
MGYASKLALKICLVGLCLFSTLGAEHLEQKGNYIYKGEEAYNNKEYERAASFYKSAIKNGESLAYILLGIMYENGRGVPKDYKKAVEYFQKAVDNDIPRGYNNLGVMYKEGKGVPKDEKKAVEYFRIATEKGYTNAYINLGIMYMEGRGVPSNYAKATECFRKAMHKGNVEAYILLGDIYYSGNDQLGIEPDKDKAVVYYKMAADVSSSRAYEGLSESYRYGLGVEKDKKKAEEYMQKACDFDIDKNCKKKNTSSR

SEQ ID NO: 52879 - DNA, 729 bp, Pasteurella multocida subsp. multocida str. Pm70
  CDS (1)..(729): transl_table=11
atgaagaaaacgattctgttcatattcagtgtgtttttatccggtgtggtgcacgcacagtctgcaccggtttctcctgagctgtcagctgtcttgccacagacagcaccaactgcaacgggagcagagcagcacgtttcggcattgaatgcatctgaactgagtgatgaagctcgtcgcgaattaattcgcgaggcagccgataaaaaagagtggacacgggcgtttgagctgattttaccacttgctttaaaaggggattaccaggcacaagccaatcttggtattttgtatgcacgtggtcaaggtgttccacaagatttcgaaaaagcctattggtggtttagcgaagcagccgaaaagggcagcattaaagccatcaataatttggccgttttttacttacaaggtcatggtgtcaagcaagatattcgccacagcattacattatttgaaaaaactgccaattcaggctcattggatgcgatgctggtgctagggcaaatctatgaaaacgaattaaatcaaatgacccaagctttcaaatggtataaaaaagcagcagaagcgggtaatcacgatgcacaatttcgtttagccgtgatgtatgagaatggtgagggaaccaagaaaaataaaaaacaagctgtttattggtatcagaaggtgtccgttcagcaaaatgaattagcagcattagcccaagagcgtttatctcgcctacaataa

SEQ ID NO: 52880 - protein, 242 aa, Pasteurella multocida subsp. multocida str. Pm70
MKKTILFIFSVFLSGVVHAQSAPVSPELSAVLPQTAPTATGAEQHVSALNASELSDEARRELIREAADKKEWTRAFELILPLALKGDYQAQANLGILYARGQGVPQDFEKAYWWFSEAAEKGSIKAINNLAVFYLQGHGVKQDIRHSITLFEKTANSGSLDAMLVLGQIYENELNQMTQAFKWYKKAAEAGNHDAQFRLAVMYENGEGTKKNKKQAVYWYQKVSVQQNELAALAQERLSRLQ

SEQ ID NO: 52881 - DNA, 519 bp, Pasteurella multocida subsp. multocida str. Pm70
  CDS (1)..(519): transl_table=11
atgcaaagatggagcaaaacactgctcagtattatgttgcttgtgagtacaatgaatgtcttcgctcaacgagaagaagacccggtttttgaacaaggtgttgaagcctataaacgcggtgatcatgctactgcgtttaaactttggctatcacgagccgagcaaggggagatgagcgctcaatttaatgtggggagaatgtacgacgatggtgacggtgttgaacaagacaagcaacaagctttgaaatggtatcaaaaatccgctgagcaaaatcaccccgatgcacagtatcatttagggctgatgtacagtgaaggcgacggcattgcacaagactttaaacaagcctacaaatggtatagccaatctgccgtacagggcgatgcgcgtgcgctctataatttaggtacactctatgcgaatggcgaaggaatcgaacgtgattgggacagagcgaaaatgtattttaaacaagcttgcaaagcgggtttgccagaagggtgtgattgggagtaa

SEQ ID NO: 52882 - protein, 172 aa, Pasteurella multocida subsp. multocida str. Pm70
MQRWSKTLLSIMLLVSTMNVFAQREEDPVFEQGVEAYKRGDHATAFKLWLSRAEQGEMSAQFNVGRMYDDGDGVEQDKQQALKWYQKSAEQNHPDAQYHLGLMYSEGDGIAQDFKQAYKWYSQSAVQGDARALYNLGTLYANGEGIERDWDRAKMYFKQACKAGLPEGCDWE

SEQ ID NO: 52883 - DNA, 987 bp, Pseudomonas aeruginosa PAO1
  CDS (1)..(987): transl_table=11
atgttcagtcagtgggtgttcctgtccgtccttgctcttgccgtaccctcgttcgcctgggcggaggatgcggtgtccgacctcgccagggagcagtccaaggccgagcagggcgacaagcgcggcgatgaactgttcgccgaattcacccgcctccgccaggccgccgagacgggggagccgcaggctctgttcgatttcggcgcctacttctaccagcaacagaactacgccagcgcgcgcgaatggtggggcaaggcggccgctgcggggatggtccgcgcgcagatccaactggccatgctctatcgcgatggtgacggcgggccacaggacaagaccgaggcggcacgctggttccggaaggccgcggagcagggggatgccgccgcccagaatgaaatgggcgttctctactggagaggcgaaggggtcgaccaggaccgggtgaaggccgggacctggttcgaacgcgcggcggccagcggtagcgaagacgccgaaaccaatctgggatggttctacctggacgactcgcaaggcgtctattccgccacttcagacgaggaagccgccctgctggaccgttatgccggcagccgggaaaaggccttccagtggttctgcaaggctgcgacccagggagatgcccgtgcccagttcaaggtgggcgaggcctactggaacggttccggtgccgggatgaacaagctgcaagcgcggctctggctggaaaaggccgcacagcagcaggatgcggatgccatcgcctggttggagagcgccgcgaacgcagcctggtacacccgcctggaaaactggattcacgctgcgctggatggagagctgtccggcgtcgccgactgctccggtgccgccgatcgccggcactccggccgaggcatggagggcgccccgtctgacccggaggcggtggaagccagtgcggaggatgcgcagcaggcggttgaagcggcgagccagtga

SEQ ID NO: 52884 - protein, 328 aa, Pseudomonas aeruginosa PAO1
MFSQWVFLSVLALAVPSFAWAEDAVSDLAREQSKAEQGDKRGDELFAEFTRLRQAAETGEPQALFDFGAYFYQQQNYASAREWWGKAAAAGMVRAQIQLAMLYRDGDGGPQDKTEAARWFRKAAEQGDAAAQNEMGVLYWRGEGVDQDRVKAGTWFERAAASGSEDAETNLGWFYLDDSQGVYSATSDEEAALLDRYAGSREKAFQWFCKAATQGDARAQFKVGEAYWNGSGAGMNKLQARLWLEKAAQQQDADAIAWLESAANAAWYTRLENWIHAALDGELSGVADCSGAADRRHSGRGMEGAPSDPEAVEASAEDAQQAVEAASQ

SEQ ID NO: 52885 - DNA, 816 bp, Pseudomonas aeruginosa PAO1
  CDS (1)..(816): transl_table=11
atgcgccacctgctgcttcgtcacgacgcgctggacgccgaaggtttcgccgcacaactggccggtaccccgggcgaggttgcccaggccatccttggcgctgcgcgcgagggcctgacggaagcccaggccctgctcggacagatccttctggacggccaaggcatccagcgcgacccgaccctggcgcggacctggttcacgatcgccgccgaacgcggccacgcaatggcgcgcaatatgctcgctcgctgtcttgaacatggctggggcggcccggcggatccagccgcggcagccgtccactatcggatcgccgcccaggccggccttgactgggcccgctacaacctggccaatctccacgccaccggccgcggggtgccccaggaccagccgcgcgcctatgcgctgtatcggcaagcggccgagcagggccacgcgaaatcgatgaacctggtggggcgctaccacgaagaaggcctggtggtcgctcgcgacctggcgcaagctgcgcactggtatcgacgttccgccgagggcggcgattttcgcggccagttcagccacgccgcgatgctcagcgcctcgggccgccatgccgaagccgaaacctggctccggcgtgccctcgaaggcggcaacctgaacttcctgcgcagtgcccgccatggcctggagcagtcggcccacccgccattccgcagcctggcgctggcctactaccgacgcgcggcgcagttgggcgacgacatcgatcgagaggctctggaacaggcgctcgaacgtcatgggcacgcgcaactgcccgtctga

SEQ ID NO: 52886 - protein, 271 aa, Pseudomonas aeruginosa PAO1
MRHLLLRHDALDAEGFAAQLAGTPGEVAQAILGAAREGLTEAQALLGQILLDGQGIQRDPTLARTWFTIAAERGHAMARNMLARCLEHGWGGPADPAAAAVHYRIAAQAGLDWARYNLANLHATGRGVPQDQPRAYALYRQAAEQGHAKSMNLVGRYHEEGLVVARDLAQAAHWYRRSAEGGDFRGQFSHAAMLSASGRHAEAETWLRRALEGGNLNFLRSARHGLEQSAHPPFRSLALAYYRRAAQLGDDIDREALEQALERHGHAQLPV

SEQ ID NO: 52887 - DNA, 597 bp, Neisseria meningitidis MC58
  CDS (1)..(597): transl_table=11
atgaaacagacagtcaaatggcttgccgccgccctgattgccttgggcttgaaccgagcggtgtgggcggatgacgtatcggattttcgggaaaacttgcaggcggcagcacagggaaatgcagcagcccaatacaatttgggcgcaatgtattacaaaggacgcggcgtgcgccgggatgatgctgaagcggtcagatggtatcggcaggcggcggaacaggggttagcccaagcccaatacaatttgggctggatgtatgccaacgggcgcggcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagacgcggcgtgcgccaagaccgcgcccttgcacaagaatggtttggcaaggcttgtcaaaacggagaccaagacggctgcgacaatgaccaacgcctgaaggcgggttattga

SEQ ID NO: 52888 - protein, 198 aa, Neisseria meningitidis MC58
MKQTVKWLAAALIALGLNRAVWADDVSDFRENLQAAAQGNAAAQYNLGAMYYKGRGVRRDDAEAVRWYRQAAEQGLAQAQYNLGWMYANGRGVRQDDTEAVRWYRQAAAQGVVQAQYNLGVIYAEGRGVRQDDVEAVRWFRQAAAQGVAQAQNNLGVMYAERRGVRQDRALAQEWFGKACQNGDQDGCDNDQRLKAGY

SEQ ID NO: 52889 - DNA, 1404 bp, Neisseria meningitidis MC58
  CDS (1)..(1404): transl_table=11
atgaacaatcccgacttaccctatcggcaggccttagaatgcctgtctcaaaaacaatataactttaccgaagtccgccgactgctgacagaagcgttctcggcaggtcatcccgccgccgcattcgagttggcaaaacacctgatggacgcggacagcccctaccaagaccgcgaacaaggtatggaaatgctccgcatcgccgctgaacagggacatccctacgcgcgttacaatctggcatatatccaagaattggaaggcgcacccccggaaaccctgataccgctttacagaccgttggcagaagaaggactgcccgaagcgcaagtccgcctgatgtaccttctgtacgcgtcccgacattttgaagaagccttggaatgggcaaaaacaagcgcaaaaaacaacaacccccacgggcaatacctgcttgcccaatactgccggtacggcacaccgccggattttgaaacggcgcacctgctctaccgaaaatcggcggcacaaggcttgccggaggcacattggcagctcgggctgcaatatcgtttcgggcaagggacgaaagtcgacacggcacaggccgtcaatcatttgcgcgccgccgcacaacaaggatacattcctgcctacaccccacttgccgagctcatcctacctacggctcctgatgaagccgttcactggtttcaacaggccgcacaggaaaatgaccccgatgcccatgccgcacttgccgacatctacctgcaaggcaagcatctggaaagaaaccacaaacttgccctgcatcatgccgaagcagccgccgccgaacgccatcccgaaggtttgcggatactgggcgacatctgccgctacggtttgggcatagcccccgatacggaaaaagcccggcattattatcggcaggcagccgaagccggcagcctttccgcctatcagaaactcatatccgacagcgcgttaaaccatcctgaccaatacggcggcattaaagattccgccatcaggcggcaaagggcagaacggctttatcaaaaagcccaagccctgcattacggattacaatgcgcgcccgaatacgcagccgcgctcaaactctacacagaagccgcagaactcggacacagcaaagcccaaaccaatctgggcagcatgtattacttcggacagggtatgaccgccgactacaatgaagcacgcaaatggtttgaaaaagccgccgcgaaaaaagacagtatggcgttctacaacctcgcctgcatccattacagcggacacggcgtcgagccggacaaagaaaaagcctgccgctacctgcaagaagccataaacaacggatacgggcaaaaaagcgtcctgcaagaactgctgcaacaatggcaaaatgccgtctga

SEQ ID NO: 52890 - protein, 467 aa, Neisseria meningitidis MC58
MNNPDLPYRQALECLSQKQYNFTEVRRLLTEAFSAGHPAAAFELAKHLMDADSPYQDREQGMEMLRIAAEQGHPYARYNLAYIQELEGAPPETLIPLYRPLAEEGLPEAQVRLMYLLYASRHFEEALEWAKTSAKNNNPHGQYLLAQYCRYGTPPDFETAHLLYRKSAAQGLPEAHWQLGLQYRFGQGTKVDTAQAVNHLRAAAQQGYIPAYTPLAELILPTAPDEAVHWFQQAAQENDPDAHAALADIYLQGKHLERNHKLALHHAEAAAAERHPEGLRILGDICRYGLGIAPDTEKARHYYRQAAEAGSLSAYQKLISDSALNHPDQYGGIKDSAIRRQRAERLYQKAQALHYGLQCAPEYAAALKLYTEAAELGHSKAQTNLGSMYYFGQGMTADYNEARKWFEKAAAKKDSMAFYNLACIHYSGHGVEPDKEKACRYLQEAINNGYGQKSVLQELLQQWQNAV

SEQ ID NO: 52891 - DNA, 1407 bp, Neisseria meningitidis Z2491
  CDS (1)..(1407): transl_table=11
atgaccgccgctcctgatatcctctaccggcaagccgccgcccttttggaacaatccaataccgcccaagccctgcccctgttgcaacaggcggcagagcaaggttatgcggaagctgctttcgtattgggcaaccatctgctgcaaaacggccaaccggagcaggcactttcatggttggaagccgccgcggcccaacgccatcccaaagcactcttctccctgctgcaacaacgcgaacacaacggcaccccgaccggacagcttctcaacgactatgcctggctgggtgagcaggggcactcagaagcccaattaatcctcatgcgttaccacgcgcaacgcaacgatccacaatcgctctactgggcggaacttgctgccgcccgatatgccgcacctgcgtattaccatctggcacgccatcatcaacgccaaggcgacgttgaaacagccatcgaacaatacgaaaaagcggcagcactcggcgtaactgccgcctgctggcaacttggtcaaatctacttctacggtacaggtgtcagccccaaccacgcacaagccgaacactatctcgaaccagccgcacaagccggccacatcgccgcacaaacgctgctggctgaccttcttgccgcccaacgcaaacctgaagccttggaatggtatcgtcgtgccgccgataaggaacaagcggaagcacagtctaagctggcccaatacgccctgaccggcgaactttccgaacgcgatccgttccaagcggcacgatatgccaaagccgctgccgagaaagaccatcctgaagccctgaaaatcatgggcgacctctaccgctacggcctcggcatcaaagctgacaaccatatcgcgcacgattactaccaccgtgctgccgcgctgggttctgccgccgcagcacaaaaactcatcagcgacgccgcgctgtaccatccgcaacaatacgaacaaatcaaaactgccgccctgcaacagcaacaaaccgaaaccatctaccgtttggcggaagcacaagcctgcgccatcggccgtcccgccgactacaatgccgcgcgaaaaaattacatggaagctgccgggttccaccataaaaacgcagcggcagccttaggccgcatctaccattacggcctcggtacggcgcaagatcctcgggcggctgcacactggtacgccattgctgccgaacaaaaccacccttccgcccaataccacctcgcctgtttttactatcacgggcaaggtgtcggctgtcatgttccgaccgcctgctactggctgcaggccgccatcggcaacggccacacttcggccgaatcattaatatccctattagaacaatggcgacgcgaagcacaccatgccatcggacaaaaggccgtctga

SEQ ID NO: 52892 - protein, 468 aa, Neisseria meningitidis Z2491
MTAAPDILYRQAAALLEQSNTAQALPLLQQAAEQGYAEAAFVLGNHLLQNGQPEQALSWLEAAAAQRHPKALFSLLQQREHNGTPTGQLLNDYAWLGEQGHSEAQLILMRYHAQRNDPQSLYWAELAAARYAAPAYYHLARHHQRQGDVETAIEQYEKAAALGVTAACWQLGQIYFYGTGVSPNHAQAEHYLEPAAQAGHIAAQTLLADLLAAQRKPEALEWYRRAADKEQAEAQSKLAQYALTGELSERDPFQAARYAKAAAEKDHPEALKIMGDLYRYGLGIKADNHIAHDYYHRAAALGSAAAAQKLISDAALYHPQQYEQIKTAALQQQQTETIYRLAEAQACAIGRPADYNAARKNYMEAAGFHHKNAAAALGRIYHYGLGTAQDPRAAAHWYAIAAEQNHPSAQYHLACFYYHGQGVGCHVPTACYWLQAAIGNGHTSAESLISLLEQWRREAHHAIGQKAV

SEQ ID NO: 52893 - DNA, 162 bp, Escherichia coli O157:H7 EDL933
  CDS (1)..(162): transl_table=11
atgataatgattttcacgtcaagttgctgcgataatttatcaatagatgagattatcgaacgtgctgaaaaaggcgattgcgaggctcaatatattgttgggttttattataatcgcgatagcgcaattgactctccggacgacgaaaaggccttttactag

SEQ ID NO: 52894 - protein, 53 aa, Escherichia coli O157:H7 EDL933
MIMIFTSSCCDNLSIDEIIERAEKGDCEAQYIVGFYYNRDSAIDSPDDEKAFY

SEQ ID NO: 52895 - DNA, 588 bp, Escherichia coli O157:H7
  CDS (1)..(588): transl_table=11
atgtcttatgcgcaaaataatcttgggtggatgtacagaaatggcaacggagccgcacaagactatacgctggcatttttctggtacaaacaagctgcattacaaggccatagtgacgcgcaaaacaatctggccgatctttatgaagacggaaaaggcgttgctcaaaacgagacactcgccgcattctggtatttgaaaagcgcacagcagggtaatcggcatgctcagtttcaaattgcatgggattataacgctggcgaaggggtggaccaggactataagcaagcgatgtactggtatctgaaggctgccgctcaggggagcgtcggcgcttacgtcaacatcggttatatgtataaacacggacaaggcgttgagaaagattatcaggctgcctttgaatggtttacgaaagccgctgaatgcaatgacgccactgcctggtataacctggccattatgtatcactacggagaaggaagacctgtcgatctccgacaggctctcgacctgtatcgtaaagttcagtcatccggaaccagagatgtcagtcaggaaattcgtgagactgaagatttactgtag

SEQ ID NO: 52896 - protein, 195 aa, Escherichia coli O157:H7
MSYAQNNLGWMYRNGNGAAQDYTLAFFWYKQAALQGHSDAQNNLADLYEDGKGVAQNETLAAFWYLKSAQQGNRHAQFQIAWDYNAGEGVDQDYKQAMYWYLKAAAQGSVGAYVNIGYMYKHGQGVEKDYQAAFEWFTKAAECNDATAWYNLAIMYHYGEGRPVDLRQALDLYRKVQSSGTRDVSQEIRETEDLL

SEQ ID NO: 52897 - DNA, 3645 bp, Agrobacterium tumefaciens str. C58
  CDS (1)..(3645): transl_table=11
atgagccagaagtttccgcgtgagccgcgcgctgcgagctctcagccggaaccgaaaaacgaggcctatgctgcgccgcgcgagccccgcgccgccgtcacaccgccgcagctcgatcccgtcaacgaaatccggcagcgccagcgtcttctcgaagcgagcttccagcgtccgcaggaacccgttgcccgcccggaacggacgattacccggccgctcgcaccggaatatggttcaagggacacgcagcaaacggccgctcccgcgccgcgtgcccgcgccattccgccctatcaggaacagcagcgcaatgatgcagccctgcaggagatcgcgcaggcgctggtcaaccttcgccatgagctgaaacacgatattgccgagggcgttgcccgcgaagcgcaggggctgcgtgccgaaatccgcaatattcgcgcggtggcggaagaccagcaattcatcggcgatctgcgcgacgacatcgcacgtcttgccggcagcatcgaccagctcggcaatctggcatctcctgacgcctacgggttgcgtaacgaattcgaagacctgcgcctgacgatcgaccagcttgcgcgcgaagacagcgtgcaccggatcgaaagccgctggaacaatgtggaggacacgctgcgcggtttcgatgcggcctcgctgcaggatgagatcgtttcactcgcctatcgtctcgatgacatcaagacgcaacttggcggtatgagcaacaatcccgccgtgcgcgtgcttgaggaaaagctcatcaccattgccagcgccgtggagcagcttggcaagcacatgcagcccaacgaggccgcctttaccgaacagttttccggtctcgaccagcggctggacgaaattagccgcgccattgccgcaaccggcacccgcgccaacgctcaggccacggacaacgcgctggcgcagcggctggaaacccggctgaacggccttgccgaacagctcggcgacatcaaccgcctcgccgccatcaagccggaaccggcgcccgaccttaccgcccgcctcgaagcgctctccggcaagatcgatgagctgagcaccgcgcgcgacgccgcgcaactgcatgaccggctggaccagctttccttgctgctggaacggtcgcagcgccccacgcagcaggcggaactgacatctttcctcagcgatatctcccgcaagatcgatgcgctggatcacggcgctatcaatgacggcctcgccgaacggctcgacctgctctcccggcggatagaagatctcgattatcgctacagccagccgcaaccggcttcgggtctcagcgacagcgctttttcccgtctggaagaacggctcggcacgatcgccgcccgcctggacgagaccgcccatgccgctcctgccgatagccgcgctctggcaagcctcgaaaaccagatcgcccatctgtcgacgctgatcagccagccggtgcaggtgcaggcggccggcatatctccggaactcgacgtccgcatggcggcgatcgaagactacatggcgtcgaacgacgaatatatcatcgaagcggcgcggcaggcagccgaggccgttctcgacgcctatacccgcaacaatctctcggccggcgcaaacctcgccgacatgacgatgctgaccgatctcgccaccgatctgcgcagtctcgaagccttgagccgcaacaccgaagagcgcacgcaccgcaccttcgaggcgctgcacgagacgctggtgcagattgccggccgtctggacaatctcgacagcgcgcccgcctatcgccaagacgctccccgtaacgtcgcgcagcacatggttgccgccagccgcgaagacgcggccatgccggccgccgttttcccggcagacggctatatcgccgaagagcaggccattctcgatgatgtcagcgaaaacgatgcgaccgcgatcgtaccgccggctgccgccaagcccgcaaaagcggaacggaagagcctgctcgccggcctgacgaagcgtttcaagacaagcacggcgaagcccgcaaaggccaaggaagaacccgtatcggcctcctccgcccgcacgcaggttgagcccgccccgtcgctcgatccgatcgacgttctgcctgctggccaggagaatgaacttctggaaccgggctcgggtgcgcccgatatcaagaaaatcctcgaacgtgtgcgtgccagccaggtcgcaggcgccggcaaggccgcggatgcggaaggacggacggatttcatcgccgccgcccgccgcgccgcccaggccgccgccatggagacatcgccggagaagctggataccggcaagaagagccgcaaggccgacacgtcggcactttcgcgttatcgtcggccgctgctgctcggcatcggcgccattcttctggcgatgatggccatgccgctcgtcaagacgctgatcggcggcgctgaagcgccggcaccggtcatagagcagaagacggaccagggcccggtctccgcgcttcccgaaaccgacgataaggccgtgaccattccctccggtcttgccatcgatccggaacaggctgcctcggcagacagcatcgaaaacgccgcaccggcgcagaacatcattgacaatcgcaccatcggcggcgcgccgttgccggacgagccgccggttgccgatgttcccgccgtggaccccgcaaagtccgacaccgtcgcgcagaacgaaggaccgaaaccgactgaggtcgccaccacgactattcctgcgcaggacaccattgtggttccggccggcatcgagcccgcatcgcttgccgaagcggccgccaagggcgacacgcaggcgctgttcgagattgcggcacgctacaccgacggccgcggcgtaaccgccgaccgtgcggaagcagcaaagtggtacaagatggcggccgatcgtggccttgcccccgcgcaatatcgtctcgccaatctttacgagaaggcgaatggcgtcgagcgcaatcttgtcgaagcgaagcgctattacacgctggctgccgaacagggtaatgccggcgccatgcacaatctcgcagtcctgctcgcctcagacgcggccggccagccggatttcgccacctctgcacaatggttcatcaaggcgtccgaactcggcgttcgtgacagccagttcaacctcgccattctctacgcccgtggcagcggcgtgaagcaggatatcgaggaatcctacaagtggttcgccattgccgccaaggatggcgatgctgatgccgcccagaagcgcgacgaggttgcaggcgcgatgagcccgcagcagctgcagagcgccaaggccaaggtcgatgcttggaaggtgaagccgctctcggacgacgccaacagcgtcaacccgcctgaggaatgggccggcaaagagggcgtgaagaccgcctccgtggacatggaaaaggcgatccgcaacattcaggcgatcctgaacaagaacggtttcgatgccggccagccggatggcaagcttggcaagaacacggtgacggccatcagggacttccagaaatccgtgggccagacgccggacgggcgtatcaccaacgacttggtgaccgcgctgctcgcccgcaacaaataa

SEQ ID NO: 52898 - protein, 1214 aa, Agrobacterium tumefaciens str. C58
MSQKFPREPRAASSQPEPKNEAYAAPREPRAAVTPPQLDPVNEIRQRQRLLEASFQRPQEPVARPERTITRPLAPEYGSRDTQQTAAPAPRARAIPPYQEQQRNDAALQEIAQALVNLRHELKHDIAEGVAREAQGLRAEIRNIRAVAEDQQFIGDLRDDIARLAGSIDQLGNLASPDAYGLRNEFEDLRLTIDQLAREDSVHRIESRWNNVEDTLRGFDAASLQDEIVSLAYRLDDIKTQLGGMSNNPAVRVLEEKLITIASAVEQLGKHMQPNEAAFTEQFSGLDQRLDEISRAIAATGTRANAQATDNALAQRLETRLNGLAEQLGDINRLAAIKPEPAPDLTARLEALSGKIDELSTARDAAQLHDRLDQLSLLLERSQRPTQQAELTSFLSDISRKIDALDHGAINDGLAERLDLLSRRIEDLDYRYSQPQPASGLSDSAFSRLEERLGTIAARLDETAHAAPADSRALASLENQIAHLSTLISQPVQVQAAGISPELDVRMAAIEDYMASNDEYIIEAARQAAEAVLDAYTRNNLSAGANLADMTMLTDLATDLRSLEALSRNTEERTHRTFEALHETLVQIAGRLDNLDSAPAYRQDAPRNVAQHMVAASREDAAMPAAVFPADGYIAEEQAILDDVSENDATAIVPPAAAKPAKAERKSLLAGLTKRFKTSTAKPAKAKEEPVSASSARTQVEPAPSLDPIDVLPAGQENELLEPGSGAPDIKKILERVRASQVAGAGKAADAEGRTDFIAAARRAAQAAAMETSPEKLDTGKKSRKADTSALSRYRRPLLLGIGAILLAMMAMPLVKTLIGGAEAPAPVIEQKTDQGPVSALPETDDKAVTIPSGLAIDPEQAASADSIENAAPAQNIIDNRTIGGAPLPDEPPVADVPAVDPAKSDTVAQNEGPKPTEVATTTIPAQDTIVVPAGIEPASLAEAAAKGDTQALFEIAARYTDGRGVTADRAEAAKWYKMAADRGLAPAQYRLANLYEKANGVERNLVEAKRYYTLAAEQGNAGAMHNLAVLLASDAAGQPDFATSAQWFIKASELGVRDSQFNLAILYARGSGVKQDIEESYKWFAIAAKDGDADAAQKRDEVAGAMSPQQLQSAKAKVDAWKVKPLSDDANSVNPPEEWAGKEGVKTASVDMEKAIRNIQAILNKNGFDAGQPDGKLGKNTVTAIRDFQKSVGQTPDGRITNDLVTALLARNK

SEQ ID NO: 52899 - DNA, 993 bp, Caulobacter crescentus CB15
  CDS (1)..(993): transl_table=11
gtgacgcttcagcggtgtgaggcattgatgcgtttgggttggttgatcgcgctgatcgtcgcgggcctttggcccgatgactcggcgcgcgcccaggactggcgctcccagaccgactgcgctgctgtcgaacgggcggcggaggggggcgacacgtccttctatgtcgatctggcgatctgtcacattcggggcgaggggcgcgagccggatgtcgctaaggggctggtctggcttcggaaggctgtggcgctcggcgataccgacgcgatggtcgagctcgggaatctctacctcttcggcgcggaagggctggcggttgacgcccctggcgccgtgaagctctacgcgcgggcggcgcgtctgggcgatccgaacgccatgttcaacatggccgtgatgcaccggggcggatacggattgcccgagaacccgcgtctggcccgcgcctggtatctgcggtcgggtgaggccggattggccgctggcgcgttcggcgcaggcgtcgccctgttggaagggtatggcgggcgctcggacgccagacggggcgttctttggctgcgccgcgctatcgagatgggctcggccgaggccatgaacgaactaggtcgacttcacgccgaggggttgggtgtgtcctcggactccgacaaggcgctctacttctaccgcgccgcggcgcggaacgagctgccggacgcgatgtatcgattgggcgcggcccactacaatgggcggctgacggacagaaactatgttgtggcgatgcgctggttccagttggcggcggaccggggcgactacgacgcctggtttgccctgggcgtgatgtgcgagacgggtcgcggcgtgaagtctgatcgggagctggcgcttcagatgtatcgacgagcggccgacagcgaccagcccgccgtccgcgacaaggcgcaaagagcgatcgaccggctgctcggcttggccgaggatgacgaggacccggtgggttag

SEQ ID NO: 52900 - protein, 330 aa, Caulobacter crescentus CB15
MTLQRCEALMRLGWLIALIVAGLWPDDSARAQDWRSQTDCAAVERAAEGGDTSFYVDLAICHIRGEGREPDVAKGLVWLRKAVALGDTDAMVELGNLYLFGAEGLAVDAPGAVKLYARAARLGDPNAMFNMAVMHRGGYGLPENPRLARAWYLRSGEAGLAAGAFGAGVALLEGYGGRSDARRGVLWLRRAIEMGSAEAMNELGRLHAEGLGVSSDSDKALYFYRAAARNELPDAMYRLGAAHYNGRLTDRNYVVAMRWFQLAADRGDYDAWFALGVMCETGRGVKSDRELALQMYRRAADSDQPAVRDKAQRAIDRLLGLAEDDEDPVG

SEQ ID NO: 52901 - DNA, 735 bp, Sinorhizobium meliloti 1021
  CDS (1)..(735): transl_table=11
atggccgaggccctggcacgcgcccaagccggcgactacgggtcggcgctgcgcatctgggagcctctggcgcgtgccggcgtcgcgcgggcgcagaacaatatcggcgcctgcttcgcagaagggctcggagtgccggagaatcgagaactggcgtgcaaatggctgcgccttgcggccgaagccggggatcccgtcgggcaacgcaactatgccgccctgcacatgcaagggctcgccggcaccgatgccgactacggcatcgcagccgaatattatcgacgcgccgctgaaaagggcgacgcgccggcccaggacatgttgagctggctgctgctggaaggcgagatcatgacggccgacccgctcgaggcgcgacgctgggcggaatgtgccgccgaggccggcatcgcgtcctcgatgacgcggctcggcatgctccaccacaacgcactcggtgtcgaacgcgatgcgcaaaaggccgtctactggtggctgaaggctgcagagaggggcgacgcagacgcccaggccatgctgggagcggcctgccatatgggggcgggcacgatacgcaatggtgtgactgccttggtctggctgatccgggcgacggaaggcggcagcaccctggcaaagcccttcatgggaccggttcgtgacagcctttcgccggcggagatccaggaagcggaacgtcgggcgcaagagccgctttcaaggcgggcgccatga

SEQ ID NO: 52902 - protein, 244 aa, Sinorhizobium meliloti 1021
MAEALARAQAGDYGSALRIWEPLARAGVARAQNNIGACFAEGLGVPENRELACKWLRLAAEAGDPVGQRNYAALHMQGLAGTDADYGIAAEYYRRAAEKGDAPAQDMLSWLLLEGEIMTADPLEARRWAECAAEAGIASSMTRLGMLHHNALGVERDAQKAVYWWLKAAERGDADAQAMLGAACHMGAGTIRNGVTALVWLIRATEGGSTLAKPFMGPVRDSLSPAEIQEAERRAQEPLSRRAP

SEQ ID NO: 52903 - DNA, 996 bp, Salmonella typhimurium LT2
  CDS (1)..(996): transl_table=11
atgaatcattccataaccagtcatccctgcgacaacgtatctttagcacaattaaccgaactggcgcagtcaggaaatagtgaagctcaatatatattaggccgtttatataatgacgaacgtatagatggcagcgaagaggataagctctctttttattggttgcagcaggcagctgaacaaggacactgcgaggcacaatattggctcggcttacgatacaaagacacgcctaccgacatgaaagataatacgctggctttattctggtcagaaaaagccgcacagcaaggacaccgccacgctttcaacacattaggctgggttcaggaaggagaaaccgggatggcgccagattatgcccaggccgttgcctggtatcgcaaaggagcagaacagagccacaaccttgcgcaatataatctcgggagaatgtatcattcaggaactggcgtagagcaaaatgatacacaggcactctactggtttaaacaggcagcattacaaggccattgcgccagccaggaaagactggcgtatatgtatggcaatgggaaaggatgtcggaaaaatttatcccttgccgccctttggtacaagaagagcgcgctacaagagagcagctactcgcaatatcagatgggctattgttattacatcggaaaaggtatcaaacaagattaccagcaggcaatatactggtttcgaaaagcggcagaccagggtgacgatgatgcctataacagtatcggctggatgtacaaatgcggtcatggcgtcgagcaaaattattcgctagcactggaatggttccacaaatcagcagaatgtaacaattcatcgggctggtacaacctcggatgcatgtacagagatggacacggtaccgcacaagacctacaacaagcgctctactggttcaaaaaagcacagcccacgggcaaatggaacgtcgatgaagagatccgcaaactggaagcccaactgcacgcttaa

SEQ ID NO: 52904 - protein, 331 aa, Salmonella typhimurium LT2
MNHSITSHPCDNVSLAQLTELAQSGNSEAQYILGRLYNDERIDGSEEDKLSFYWLQQAAEQGHCEAQYWLGLRYKDTPTDMKDNTLALFWSEKAAQQGHRHAFNTLGWVQEGETGMAPDYAQAVAWYRKGAEQSHNLAQYNLGRMYHSGTGVEQNDTQALYWFKQAALQGHCASQERLAYMYGNGKGCRKNLSLAALWYKKSALQESSYSQYQMGYCYYIGKGIKQDYQQAIYWFRKAADQGDDDAYNSIGWMYKCGHGVEQNYSLALEWFHKSAECNNSSGWYNLGCMYRDGHGTAQDLQQALYWFKKAQPTGKWNVDEEIRKLEAQLHA

SEQ ID NO: 52905 - DNA, 1530 bp, Salmonella typhimurium LT2
  CDS (1)..(1530): transl_table=11
atgcgtttttcatcaattttcaaaataataatattaaatatatttatttcaaaaatggctcacgctgctgtctgcgaggagcgctatcccgccgactcagaagaatgccagtacgttcaggaattagagcaaaaagcggaacaaggagatgaaagcgcgcagttctcgcttggaagctggtatgcggaggggcgatacgttaagcctgattataaactagccataaaatggctggagaaagcgggtaaacaaggttctgatttttcctatttcatccttggctatcattacaactatggtgaaaattttccacttagtcgacaaaaagcgctggagtggtatcgcaaggcggcagagctaggggatagtagtacgcaagaaatcctcggtgacgcctatatgtatggcgatgggtttccccaaaatacccagctagcgctggagtggtatcgaaaagccgcctctccaaccaatgatgcgggcgttgtccgcggacagggttcagcttcgtcagcacaatttaagcttggagtaatgtacgcccacggtcagggcgttcctcaggattatcagcaaacggcgatcttgatgcgtaaagcggcggaaaatatgtactaccccgcgcaactttatctcggcgttgcctatttttatggtgaaggcgtgcctcaggattatcgtcaggcagtttactggcttaatgaaggtataccaggcagctatacgccaggccacattccgctgaatgcgctctatgataaagcgcatcccgctgaccgggttcactctcagacgtggtatcgaaaaacagcgcaacgcgtgatggcaaaggtacagtacaattttggcgtatggtattacaacggttatcacttattgaaagatcacaacctggcgctggagtggtatcgcagagccgcagcgcaaggattggccgaggcgcaggatgcgatcggcgtgatgtttatgcagggtgagggcgtttctcaggactaccaacaggcgctggcgtggtatcgcaaagccgctcgccaggggctgcctgctgcgcaaacgcatctgggcatcatgtctgcatttggtcgcggcgtcgcgcaaagcgacagacaggctatcgcatggtatcgaaaagcagcaaaacaggattttgcgaaagcgcaatatcagcttggcgtagcatatagcacgggaagaggcgtgcctgaaaatagccggaatgcgctgaagtggtacctcaaagcggcagagcaggggtttactccggcacaatcagcgcttggggaaatttatgctcatgggcgccagggtgtgcctaaagataataagcaggcctatatttggtattacatggcaagtatgtatacggaaaaatctaaggatgattgttcagcgctcattgccgaaagaaaccgactcaagggaacgctcaccccagatcaacttagcgagacatatgccgcctttaatctcatctggcgaaaaattgatcagtcaaaggaggcgaaaaagattgccaggaagaagtattga

SEQ ID NO: 52906 - protein, 509 aa, Salmonella typhimurium LT2
MRFSSIFKIIILNIFISKMAHAAVCEERYPADSEECQYVQELEQKAEQGDESAQFSLGSWYAEGRYVKPDYKLAIKWLEKAGKQGSDFSYFILGYHYNYGENFPLSRQKALEWYRKAAELGDSSTQEILGDAYMYGDGFPQNTQLALEWYRKAASPTNDAGVVRGQGSASSAQFKLGVMYAHGQGVPQDYQQTAILMRKAAENMYYPAQLYLGVAYFYGEGVPQDYRQAVYWLNEGIPGSYTPGHIPLNALYDKAHPADRVHSQTWYRKTAQRVMAKVQYNFGVWYYNGYHLLKDHNLALEWYRRAAAQGLAEAQDAIGVMFMQGEGVSQDYQQALAWYRKAARQGLPAAQTHLGIMSAFGRGVAQSDRQAIAWYRKAAKQDFAKAQYQLGVAYSTGRGVPENSRNALKWYLKAAEQGFTPAQSALGEIYAHGRQGVPKDNKQAYIWYYMASMYTEKSKDDCSALIAERNRLKGTLTPDQLSETYAAFNLIWRKIDQSKEAKKIARKKY

SEQ ID NO: 52907 - DNA, 1695 bp, Salmonella typhimurium LT2
  CDS (1)..(1695): transl_table=11
atgcccctcccctatgacaaagagaaaaaattatggaaagtcaccggctggtatctggaatcctcagaagaaacaggggaggtgatgcagagtaaacagatagcctttgaaggctataccaacgaagaaaacttcgctaaccgacaacgtgtttctgtatttaaatctttctatgaaagcggcaatctcaaaagtatttatcattataatgcgcaaaataagcgtgacggaaaagctgaaacttactttgatgaaaaagacaaaatagcggaaacgctgacgtttaaagatggtcaacccgaaggggaatacatcgtataccatgaaaacggagccgttgaaagtaaacgttactttgcccaaggtaaaattaaagatggcgaatgcccacatttttatgataacggcgttttaaaacaaaaacacagctatttaaatcagaaactggaaggcccggcatttgaatatttccctgatgggaaaataaaggggaaatattcatacagtaaaggcaccattgtcggcaccagtacggaatattattctaccggtaaaattcgtggtgtttaccacagaaataaccaaggtgaaaacgacggaacgttcgaacaatacagtgaagagggcaaactcctttctaaagcgacctataaaaatggcaaacagctttctgctcagagctggtatgaaaatgggcatcccaaagaagaatcctcttttgatagtgaaggccgtaaacatggtgcggtcaaagaatggttcagcaacggaaagcctgcctcatccaaaatgtataaacatgatgtgttagacggggatttcgaaaagtggtacgaaaatggtcaccgcgaatcagtctatccctataaaaacggtatgctaaatggggacgctaagcactggaatgaacagggcaaactcacctataccaccgaatataaagacgataaaaagcagggagccgatcgccgctggagcgaacgtaccggtaaacttgttgaagaggttatgtttgctaatgatgaaagaaacggcctgaaaagagagtttaacgatcgtacgggtaaggtcttaagtgcgctgccctatgtcgatggcgacaaggaaggtacagaagaagcctatgatgaagacggcataaaatacatccgttgttaccacaacgatgaagagctttcagagctatatgcgccgactgacgtcaccaataaggcaaagcagggtgacagcactgcgcaatatcatttaggtaagtatgagtttgaatgcacaaactacgatgcggcgatgaaatggttaactcagtccgcagagcaaaatcatcccggcgcgcttctctttttggcctatgcgtacaacgacggtgatggcgtagcgcaagacagtaaaaaatatctctcctatttattcaaagcggcagagcttggcgaaagtgatgcgcagttagaagtgggatatttaaatcttatcggcgaaggaatgccgaaaaacctgccggaagcctataagtggattaaaaaatccgctgaccagggaaatgctcaggcgcactataaccttggactcatgtacaggaatggtgatggcgttgagaaagacctcaacaaagccaaacttcatcttacagcggcggtaaaaggcggcgtcaaacctgcactggcagccttaaaggaattaacgcctcaaactaagtaa

SEQ ID NO: 52908 - protein, 564 aa, Salmonella typhimurium LT2
MPLPYDKEKKLWKVTGWYLESSEETGEVMQSKQIAFEGYTNEENFANRQRVSVFKSFYESGNLKSIYHYNAQNKRDGKAETYFDEKDKIAETLTFKDGQPEGEYIVYHENGAVESKRYFAQGKIKDGECPHFYDNGVLKQKHSYLNQKLEGPAFEYFPDGKIKGKYSYSKGTIVGTSTEYYSTGKIRGVYHRNNQGENDGTFEQYSEEGKLLSKATYKNGKQLSAQSWYENGHPKEESSFDSEGRKHGAVKEWFSNGKPASSKMYKHDVLDGDFEKWYENGHRESVYPYKNGMLNGDAKHWNEQGKLTYTTEYKDDKKQGADRRWSERTGKLVEEVMFANDERNGLKREFNDRTGKVLSALPYVDGDKEGTEEAYDEDGIKYIRCYHNDEELSELYAPTDVTNKAKQGDSTAQYHLGKYEFECTNYDAAMKWLTQSAEQNHPGALLFLAYAYNDGDGVAQDSKKYLSYLFKAAELGESDAQLEVGYLNLIGEGMPKNLPEAYKWIKKSADQGNAQAHYNLGLMYRNGDGVEKDLNKAKLHLTAAVKGGVKPALAALKELTPQTK

SEQ ID NO: 52909 - DNA, 2058 bp, Caenorhabditis elegans
  CDS (1)..(2058)
atgattaaaacctatctgacactgttgctactagcaacctcggccacgtgtcaaaaaaagtcagcgactctggtatctgcggaaggagaagcgcctgcaataaaagtgataaaaaccacaggctcgttactcactgcaattgatgtgtcgaaagctgatttggactgggaacaggtcacatcacagcaagatgagaataagagcaatcgagaaattccaaaagtaataagcgaggagtacttggctgaaaaagtagaacaaccaccaagccctgaagctgaagctgagtttcaacgcggaatggcttatattgaaagaggaaaaggtcatggaagagaaggaagagttgcagctcatagagtatttgaaagagcagccgcacaaggtcatcaagaagccagaaaagctgtagcgttctcacagatgttcggagattattcccgttggtccattcaggaagccaagacagttttcgaagatctcgaaaaaaacggctcaccagatgctcaacttgcattaggattcatgcatggagccggaatcggagtggaaaaatcgaatcaagcaaaagctcttgtatattatatgttctccgctctcggaggaaatcctcttgcccaaatggctatgggcttccggtatagtcacggagttggagtgccacaaaactgcgaaactgcactttcatattatcaaaaagttgcaaaaactgtagtggataatgttaaattcacaactggacagacaattcaacgattgagactaaccgacgaaacagatccaacaatccatatgcaaccaggaagtgcaccactggagagtaatcttcttgagtattacaagatgcttgccgacaaaggagatacatccgctcaattgggactcggacagatttatttagctggtggacgagggctcaatcaaaatttcgaactcgccttccgctacttgttagctgctgctgagtcaggaagtgccgatgcattgacatatctcggaaaaatgtatttggatggaactccgtttacgccaaaagattatcaaaaatcattcgaatatttgatgaaatcagctgataaatctagtcctagtgcacaggctgtattgggagcaatgtatatgaaaggaaaaggagtcaagaagaattacgaaaaggctttgaagttgctgacattgtcggctgataagaagaacgccgatggacaaatgtatttagcagaattacattacaaaggtgttccaaccaacaaaggagtgcatcgagatttcaagaaatctgtgaaactttaccagcttgcttctcaaaatggacatattcttgcctactataatcttgctcaaatgcacgctgctggaacgggagttccacgttcatgttcccacgcggttgatcttttcaaatctgtagccgaacgaggaaaatggggagaacgattgatggaagcccatagcgcatataaagataatcgagttgatgaggccgcaatgaaatatttattcatggctgaacttggctatgaagttgctcaaactaatctagcctatattttggatcgtggagaagcgacgtcattgttctcgggaccgaaagataacaatatggaaagagcgttcctcaattggcaaagatctgcaaatcaagaatatgctgctgctcgcgtgaaacttggtgattactactattatggtctcggtacagaagttgaccacagtttggcgttctcaaactataaaatggcagtcgatagacacggtgttgctcaagcaatgttcaatttgggatatatgcacgaagttggcgaaggaatcactcgggatctttacctggctaaacgtttctacgatcaagcaattgagcatagtcaggatgcatacatgccgtcgaaattagcattagcaaaactagcttttgtcttctatttggaagagctcaacaagctgccattaatcagttttatggagaaaaccgttggaccacgatgggatgctattttgatgaccgtttctgcattggttccattattcttgttctggaggcaccgacaaaatgataattga

SEQ ID NO: 52910 - protein, 685 aa, Caenorhabditis elegans
MIKTYLTLLLLATSATCQKKSATLVSAEGEAPAIKVIKTTGSLLTAIDVSKADLDWEQVTSQQDENKSNREIPKVISEEYLAEKVEQPPSPEAEAEFQRGMAYIERGKGHGREGRVAAHRVFERAAAQGHQEARKAVAFSQMFGDYSRWSIQEAKTVFEDLEKNGSPDAQLALGFMHGAGIGVEKSNQAKALVYYMFSALGGNPLAQMAMGFRYSHGVGVPQNCETALSYYQKVAKTVVDNVKFTTGQTIQRLRLTDETDPTIHMQPGSAPLESNLLEYYKMLADKGDTSAQLGLGQIYLAGGRGLNQNFELAFRYLLAAAESGSADALTYLGKMYLDGTPFTPKDYQKSFEYLMKSADKSSPSAQAVLGAMYMKGKGVKKNYEKALKLLTLSADKKNADGQMYLAELHYKGVPTNKGVHRDFKKSVKLYQLASQNGHILAYYNLAQMHAAGTGVPRSCSHAVDLFKSVAERGKWGERLMEAHSAYKDNRVDEAAMKYLFMAELGYEVAQTNLAYILDRGEATSLFSGPKDNNMERAFLNWQRSANQEYAAARVKLGDYYYYGLGTEVDHSLAFSNYKMAVDRHGVAQAMFNLGYMHEVGEGITRDLYLAKRFYDQAIEHSQDAYMPSKLALAKLAFVFYLEELNKLPLISFMEKTVGPRWDAILMTVSALVPLFLFWRHRQNDN

SEQ ID NO: 52911 - DNA, 759 bp, Ralstonia solanacearum GMI1000
  CDS (1)..(759): transl_table=11
atgggcaggcgaacgcagcagcacggcaccccgcgcaccaccaggatgacgctggccgcgatcatgctggcggccgccggatggaccgcgccggcccgtgccgccacctcgccggcggacgcccagggcgatgccgccgccctcacgcagatcgccatcgcgcactacgagcacaatgagttcggccgcgccatcgacgagttcgccgaagccgctcagcgcggcaaccgcctcgcccagttcaactacgcgatgatgctgatgcgcggcgaaggcaccgtcgcgcagcccgaggcggccgtcaaatggctgcgccgcgccgccgacaaccagatgacgcacgcgcagttcgcctacggcgagctgttcgagcgcggcgagctggtgccgcgctccctgccggaagccaacaagtggtacgagcgcgccgccgccggcgggcacatcgaggcgcagcgcgcgctggcgaccaactacttcaccggccgcggcgtgccgcgcgactacggccgcgccttcacctggtacaagaaagcggcggaagccggcgatgggccgtcgcaatacatcgtcggcagctactacgagcgcggcgagcccggcgtggtggcacaggacatcgaacaggccaagctctggtacggccgcgccgcggcacagggcgaccccggggcgctggccaagctgcgcgagctggtggagaagacctaccgcgccaagcacggcgatccgcccgcggccgcacgccccgccatgtag

SEQ ID NO: 52912 - protein, 252 aa, Ralstonia solanacearum GMI1000
MGRRTQQHGTPRTTRMTLAAIMLAAAGWTAPARAATSPADAQGDAAALTQIAIAHYEHNEFGRAIDEFAEAAQRGNRLAQFNYAMMLMRGEGTVAQPEAAVKWLRRAADNQMTHAQFAYGELFERGELVPRSLPEANKWYERAAAGGHIEAQRALATNYFTGRGVPRDYGRAFTWYKKAAEAGDGPSQYIVGSYYERGEPGVVAQDIEQAKLWYGRAAAQGDPGALAKLRELVEKTYRAKHGDPPAAARPAM

SEQ ID NO: 52913 - DNA, 3747 bp, Agrobacterium tumefaciens str. C58
  CDS (1)..(3747): transl_table=11
atgaacggattgcgatcgaaaacccaacagccaagcgacagatcgtctcttgatgcgctcaatcgcaccattgaaggccttgaagcccgtattgaagggctgatgagccagaagtttccgcgtgagccgcgcgctgcgagctctcagccggaaccgaaaaacgaggcctatgctgcgccgcgcgagccccgcgccgccgtcacaccgccgcagctcgatcccgtcaacgaaatccggcagcgccagcgtcttctcgaagcgagcttccagcgtccgcaggaacccgttgcccgcccggaacggacgattacccggccgctcgcaccggaatatggttcaagggacacgcagcaaacggccgctcccgcgccgcgtgcccgcgccattccgccctatcaggaacagcagcgcaatgatgcagccctgcaggagatcgcgcaggcgctggtcaaccttcgccatgagctgaaacacgatattgccgagggcgttgcccgcgaagcgcaggggctgcgtgccgaaatccgcaatattcgcgcggtggcggaagaccagcaattcatcggcgatctgcgcgacgacatcgcacgtcttgccggcagcatcgaccagctcggcaatctggcatctcctgacgcctacgggttgcgtaacgaattcgaagacctgcgcctgacgatcgaccagcttgcgcgcgaagacagcgtgcaccggatcgaaagccgctggaacaatgtggaggacacgctgcgcggtttcgatgcggcctcgctgcaggatgagatcgtttcactcgcctatcgtctcgatgacatcaagacgcaacttggcggtatgagcaacaatcccgccgtgcgcgtgcttgaggaaaagctcatcaccattgccagcgccgtggagcagcttggcaagcacatgcagcccaacgaggccgcctttaccgaacagttttccggtctcgaccagcggctggacgaaattagccgcgccattgccgcaaccggcacccgcgccaacgctcaggccacggacaacgcgctggcgcagcggctggaaacccggctgaacggccttgccgaacagctcggcgacatcaaccgcctcgccgccatcaagccggaaccggcgcccgaccttaccgcccgcctcgaagcgctctccggcaagatcgatgagctgagcaccgcgcgcgacgccgcgcaactgcatgaccggctggaccagctttccttgctgctggaacggtcgcagcgccccacgcagcaggcggaactgacatctttcctcagcgatatctcccgcaagatcgatgcgctggatcacggcgctatcaatgacggcctcgccgaacggctcgacctgctctcccggcggatagaagatctcgattatcgctacagccagccgcaaccggcttcgggtctcagcgacagcgctttttcccgtctggaagaacggctcggcacgatcgccgcccgcctggacgagaccgcccatgccgctcctgccgatagccgcgctctggcaagcctcgaaaaccagatcgcccatctgtcgacgctgatcagccagccggtgcaggtgcaggcggccggcatatctccggaactcgacgtccgcatggcggcgatcgaagactacatggcgtcgaacgacgaatatatcatcgaagcggcgcggcaggcagccgaggccgttctcgacgcctatacccgcaacaatctctcggccggcgcaaacctcgccgacatgacgatgctgaccgatctcgccaccgatctgcgcagtctcgaagccttgagccgcaacaccgaagagcgcacgcaccgcaccttcgaggcgctgcacgagacgctggtgcagattgccggccgtctggacaatctcgacagcgcgcccgcctatcgccaagacgctccccgtaacgtcgcgcagcacatggttgccgccagccgcgaagacgcggccatgccggccgccgttttcccggcagacggctatatcgccgaagagcaggccattctcgatgatgtcagcgaaaacgatgcgaccgcgatcgtaccgccggctgccgccaagcccgcaaaagcggaacggaagagcctgctcgccggcctgacgaagcgtttcaagacaagcacggcgaagcccgcaaaggccaaggaagaacccgtatcggcctcctccgcccgcacgcaggttgagcccgccccgtcgctcgatccgatcgacgttctgcctgctggccaggagaatgaacttctggaaccgggctcgggtgcgcccgatatcaagaaaatcctcgaacgtgtgcgtgccagccaggtcgcaggcgccggcaaggccgcggatgcggaaggacggacggatttcatcgccgccgcccgccgcgccgcccaggccgccgccatggagacatcgccggagaagctggataccggcaagaagagccgcaaggccgacacgtcggcactttcgcgttatcgtcggccgctgctgctcggcatcggcgccattcttctggcgatgatggccatgccgctcgtcaagacgctgatcggcggcgctgaagcgccggcaccggtcatagagcagaagacggaccagggcccggtctccgcgcttcccgaaaccgacgataaggccgtgaccattccctccggtcttgccatcgatccggaacaggctgcctcggcagacagcatcgaaaacgccgcaccggcgcagaacatcattgacaatcgcaccatcggcggcgcgccgttgccggacgagccgccggttgccgatgttcccgccgtggaccccgcaaagtccgacaccgtcgcgcagaacgaaggaccgaaaccgactgaggtcgccaccacgactattcctgcgcaggacaccattgtggttccggccggcatcgagcccgcatcgcttgccgaagcggccgccaagggcgacacgcaggcgctgttcgagattgcggcacgctacaccgacggccgcggcgtaaccgccgaccgtgcggaagcagcaaagtggtacaagatggcggccgatcgtggccttgcccccgcgcaatatcgtctcgccaatctttacgagaaggcgaatggcgtcgagcgcaatcttgtcgaagcgaagcgctattacacgctggctgccgaacagggtaatgccggcgccatgcacaatctcgcagtcctgctcgcctcagacgcggccggccagccggatttcgccacctctgcacaatggttcatcaaggcgtccgaactcggcgttcgtgacagccagttcaacctcgccattctctacgcccgtggcagcggcgtgaagcaggatatcgaggaatcctacaagtggttcgccattgccgccaaggatggcgatgctgatgccgcccagaagcgcgacgaggttgcaggcgcgatgagcccgcagcagctgcagagcgccaaggccaaggtcgatgcttggaaggtgaagccgctctcggacgacgccaacagcgtcaacccgcctgaggaatgggccggcaaagagggcgtgaagaccgcctccgtggacatggaaaaggcgatccgcaacattcaggcgatcctgaacaagaacggtttcgatgccggccagccggatggcaagcttggcaagaacacggtgacggccatcagggacttccagaaatccgtgggccagacgccggacgggcgtatcaccaacgacttggtgaccgcgctgctcgcccgcaacaaataa

SEQ ID NO: 52914 - protein, 1248 aa, Agrobacterium tumefaciens str. C58
MNGLRSKTQQPSDRSSLDALNRTIEGLEARIEGLMSQKFPREPRAASSQPEPKNEAYAAPREPRAAVTPPQLDPVNEIRQRQRLLEASFQRPQEPVARPERTITRPLAPEYGSRDTQQTAAPAPRARAIPPYQEQQRNDAALQEIAQALVNLRHELKHDIAEGVAREAQGLRAEIRNIRAVAEDQQFIGDLRDDIARLAGSIDQLGNLASPDAYGLRNEFEDLRLTIDQLAREDSVHRIESRWNNVEDTLRGFDAASLQDEIVSLAYRLDDIKTQLGGMSNNPAVRVLEEKLITIASAVEQLGKHMQPNEAAFTEQFSGLDQRLDEISRAIAATGTRANAQATDNALAQRLETRLNGLAEQLGDINRLAAIKPEPAPDLTARLEALSGKIDELSTARDAAQLHDRLDQLSLLLERSQRPTQQAELTSFLSDISRKIDALDHGAINDGLAERLDLLSRRIEDLDYRYSQPQPASGLSDSAFSRLEERLGTIAARLDETAHAAPADSRALASLENQIAHLSTLISQPVQVQAAGISPELDVRMAAIEDYMASNDEYIIEAARQAAEAVLDAYTRNNLSAGANLADMTMLTDLATDLRSLEALSRNTEERTHRTFEALHETLVQIAGRLDNLDSAPAYRQDAPRNVAQHMVAASREDAAMPAAVFPADGYIAEEQAILDDVSENDATAIVPPAAAKPAKAERKSLLAGLTKRFKTSTAKPAKAKEEPVSASSARTQVEPAPSLDPIDVLPAGQENELLEPGSGAPDIKKILERVRASQVAGAGKAADAEGRTDFIAAARRAAQAAAMETSPEKLDTGKKSRKADTSALSRYRRPLLLGIGAILLAMMAMPLVKTLIGGAEAPAPVIEQKTDQGPVSALPETDDKAVTIPSGLAIDPEQAASADSIENAAPAQNIIDNRTIGGAPLPDEPPVADVPAVDPAKSDTVAQNEGPKPTEVATTTIPAQDTIVVPAGIEPASLAEAAAKGDTQALFEIAARYTDGRGVTADRAEAAKWYKMAADRGLAPAQYRLANLYEKANGVERNLVEAKRYYTLAAEQGNAGAMHNLAVLLASDAAGQPDFATSAQWFIKASELGVRDSQFNLAILYARGSGVKQDIEESYKWFAIAAKDGDADAAQKRDEVAGAMSPQQLQSAKAKVDAWKVKPLSDDANSVNPPEEWAGKEGVKTASVDMEKAIRNIQAILNKNGFDAGQPDGKLGKNTVTAIRDFQKSVGQTPDGRITNDLVTALLARNK

SEQ ID NO: 52915 - DNA, 954 bp, Brucella melitensis 16M
  CDS (1)..(954): transl_table=11
atgccggcgcttccaccagagccgcaggcatccgcacagttttcgccaccggaaaccgaacagacagccgcgcctgaacccaaaaagatcgaaatcccgtccattcccgaagaagccgggcctgccgcgctgcgcgaggccgctgccaagggggacatacgcgcgctttttgaaatcggcaatcgctatatggaagggcgcggtgttgccgaaaacgtgaaagaagcggcgaaatggtatcagcttgccgccgatcagggctttgcgcctgcgcaatatcgcatcggcagtttcaatgaaaagggcctcggcatggcccgcaatctggaaaaggccaaaagctggtatcagcttgccgcagatcagggcaatgcaagcgccatgcacaatcttgccgtgctttttgccacaggtacaaacggcacgccggataatgctgccgctgtgcgctggttcaccgaagcggcagaacttggtgtgaaggacagccagtataatctcggcatccttgccgccaaggggctgggaatgccggtcaatctggaagaaagctacaaatggttcgcgcttgccgccaatgcgggcgacaaggacgccgccgaaaagcgcgaccagatcgcaaaagccctgaagccggaaatgcttacccgcgccaagggagccgtgaaactgtggaaggcaaaaccgcttgacgatgcggccaattccattgacgtgcccgacgcctggaccgaggcaaaaccgctgtccaccagctcggtggacatgaagaaggccgttcgcaacatccagctcattctccagaaaaacggctatgataccggcactgccgacggcatgatgggcgccaagacccggacggcaatttccgcctttcagaaggccaatggtcaggagccgaccggcgaagtgaaccagaagctggttcaactcctgctcgaaaagaacaaataa

SEQ ID NO: 52916 - protein, 317 aa, Brucella melitensis 16M
MPALPPEPQASAQFSPPETEQTAAPEPKKIEIPSIPEEAGPAALREAAAKGDIRALFEIGNRYMEGRGVAENVKEAAKWYQLAADQGFAPAQYRIGSFNEKGLGMARNLEKAKSWYQLAADQGNASAMHNLAVLFATGTNGTPDNAAAVRWFTEAAELGVKDSQYNLGILAAKGLGMPVNLEESYKWFALAANAGDKDAAEKRDQIAKALKPEMLTRAKGAVKLWKAKPLDDAANSIDVPDAWTEAKPLSTSSVDMKKAVRNIQLILQKNGYDTGTADGMMGAKTRTAISAFQKANGQEPTGEVNQKLVQLLLEKNK

SEQ ID NO: 52917 - DNA, 2037 bp, Arabidopsis thaliana
  CDS (1)..(2037)
atgagaatattaagctacggaatcgttattctctctttactcgttttctctttcattgaatttggcgttcacgctcgtcccgtcgttctcgtcctctcaaatgacgatctcaatagcggcggcgatgataacggagtcggagagtcctctgacttcgatgagtttggagaatccgaacctaagtccgaagaggagcttgatcccggttcatggcgatcgatcttcgagccagatgactcaacagtccaagcagcctcgccgcagtactactccggcctcaaaaagattctatcggcggcgagtgagggaaatttcaggttgatggaagaagcagtggatgagatagaggctgcttcttcagctggagatccacacgcacagtcgataatggggttcgtttacgggataggaatgatgcgagagaagagcaaaagcaagtcgtttcttcaccataatttcgcagctgctggtgggaatatgcagtcgaagatggcacttgcgttcacgtatcttcgtcaagatatgcatgataaagctgttcaattatatgctgaattagcagagacagctgtcaatagttttctgatctcaaaggattctccggtggttgaaccaactagaattcatagcggaactgaagagaacaaaggtgctctaaggaaatctcgaggcgaggaggatgaagatttccagatattggaatatcaggcacagaaagggaatgctaatgcaatgtacaaaattggactgttctactactttggcctgcgaggattaaggcgtgatcacaccaaggcattgcattggtttttgaaagcagtagataaaggagagccgaggtcaatggaacttctgggggagatatatgctagaggagctggtgttgaaagaaattataccaaggcacttgaatggcttacacttgctgcaaaagaaggtctctattcagcatttaatggaattggctacttgtatgtcaaaggctatggagtagataagaaaaactatactaaggcaagagaatattttgagaaggctgttgacaatgaagaccccagtgggcattataaccttggagttttgtatcttaaaggcatcggagtcaacagggatgtgaggcaggcaacaaaatacttctttgttgctgcaaatgctggtcaaccaaaggctttctatcaactcgccaagatgttccatactggtgttgggcttaagaagaatctggagatggcgacttcattttataagctagtagcagaaagggggccgtggagttctctctctagatgggctcttgaagcttacttaaaaggtgatgtgggtaaggctttgattttgtactcaaggatggcagagatgggttatgaagtggcacaaagtaatgctgcctggatcctcgataaatacggcgaaagaagcatgtgcatgggagtatctggattttgcacagacaaagagagacatgagcgggcacattctttgtggtggcgggcctctgaacaaggcaatgaacatgctgctctgcttattggagatgcatattactatggccggggaactgagagagattttgtgcgtgcggcagaagcatacatgcatgctaaatcacagtccaatgcgcaagcaatgttcaacctcggttacatgcatgaacatggacaaggacttccctttgatctccatttagcaaaacgttactatgatgaatcccttcagagcgatgcagccgcgagattgccagtcacacttgctctcgctagcttatggctccgtagaaactatgctgataccgtcctggtgagagttgtggattcattaccagaagtgtatccgaaggtagagacttggatagagaatgtggtgtttgaagaaggtaatgcaacaatacttacactctttgtctgtctcatcacaattctctatctccgggaaagacaacgtagacaagtcgtcgttgttgccgatccagtggctgctgacgtggcacaaccgctcgacgctgatgtggcgcaacacctcgctgcgttcccacggtaa

SEQ ID NO: 52918 - protein, 678 aa, Arabidopsis thaliana
MRILSYGIVILSLLVFSFIEFGVHARPVVLVLSNDDLNSGGDDNGVGESSDFDEFGESEPKSEEELDPGSWRSIFEPDDSTVQAASPQYYSGLKKILSAASEGNFRLMEEAVDEIEAASSAGDPHAQSIMGFVYGIGMMREKSKSKSFLHHNFAAAGGNMQSKMALAFTYLRQDMHDKAVQLYAELAETAVNSFLISKDSPVVEPTRIHSGTEENKGALRKSRGEEDEDFQILEYQAQKGNANAMYKIGLFYYFGLRGLRRDHTKALHWFLKAVDKGEPRSMELLGEIYARGAGVERNYTKALEWLTLAAKEGLYSAFNGIGYLYVKGYGVDKKNYTKAREYFEKAVDNEDPSGHYNLGVLYLKGIGVNRDVRQATKYFFVAANAGQPKAFYQLAKMFHTGVGLKKNLEMATSFYKLVAERGPWSSLSRWALEAYLKGDVGKALILYSRMAEMGYEVAQSNAAWILDKYGERSMCMGVSGFCTDKERHERAHSLWWRASEQGNEHAALLIGDAYYYGRGTERDFVRAAEAYMHAKSQSNAQAMFNLGYMHEHGQGLPFDLHLAKRYYDESLQSDAAARLPVTLALASLWLRRNYADTVLVRVVDSLPEVYPKVETWIENVVFEEGNATILTLFVCLITILYLRERQRRQVVVVADPVAADVAQPLDADVAQHLAAFPR

SEQ ID NO: 52919 - DNA, 1773 bp, Encephalitozoon cuniculi GB-M1
  CDS (1)..(1773)
atgcggatggacacgcttcactcgtttttcggcagaaaaatgtccagagaagccgacgtggtgcttttgggcgtgggcagagaaaaaaacgaggagcttgggctaaagatgcatctggaaaactctgcaagagatgcaaactcgcttgcagtatctgcattctgctacgagtttggaattggcactagtgtcgatatgaagaaagcagagatgagatacactaaggctgcgttgagcgacaacgggcttgcgctaattagactagcatttataaggcggtttggcaggcctacggcaacaatagatcggcgggaggctaagcggtatctcgataagctaaagcgcctgggcagaagaggggtggaatggctagtttatgcaaacaagcatggaaacctttatgccaggtactgcttgggggtgtgctaccaggagggatatggtgttcctgtagatccgttactagctgtgaagtactacagtgagggtgcatatgaaggaaatacctgctcgattggaatccttggatactgcttcctaaagggatttggagtggagaggaacgaagaaatagccgtggagctcttcaaatatgcgtctgaaaagaaggactcgacggcgctgtacaacataggtttctgctacgaggaggggcgaggggttgagagaaacctcatcaaagcctttgaaatgtacaggctgtctgcaaagatggagaattcgtatgctcagaatgcattgggcaactgctatgaggaggggaagggagtggatagagatctccaaaaagcctttgagctctataagaaaagtgctttgcaaggatatccgtctggtcaatgcaaccttgcgttctgctaccaaaaggggattgggacggagaggaatttggaaaaggccttcgagtggtacaaaagggctgccatccaaggactcagcagggcaaagcataacattggatactgctaccagaatgggctggggacctctccgtgtatgcgtagtgccgtcaattggtacaaggagtccgcagctgaagacaataagtattcaatacatgcactaggggtttgttaccagcatggatatggagtacccaaggacgaaaggctggctgtaaggtattttagtgagggtgtccgggccggctttgacgaagcaatcataagccttgcattgtgctacagatctggaataggagtccggatctctccggagaagtcctttgcgctgatgaagagagcagcagaaatgaataactcctcagcacagaataccttgggatactactacgaggaaggatatggaacacccaaaaacctaagaaaggcagtgaaatggtatgagacaagtgccaagcggaacaactcatgggcgctgttcaacctaagcaccttatacctcaatggaaaccatgttccagcagacaaagagttagggataaggctcctgattaggtcgagagatttgggtaaccccagagcaatgaacaccctgggatactgttttgagaagggcattgttgttgggaaggatccaaggcttgcctttgagcactacacacaggcattgatgaacggatactcgaaggcagggtatagtctcggaaggtgctatgagagcggtatcggaactgaagttgacctggataaagctctgtactatttttacaaggcatcttctgccggagaagaggcttctctacagagactcaagaagatactgtcttcattggttgagccaaaccacatgactatcccgccctgcgcctga

SEQ ID NO: 52920 - protein, 590 aa, Encephalitozoon cuniculi GB-M1
MRMDTLHSFFGRKMSREADVVLLGVGREKNEELGLKMHLENSARDANSLAVSAFCYEFGIGTSVDMKKAEMRYTKAALSDNGLALIRLAFIRRFGRPTATIDRREAKRYLDKLKRLGRRGVEWLVYANKHGNLYARYCLGVCYQEGYGVPVDPLLAVKYYSEGAYEGNTCSIGILGYCFLKGFGVERNEEIAVELFKYASEKKDSTALYNIGFCYEEGRGVERNLIKAFEMYRLSAKMENSYAQNALGNCYEEGKGVDRDLQKAFELYKKSALQGYPSGQCNLAFCYQKGIGTERNLEKAFEWYKRAAIQGLSRAKHNIGYCYQNGLGTSPCMRSAVNWYKESAAEDNKYSIHALGVCYQHGYGVPKDERLAVRYFSEGVRAGFDEAIISLALCYRSGIGVRISPEKSFALMKRAAEMNNSSAQNTLGYYYEEGYGTPKNLRKAVKWYETSAKRNNSWALFNLSTLYLNGNHVPADKELGIRLLIRSRDLGNPRAMNTLGYCFEKGIVVGKDPRLAFEHYTQALMNGYSKAGYSLGRCYESGIGTEVDLDKALYYFYKASSAGEEASLQRLKKILSSLVEPNHMTIPPCA

SEQ ID NO: 52921 - DNA, 1824 bp, Streptomyces coelicolor A3(2)
  CDS (1)..(1824): transl_table=11
atgggggacatggcaaatctgttcgggacagggcgttttgcgcagccttccggtcagctttccggtcaggaggaggccacggacgaggctcaggaagccgccgacgaggccgccgaggaagtgcgcctgcggctcgccgtcgactgtggtgacgtcgaggcgatgagcgtgctcggcgcgatgctgctgcgccgtggcgacttcgacgcagccgagtcgcacctgcgtgccgccaccgcggccggcgaccgggccgccgccaacaacctgggcgtcctgctgcaccagcggggatacgccgacgaggccgccggctggtggcgcatcgccgccgtcgccggatccgccgccgccgcgcacgcgctcggccggcacttccgggaacgcggggacgagcccgccgccgagtactggctgtgccagtccgcggaacaggggcacgtgctgggcgcctacgcgctcgccgacctgctggagcaccgcggcgacgacaccgggtccgagcggtggatgcgggccgcggccgaacgcgggcaccgggaagcggcgtaccggctggcgcggacgctggaccggcgggccgggcgggacggcgacgacaaggccgccgcacgcgcggccgacgaggccgagcagtggtaccggcaggccgccgcgcgcggtcaccggcgcggcgcgctgcacctggggacgatcctggagaagcgcggcgagctcaaggaggcgggccgctggtacctcacgtccgccaaggacggcgaggcccgcgccgcctgcgcgctcggcttcctgctgcgggacgccggggacaccgagagcgccgccgtgtggtggctgcgcgccgcccaggacggcgacggcaacgccgccaacgccctgggcgcgctgcacgccgagcgcggcgagacccagaccgcggagcgctggtaccgggccgcgatggacgcgggcgacgacaacggggcgtacaacctcgggctgctctgcgccgagcagggccgcaccacgcaggccgagcagtggtaccggagggccgcctacgccgggcaccgggaggcctccaacgcgctggccatcctgctgctgcgcgccggggacgagagcggcgccgagccgtggttctccaaggccgccgaggcgggcagcgtcgacgccgccttcaacctcgggatcctgcacgccgggcggagcgaggagcgggcggcgctgcgctggtacgagcgggccgccgccgccgggcacaccgaggcggcgctccaggtcgggatggcgcggctgcgcggcggggacgagcaagaggcggagcggttcctgcgctgtgcggccgggggcggcagcgcggaggccgcgtaccggctggcgacggtgctggacgcgcgccggccgccggagcccgcgcacgagctgggtgagcccgcgcaggacaagtccgagtgcgaggagtggtacgagcgggccgcctcccaggggcaccggcgcgcgcaggtgcgggtcgggatgctcgccgcggcgcggggcgacgtggtggaggccgcgcggtggtaccgcgaggcggccgaggccgggtcccgcaacggtgcgttcaacctggggctgctgctggcccgcgaagggagcgagcccgaggccgtcgtgtggtggcgcagggcggccgacgccgggcacgggcgggcggcgctgcggctggcgctggtctgtgcgcggcggggggagctggcggaggggcagcggtgggcggacctcgcggtgtcactggggccgcgggaggtgggggagcgggcggctcggctgcgggacgcgttgcggcaggagctgtcggcgtga

SEQ ID NO: 52922 - protein, 607 aa, Streptomyces coelicolor A3(2)
MGDMANLFGTGRFAQPSGQLSGQEEATDEAQEAADEAAEEVRLRLAVDCGDVEAMSVLGAMLLRRGDFDAAESHLRAATAAGDRAAANNLGVLLHQRGYADEAAGWWRIAAVAGSAAAAHALGRHFRERGDEPAAEYWLCQSAEQGHVLGAYALADLLEHRGDDTGSERWMRAAAERGHREAAYRLARTLDRRAGRDGDDKAAARAADEAEQWYRQAAARGHRRGALHLGTILEKRGELKEAGRWYLTSAKDGEARAACALGFLLRDAGDTESAAVWWLRAAQDGDGNAANALGALHAERGETQTAERWYRAAMDAGDDNGAYNLGLLCAEQGRTTQAEQWYRRAAYAGHREASNALAILLLRAGDESGAEPWFSKAAEAGSVDAAFNLGILHAGRSEERAALRWYERAAAAGHTEAALQVGMARLRGGDEQEAERFLRCAAGGGSAEAAYRLATVLDARRPPEPAHELGEPAQDKSECEEWYERAASQGHRRAQVRVGMLAAARGDVVEAARWYREAAEAGSRNGAFNLGLLLAREGSEPEAVVWWRRAADAGHGRAALRLALVCARRGELAEGQRWADLAVSLGPREVGERAARLRDALRQELSA

SEQ ID NO: 52923 - DNA, 759 bp, Xanthomonas axonopodis pv. citri str. 306
  CDS (1)..(759): transl_table=11
atgtctgagccggcgctggacatcgcgcagctgagcgcgttgctgcgcacgcagccggaacaggcacgtgcgcgcttgcacaaagccgctgcgaaccatgacgtaggcgcacaattgctgctcgcgcagatgtacgccgaaggacgcggcattgccgcagatccggctgcagcgatgctgtggtacgaagtggccgccaacgcagggtgtgcggaggcgatgaaccagctgggccgctgccatgagctcgggttcggcaccgccatcaacgcggtgctggccgtgctgtggtatcgccgcgccgccgaacatggcctggcatggggcatgtacaacctggcgcacatgtacgcctccgggcgcggcgtggcgcaggaccacgcgcaggcattggcgctgtaccaccgcgcggccgaagccggacatgccaagtcgatgaacttcctggcgcgctatctcgaccagggcctggcctgcgctgcagaccctctggccgcatgcgtgtggtaccgccgctccgccgaagcgggcgatttccgcggccaggccggctacgccaccctacttgccgacagcggcgagctggatcaggccgagacatggatgcgccgcgccatcgcaggtggccacgccggctttttgcaacagctcgcaccactgctggccggcgcgcgccatccgcgcctgcgcgccttgctgcacgaggtggctgcacggcagcggcaactgcagccttgcgtccccgcagacgtggcctga

SEQ ID NO: 52924 - protein, 252 aa, Xanthomonas axonopodis pv. citri str. 306
MSEPALDIAQLSALLRTQPEQARARLHKAAANHDVGAQLLLAQMYAEGRGIAADPAAAMLWYEVAANAGCAEAMNQLGRCHELGFGTAINAVLAVLWYRRAAEHGLAWGMYNLAHMYASGRGVAQDHAQALALYHRAAEAGHAKSMNFLARYLDQGLACAADPLAACVWYRRSAEAGDFRGQAGYATLLADSGELDQAETWMRRAIAGGHAGFLQQLAPLLAGARHPRLRALLHEVAARQRQLQPCVPADVA

SEQ ID NO: 52925 - DNA, 2460 bp, Drosophila melanogaster
  CDS (1)..(2460)
atgaaggccaacagctggatgtgcctgctggcgctgcttctcgcctggcagctgcgagcggaggagctccaagggcccaacattgatggtacgggcagcagtttgggttcggccacaggtacgggtacgggaacgggattgggcacgggaacagccacgccaacgctgcccaatgagccctccacccaggcggaggcggaggaggtgaccacggcggaatcagagtcgcgggttccgtcggaaagcaacgaacgcaaggcagacaaacccaaggagtccacaaagtttgcttccaggacgaaggttatgccggcttccctgttcgaacgcctgtggaacgaaagtctgatcaggcggcaaaagctgaaagccgagatcgagcgcatcgaagccaaacgcaaatccactgaagtgttagaacttaccccagaccaaatagaagctcaaaccgtgtacgacaacgcaatggacatgttggccaagccaagcacggataagcgagtagccatgattttgcttaagaaggctgctgcatttaatcacctcaaggcgagggcggaactagcctgggccgccctactgggtcaatggatggactttgatttcaaccatgctgtcgatgagtttgagagtctggccaacgaaggcgtcccagaggctcacatgggcctgggattcctttattcggtgggcgttggcggtaaaaatgtaagccagcccctggcactgatccactatagcctggctgccctcggtgataatactccggcgcaaatggccatggggtatcgctatctttatggcatcaatgtgcccattagctgtgagaaggcgctgatccactacaagcgagtagccaaaaaagtggcttccaagataaccttcgccaatgggccggttgtgcatcgggtaagactgctggatgacctagagaatcccggcagttccgaaactgagattgtcgactattacaaacttctggccgataaaggcgacatccagtcgcaggtgggattgggtcaggtgtactatcagggcggcaaggtcaccgagcaagatcatcaaaaggctttggaatatttcaaaatggccgccgatgcaggtagtgcagttggcatcgcgtttttaggcaagctttatctggaaggaagtgatcaaatcagggccgataatgatgcagcatttgggtacttctccaaggccgctgaaatgggggatccagttggtcaaagcggactgggcctcatgtatctaaagggtttaggtgttcccaaagactccatcaaggcattatcctatttcactcaggcggctgatcaaggttgggttgatgggcaactgcagctgggcaacatgtatttcactggcaatggtgtaaaaaccgactacaagttagcctttaagtacttcaacctggccacccaatcaggccatgttttagcctattataatctgggagtgatgaatgcctacggtatgggaatgctgcgttcatgtccagcagcagtagaattcttcaagactgtttcggagcgtggccgttggagcagccgattgatgatggcctacagcgactataaaaataaccgcatcgacgaggcctacatgcagtactcgttgatggccgaaatgggctatgaggtggctcaaagtaatgccgcctttttactagaccgcaaggaggtgcatgtgttcaacgatcggcacgaagatctgattcgtgccttctactactggaaacgagcagccggacagggctattctgcggcccaagtcaagctgggcgattactattactacggttggggtacttcgacggacttcgagactgccgctgctctttacaggaaagcctctgagcagcaatataatgcccaagccatgttcaacttgggatacatgcacgagcaagggctcggaatgaagaaagactggcatctggcaaagagattatacgatttggctgcggaaaccaattcagacgccaaagtgcctgtggccattgcgctttttaagctacaaatgttggccacgattgaatcaatcaaggagtcaccttacaggttcatcttctacatggatgaaaatattgctgccaattgggacttgtacatgattaccgttctaactctactgctgggcatcatcatgtacatgaggcgtccatttcagcagccggatcagccggcacagcagccagctgcagatgacattgctgctgcgccagttaacttggcgccggttggagcggaagcagcacctgtagccgcagtggtcgaaggtgtgggcgtcacaccacctgccgccgcagtttcatctcacgatgctgtggccgcgtcctcctctacggaaacctcatcaaccactgccacgtcccttgtcgatgcagcgtcacaagggggaagtggcacgacatctgcggcgccggatggcgctaacacactcgatcccactggttag

SEQ ID NO: 52926 - protein, 819 aa, Drosophila melanogaster
MKANSWMCLLALLLAWQLRAEELQGPNIDGTGSSLGSATGTGTGTGLGTGTATPTLPNEPSTQAEAEEVTTAESESRVPSESNERKADKPKESTKFASRTKVMPASLFERLWNESLIRRQKLKAEIERIEAKRKSTEVLELTPDQIEAQTVYDNAMDMLAKPSTDKRVAMILLKKAAAFNHLKARAELAWAALLGQWMDFDFNHAVDEFESLANEGVPEAHMGLGFLYSVGVGGKNVSQPLALIHYSLAALGDNTPAQMAMGYRYLYGINVPISCEKALIHYKRVAKKVASKITFANGPVVHRVRLLDDLENPGSSETEIVDYYKLLADKGDIQSQVGLGQVYYQGGKVTEQDHQKALEYFKMAADAGSAVGIAFLGKLYLEGSDQIRADNDAAFGYFSKAAEMGDPVGQSGLGLMYLKGLGVPKDSIKALSYFTQAADQGWVDGQLQLGNMYFTGNGVKTDYKLAFKYFNLATQSGHVLAYYNLGVMNAYGMGMLRSCPAAVEFFKTVSERGRWSSRLMMAYSDYKNNRIDEAYMQYSLMAEMGYEVAQSNAAFLLDRKEVHVFNDRHEDLIRAFYYWKRAAGQGYSAAQVKLGDYYYYGWGTSTDFETAAALYRKASEQQYNAQAMFNLGYMHEQGLGMKKDWHLAKRLYDLAAETNSDAKVPVAIALFKLQMLATIESIKESPYRFIFYMDENIAANWDLYMITVLTLLLGIIMYMRRPFQQPDQPAQQPAADDIAAAPVNLAPVGAEAAPVAAVVEGVGVTPPAAAVSSHDAVAASSSTETSSTTATSLVDAASQGGSGTTSAAPDGANTLDPTG

SEQ ID NO: 52927 - DNA, 747 bp, Chlorobium tepidum TLS
  CDS (1)..(747): transl_table=11
atgaagcgttttgttttcagcggttttgctgtgtttatgcttgctgctcctgtgacggggcattgccgggattatcaaatgaatgactcatcaccggaagcatcggtccgtcgggacgcggatactgataaagatgctgcccaaaaagagtatctcatcgcgatgaaatactattatggccgtgatgtggatcgtgattatgccgaggcgctcaaatggctcagattgtcagccgcgaaaggcaatgatgctgcggagtacgcaataggattcatgtaccagaagggactgggtgttccacaggactatgccgaggcgatgaaatggtaccggctcgctgctgccaaagataacgataatgcccagaaccagatcggttacctgtatcatcatggatggggtgtggagactgattatgccgaggcgatgaaatggtaccgcatatcggctgccaaagggaattttgctgctgaagacaatatcggggtgctctatgaacatggtcagggcgtagaacaggactatgctgaggcaatgagatggtaccgcatatcggcagccaagggcaacggcgaggctgaactcaatattggcaatttttatcagcatggtttgggcgttgagcttgatcttaacaaagctgtaaaatggtatcggtcggcagcggccaaaggcaacgaggaagctgcgcaaaagctcagtgccatgaagagcggcagtgtgttgcctgacgtgcaccatgagtaa

SEQ ID NO: 52928 - protein, 248 aa, Chlorobium tepidum TLS
MKRFVFSGFAVFMLAAPVTGHCRDYQMNDSSPEASVRRDADTDKDAAQKEYLIAMKYYYGRDVDRDYAEALKWLRLSAAKGNDAAEYAIGFMYQKGLGVPQDYAEAMKWYRLAAAKDNDNAQNQIGYLYHHGWGVETDYAEAMKWYRISAAKGNFAAEDNIGVLYEHGQGVEQDYAEAMRWYRISAAKGNGEAELNIGNFYQHGLGVELDLNKAVKWYRSAAAKGNEEAAQKLSAMKSGSVLPDVHHE

SEQ ID NO: 52929 - DNA, 2163 bp, Yersinia pestis KIM
  CDS (1)..(2163): transl_table=11
ttgaaaaaaaaactggtggcactcttaatactctcttatccgtcggttgcatatctaaagcaaccccctccggcagtacctaaacccattacctttgttgctaaaattgataacattgattttaacaaaacggccattgatagtgatatgaaattactgctggccgatcggttccactttaaaaccaaaaccccctgtaacaagaatacgctttcaggccggccagaatcatttggtttaacgtcagaagtatacgcggcaaaaatcaagagtttgctcgttgagatcttaagtgaacgttaccttttcctgacaatagatcaatgtgaccgcggtggcacaccgatgctcaccaatatagaagtttgcactgaagcactgtgcggtgctgaattcatgaaaaaagaatcttatctttggttaaatcaagacttaaaggccacggtgaaacgccaggcgacatcggtgatccctatgccattaacctttgataaagaaaagcaactgtggaaagtggccgggtggtttattgagtcatcagaagaaactgaggaacttataccgagcaaactgctggcctttgaaggttatactgacgatgaaacattcaaaacacaaaaattcgtctctaccttcaaatcctattactccagtggaaatattcaacatattctcacttataataaagagggaaaagaggatgggaaatacgactcatattatgatgaaaaagggaaattagctgagacgttggtatttaaaaatggcttggtcaatggtgagtatattatctaccatgaaaatggtgctattgaaagcaaacgacattttattgacagcaaaatagccgacggagagtgccctcattattacgacaatggaaaaattaaagagaaccatagctatttgaataataaactcgaagggaaatactttgagtattttcctgatggtaaaattaaagatgaaagaacctaccatgctggcaaagtcgttggtaaatacacagtctactttgaatcaggtaaaattagagctatttataataaaaacaataaagatcagtaccatggaactaacgaggaatacagccccgaagggcagttagtgtctaaatcaacgtataaagaaggaaaacaactctctagccagacttggtataaaaatggaaaaatgcgacaggaagaaatctacgataacgaaggccgcaaaaatggcgtatcaagagagtggtttgataatggacaacttaatacatcaaccagctataaaaatgatatcttagatggtgatagccagaaatggaacgaacagggtgaaatagtatcactctcaccgtataaagacggcaaacttcagggtgaacataaatattatgattcaggaaaactactttataccacaatgtataagaacgataaaaaagatggtccggatagacgatggagtatcaatacagggaagttaattgaagaaatgccctatgttgaaggcataagaagcggcatcaaaaaagagtttaatgatcgtaccggtagactgttaacaaccaccccttatgtgaataatgaaatacaggtcaccggagaaacatataatgccgatggtgttagcattattcactgctatatcaataataaaagtattgactcgctatacaatcctattgaaatacgcgagaaagcctcacagagtgatgataatgcacagtatgaactgggtaagtatcattatacttgtcaagactatgatagaggtcttaagtggctagaaaaatcagcagaccataaaaatattaaggcgttatttcttttagctcaaatgtataatgaaggtgacggcgttaaagaagatcaaaccaaatatttctcctatttactcaaagcagcgcagttagggctaagtgatgctcaagtggaaattggctatctgtatctcgtcggtgaaggggtagaaaagaacttaccagaagcctatcagtggcacataaaagctgccgaacaaggaaacgtgcacgcccattataaccttggttggatatatcaaaatggagacggcaccgagaaaaatttggataaggcaaaattccactttaccgttgcagctaaaagtgggatgagagaagcctatgaagaattaaaaaaattagaatccaacaagtaa

SEQ ID NO: 52930 - protein, 720 aa, Yersinia pestis KIM
MKKKLVALLILSYPSVAYLKQPPPAVPKPITFVAKIDNIDFNKTAIDSDMKLLLADRFHFKTKTPCNKNTLSGRPESFGLTSEVYAAKIKSLLVEILSERYLFLTIDQCDRGGTPMLTNIEVCTEALCGAEFMKKESYLWLNQDLKATVKRQATSVIPMPLTFDKEKQLWKVAGWFIESSEETEELIPSKLLAFEGYTDDETFKTQKFVSTFKSYYSSGNIQHILTYNKEGKEDGKYDSYYDEKGKLAETLVFKNGLVNGEYIIYHENGAIESKRHFIDSKIADGECPHYYDNGKIKENHSYLNNKLEGKYFEYFPDGKIKDERTYHAGKVVGKYTVYFESGKIRAIYNKNNKDQYHGTNEEYSPEGQLVSKSTYKEGKQLSSQTWYKNGKMRQEEIYDNEGRKNGVSREWFDNGQLNTSTSYKNDILDGDSQKWNEQGEIVSLSPYKDGKLQGEHKYYDSGKLLYTTMYKNDKKDGPDRRWSINTGKLIEEMPYVEGIRSGIKKEFNDRTGRLLTTTPYVNNEIQVTGETYNADGVSIIHCYINNKSIDSLYNPIEIREKASQSDDNAQYELGKYHYTCQDYDRGLKWLEKSADHKNIKALFLLAQMYNEGDGVKEDQTKYFSYLLKAAQLGLSDAQVEIGYLYLVGEGVEKNLPEAYQWHIKAAEQGNVHAHYNLGWIYQNGDGTEKNLDKAKFHFTVAAKSGMREAYEELKKLESNK

SEQ ID NO: 52931 - DNA, 1137 bp, Escherichia coli CFT073
  CDS (1)..(1137): transl_table=11
atgggaaaaataaaatattggctaatagtaggatttattatactttttgcgattttttacattgctattagtgacagggattctacgctttctaggttgaaatcagcaggtgaaaacggagatgtagaagctcagtatgctttggggctcatgtatttgtatggagaaattctggatgttgattatcagcaggcaaagatttggtatgaaaaagccgctgaccaaaatgatccgcgtgcgcaggccaaactcggtgtgatgtatgcaaatggtctcggggtaaatcaggattatcagcaatcaaaattatggtatgaaaaggcggctgcgcaaaatgatgttgatgcgcaatttttgcttggggagatgtatgacgatggtctcggggtaagccaagactaccagcatgcaaagatgtggtatgaaaaagcggctgctcaaaatgatgagcgtgctcaggtcaatctcgctgttctatacgcaaagggtaatggtgttgaacaggattatcgacaggccaaaagctggtatgaaaaggctgcagctcaaaatagtcctgatgcgcagttcgctcttggaattctgtatgccaatgctaatggtgtagagcaggactatcagcaggcaaaagactggtatgagaaagcagcagaacaaaatttcgccaatgctcagtttaatcttggtatgctctattacaaaggtgagggtgttaaacaaaactttcggcaagccagagaatggtttgaaaaagccgcatctcaaaatcagccgaatgcccaatataatttaggtcagatttattactacggtcagggtgtgactcagagctatcgacaggcgaaagactggtttgaaaaagcggcagagaaaggtcatgtcgatgctcaatataatctcggtgtaatatacgaaaatggtgaaggtgtgagtcagaactatcaacaggcaaaggcttggtatgaaaaggcagcctcacaaaatgatgcgcaggcgcagttcgaacttggcgttatgaatgaactgggtcagggtgaaagcatagacctgaaacaagcaagacattactatgagcggtcatgtaataatgggcttaagaaaggttgtgaacggttaaaagagttattatacaaatag

SEQ ID NO: 52932 - protein, 378 aa, Escherichia coli CFT073
MGKIKYWLIVGFIILFAIFYIAISDRDSTLSRLKSAGENGDVEAQYALGLMYLYGEILDVDYQQAKIWYEKAADQNDPRAQAKLGVMYANGLGVNQDYQQSKLWYEKAAAQNDVDAQFLLGEMYDDGLGVSQDYQHAKMWYEKAAAQNDERAQVNLAVLYAKGNGVEQDYRQAKSWYEKAAAQNSPDAQFALGILYANANGVEQDYQQAKDWYEKAAEQNFANAQFNLGMLYYKGEGVKQNFRQAREWFEKAASQNQPNAQYNLGQIYYYGQGVTQSYRQAKDWFEKAAEKGHVDAQYNLGVIYENGEGVSQNYQQAKAWYEKAASQNDAQAQFELGVMNELGQGESIDLKQARHYYERSCNNGLKKGCERLKELLYK

SEQ ID NO: 52933 - DNA, 1944 bp, Escherichia coli CFT073
  CDS (1)..(1944): transl_table=11
atgaactgctgggaaatattagctttacaaccaggtgcggaagaacgagatattaagcgtcgttatgcgcaactggtaaaaaattgccgcccggaagatgatcccgcagcctggcaacaattgcacgatgcttatgaacaggctttacgttatgacgacgaagatcagtggcaagaagaggaagaagagcaaccgatcaatatgtccaggggtattgttcatcctcgtcctgtgatgacatttcgcgcacccaacaccttttctggtcatccacttcctgatgtcactattaaatcagagggggaattcacctggcgagccgtgctggatatgctctgtgaggagaatgaagcaacccccgaacacgcccccatgcaacttgctaaggcgttatctttccttgagaaaaaagatctcagctcacgaatgtgctttgaagaaacgttattactgcatcttcatcgggtattccggccattattaactctcgctgcagcacaaacgttcagatggcatttagtcgcaggcagtcgtcaacccgtaatccagacagaaattaacgaaagttgtcttctttattatcgcatcgaaaaacaaattacccctttctttgccagtaacttgtctccactggaagaaatggaaaacgggaaggaaatggctacgatttatcaatcattaaaggataatgaagagagcctgaaatggtttgatatcgcagtattaaataaagttgctgaatttgaactatcagacaactatatggcattgttaatagagtgtttatcatattccttgcgaaaagaaaaaatgattcgcaagtggaaattaacagaacgcttcaataatttagcaatgcaacatcatagtggatataaaaagctgctaaatgccataaaattaaaaggtcttttttattatccatcttctgtataccagtcctgcttacatgctgcagagcaaggctattcactagcctggtattctcttggcaaaatgtattacgaaggtgatgaggtttcacaggatctaaaattagcctttaactggtttacccgcgccgcgcagcataatgttatcgatgctctgtatgcgctgggtatcatgtatagcgatggaaggggcacggataagaatatttgtgaggcacgaaaatggtttttacttgctgcccaaaatggcaacacatctgcgcaatatgagcttgcccgtatctcacgctttgctgttgagccattacgaaattatgaagaagcattgcagtggtatttatctgccgccacacaaggacatgaggttgcccagtatgagttgggacaaatgtatatacaagggattggcgtggagcgcgatgaggttcaggcccatcgttggtttttgcaatcagcagaacagggatatttacatgcgcaatatcatactgccaggttgtatagcggaagtgagagtattccacaggaccaggaaaaagcgctgtactggtttaccaaagcagcaaaaaatggggcagatggggcaggggatgccatgtatgaattggggaaatattatttaaccaacaatgatgatcctgaaaataacgcagaggctactcaatggcttactggtgcagcgcagcgtggtcgaatagaggcgatatttttgttagctgaaatgtatctgtacggtacaaaatatatcgcaaaagatgaaaatcatgcgctgcactggtacgaaaaagcggcgcgtttaggggcgaccgaagcgcagcaccagactgcggcaatgtatgctcaggggacgggcactaaaattgataataaacaagcatggatgtggctaacaattgccggaaataacaacccctggattgaaaaagatgcgttgcgatgcttaatgtctgaacaggatattcaggatgcagaacaaacggctgcaaattgcaaacgtctgctaaggatttaa

SEQ ID NO: 52934 - protein, 647 aa, Escherichia coli CFT073
MNCWEILALQPGAEERDIKRRYAQLVKNCRPEDDPAAWQQLHDAYEQALRYDDEDQWQEEEEEQPINMSRGIVHPRPVMTFRAPNTFSGHPLPDVTIKSEGEFTWRAVLDMLCEENEATPEHAPMQLAKALSFLEKKDLSSRMCFEETLLLHLHRVFRPLLTLAAAQTFRWHLVAGSRQPVIQTEINESCLLYYRIEKQITPFFASNLSPLEEMENGKEMATIYQSLKDNEESLKWFDIAVLNKVAEFELSDNYMALLIECLSYSLRKEKMIRKWKLTERFNNLAMQHHSGYKKLLNAIKLKGLFYYPSSVYQSCLHAAEQGYSLAWYSLGKMYYEGDEVSQDLKLAFNWFTRAAQHNVIDALYALGIMYSDGRGTDKNICEARKWFLLAAQNGNTSAQYELARISRFAVEPLRNYEEALQWYLSAATQGHEVAQYELGQMYIQGIGVERDEVQAHRWFLQSAEQGYLHAQYHTARLYSGSESIPQDQEKALYWFTKAAKNGADGAGDAMYELGKYYLTNNDDPENNAEATQWLTGAAQRGRIEAIFLLAEMYLYGTKYIAKDENHALHWYEKAARLGATEAQHQTAAMYAQGTGTKIDNKQAWMWLTIAGNNNPWIEKDALRCLMSEQDIQDAEQTAANCKRLLRI

SEQ ID NO: 52935 - DNA, 1473 bp, Escherichia coli CFT073
  CDS (1)..(1473): transl_table=11
atgaaaaaatctcttctggctgtaatgctgacaggactgtttgctctcgtttctcttcccgctctgggaaatgtcaatctcgaacaattaaagcaaaaagctgaaagtggagaagctaaagcacagttggagctgggatatcgctattttcagggtaatgaaacgacaaaggatctcacccaggcgatggactggtttcgccgtgccgcagagcagggatacaccccggcagaatatgtactggggttacgctatatgaacggtgaaggtgtgccgcaagattatgctcaggcagttatctggtacaaaaaagcggcactgaaggggcttccgcaagcgcagcagaatctgggtgtaatgtaccatgaaggtaatggcgtgaaggttgataaagccgaatctgtgaaatggtttcgcctggcagcagagcaaggtcgtgacagcggccagcaaagtatgggagacgcatattttgaaggcgatggtgtgacgcgggattacgttatggcacgtgagtggtatagcaaagcagcggaacaaggtaacgtctggtcctgtaaccagcttggttatatgtattccagaggtttaggcgttgaaagaaacgatgccatatcggcacaatggtatcgaaaatcagcgacatcaggcgacgagttggggcagcttcatttagccgatatgtactatttcggtatcggtgttactcaggattacactcagtcacgggtattattttcccagtcggcagagcagggaaattctattgcgcagtttcgtctgggatatatattggagcaaggtttagcgggagcgaaagagccgttaaaagcactggagtggtaccgtaaatcggcagaacagggaaattccgatggtcagtattatttggctcatctgtatgataaaggcgcagaaggtgtagcaaaaaatcgagaacaagccatctcctggtacacgaaatcggcagaacagggggatgctaccgcacaggctaatctcggcgctatttacttcagacttggttcagaagaagaacataaaaaggcggtggaatggtttcgcaaggccgccgcaaagggtgagaaagcggcgcaatttaatttgggtaatgctttactccagggaaaaggtgttaaaaaagatgagcaacaggccgcaatctggatgcgaaaagccgcagagcaaggattaagtgcagcgcaggtacaattaggtgaaatctattattatggcttgggcgtagaacgtgattatgtgcaggcctgggcgtggttcgataccgcatcgaccaatgatatgaatctttttggtacagaaaaccgcaacattacagagaaaaaactgacagccaaacaactgcaacaggctgaattattatcgcaacaatatatagaaaaatatgccccggaagcctgggcgagaatgcaaaagcttaaagcgcaatcagcggtaaagacgggtaataaataa

SEQ ID NO: 52936 - protein, 490 aa, Escherichia coli CFT073
MKKSLLAVMLTGLFALVSLPALGNVNLEQLKQKAESGEAKAQLELGYRYFQGNETTKDLTQAMDWFRRAAEQGYTPAEYVLGLRYMNGEGVPQDYAQAVIWYKKAALKGLPQAQQNLGVMYHEGNGVKVDKAESVKWFRLAAEQGRDSGQQSMGDAYFEGDGVTRDYVMAREWYSKAAEQGNVWSCNQLGYMYSRGLGVERNDAISAQWYRKSATSGDELGQLHLADMYYFGIGVTQDYTQSRVLFSQSAEQGNSIAQFRLGYILEQGLAGAKEPLKALEWYRKSAEQGNSDGQYYLAHLYDKGAEGVAKNREQAISWYTKSAEQGDATAQANLGAIYFRLGSEEEHKKAVEWFRKAAAKGEKAAQFNLGNALLQGKGVKKDEQQAAIWMRKAAEQGLSAAQVQLGEIYYYGLGVERDYVQAWAWFDTASTNDMNLFGTENRNITEKKLTAKQLQQAELLSQQYIEKYAPEAWARMQKLKAQSAVKTGNK

SEQ ID NO: 52937 - DNA, 1005 bp, Vibrio vulnificus CMCP6
  CDS (1)..(1005): transl_table=11
atgacacgtcgttgtaccgcgtggttggctgcgcttccccttcttctttccagtgtttctcatgcgtatgatcttacttacgaagattttgacgaagaaacgttagcagtgttaaagcaagccgaaacgtctaaagatgcacaactgcttttcaaagcgtcagagatcctcatcgacgaatcgatgatgcaagaaaacgttgatcaagggttgctttatctcaagcagtccgccgatctcgataacctagaagcactgagtactttggcggagcactattactatgaggaagcatatcagcaggctctaccgctctatcaaaaactggccgagaaaggtgatgccattgcgctttactacttgggtgtgatgtattttgatggtgaaggtgttgaacaggatcagaaaaaaggcaacgaatactacctcgcatccgcgcagaaaggcgatgaagatgcgatgttccaactggctttttcatacaatgacggtttaggcattgagcaagattttaagcaggcgaaccattggttcgcgagcgccgctgaaaagggacatgcattggcgacttttaatcttggtgtcagttacttgcaaggtgaaggcgtggcgcgtgactgccaaaaagccattactctgtttgagcacgccattgaacttgatgacgaatcaaaggcctatcagatcatgggtaaaatctactccgagcctagatacatgcgatcttgtggaatcaaatcggcagactacaaaaaagcgctggagtatttccaatatgcagcggaatggggtgaggagtacagccagtttatgattggttctttccactttaaagggcgtggtgtggagcgtaattacgtcaaagcactggcttggtacaacatcgcttatgaaaatggttatgatgaagctgaaaaggcgatcaaagaagtgaaaggaaaaatgaacgagaaagagatcgccaaagcaggtgaatatcaagaagcgattgaagaaacgctataa

SEQ ID NO: 52938 - protein, 334 aa, Vibrio vulnificus CMCP6
MTRRCTAWLAALPLLLSSVSHAYDLTYEDFDEETLAVLKQAETSKDAQLLFKASEILIDESMMQENVDQGLLYLKQSADLDNLEALSTLAEHYYYEEAYQQALPLYQKLAEKGDAIALYYLGVMYFDGEGVEQDQKKGNEYYLASAQKGDEDAMFQLAFSYNDGLGIEQDFKQANHWFASAAEKGHALATFNLGVSYLQGEGVARDCQKAITLFEHAIELDDESKAYQIMGKIYSEPRYMRSCGIKSADYKKALEYFQYAAEWGEEYSQFMIGSFHFKGRGVERNYVKALAWYNIAYENGYDEAEKAIKEVKGKMNEKEIAKAGEYQEAIEETL

SEQ ID NO: 52939 - DNA, 3498 bp, Bradyrhizobium japonicum USDA 110
  CDS (1)..(3498): transl_table=11
gtgggaaggctggagtcgccgggtggggcgccgaagtcggaaccggacagagtcatgaattcgcgcgtatcgtggagtgttgacggcatcgatccctccgtccgggagcgggccgaagctgctgcgcgcagagccggcatgtcactcaacgattggctgaactccacgctcggcgaaactgccccgccaaactttcgcggaccttacgagcagcgtccgcaacacatgccgaaccaggtaccgagtccggaaagccgcgaagtcgccgacatccaccagcggctcgacgcgatcacccagcagatcgaacggatttcgaagcccacccctcgccaggactcttcacgacaagaggtctcgcgcgagcagggcgtcgcacgccagctcaacgacgcgatctcgcggctcgatgcgcgcctgtcgcaaatctcaaagccgcagcagctgcaaccgcagccgcctcaggctccgcggcccgcacccgtcgagacgcgccagcgccaggccgatgcggtcgagcgcgcggccgcgcaggtctatcgcagttcgccgccgctgagccccgcctcgttcgacgtcgccgttgccgagatcacggcacggcagagcgagctcgacggctttacgcccaggcagatgccgccgcgcgccgcgccgtcgattgcgcccgcggcagctcctttcgccgcgccgatggcgccgcccgcgcccgcctacgctccgccgccaccgcagccggggccggatttctcgtcgctcgagcgccatctgctcaagatcacgagccagatcgagtcgctccagcgccccgacaataccgagcaggcgatcaacgctttccgcagcgagctcgcggagatccgccacgccatcaccgaggcgatgccgcgccgcgcgatcgaatcgatcgaaaacgaaatccgttcgctgcaccgtcgcatcgacgagacccgctcgtccggcaccgacggccaggttctgtcaggcatcgagcacgcgctgtccgacatcaagcaggtgctgcgcacgctgacgccggccgagcagctcaccggctatgacgaggcgatccgcaatctcggcgccaagctcgatctgatcctgcgcgccaatgacgatccgtccacggtgcgccagctcgaaggcgcgatctcggcgctgcgcggcatcgtctccaacgtcgcctccaacgaagcgctggcacggctgtccgaggacgtgcagctgttgtcgtccaaggtcgaccagatcacccgctcgtccggccccggcgacagctttgccgtgctcgagcagcgcatcgcggcactcaccgccgcgctggagacgcgcgagcggcctcagcccgccgagagcaccgagcacctcgaggccgcaatccgtgcgctgtcggatcgtttcgaccgtatgcaggtcggcagcgattcggcctcgacctttgcgcatctcgaacagcgcgtctcctatctgctggagcggatcgaagctgcctccgatccgcgcaacaccaatctcagccgcgtcgaggacgggctgcacgacatcctgcgccatctcgaacggcagcaggcgacctattccgcgctcgccgagagccgcagttcggcgccgtcccccgattccggcatggtcgatctcgtgaagcgcgagctctccgacattcgcttcagccaggccgaaaccaaccgcagcacccaggactcgctcgaagccgttcacagcgcgctcggccacgtcgtcgatcgcctctcgatgatcgagggcgatctgcgcgcggtgcgcaccgcgccgccggcccctgcgccgcagccgatgccgatgccgatggctgcgcccatggagcccgcgccgatggcgcgcgaagctcggcagcaagcacagcagccgaaatacgatccgaagcctgagctgccgaatccggccgccatgcagcagccggcgcattccgccttcgtggccgcgccgcgcgaattccacgccgccgcggcacctgccgctccgccgccggtcccgatggcgccgacggcaccgcaagccgcaccacccttgccgccgcgcgcgatcagtgaaatcctggagccgcatacggcgcccgcccgcgccgcgttggcgccggaattgccgccggatcatccgctcgagcctggcacgcggccgggcggacgcgtggccacgccgtcggagcgcattgccgcctccgagagcgcgatcagcggaattcccactgctccgaaggagccggtgtcgtcgtcgagcttcatcgcggccgcgcgccgcgccgctcaggccgccgccgcgcagccgcccgagaagccggcccgtggcgccaaggccgcaatcgcccgcgccaaggacaagggccaggaaggcgcctcgaccatcacctcgaagatccgctcgctgctggtcggcgcgagcgtggtcgtgatcgtgctcggcaccttcaagatggcgatgaacctgctcgatggcggcagcacgccgccggcaccgcaggcgatggaaaattcggtgagcgagcccgcgccgcaggcttcgccgcctccggtcgagaccaagcccgccatacccgagcaggtcacgccctcgatgacctcgccgacgccgatcggacggcaatcccagaacaatgccgcgccggctccaacgcccaattccggcagctcggcctcggttgaaatcccgcccgctccggcggccgtgccgcctgccgccagcgacgtcaccggcgcgctgtcgggggccagccgcgcgcggctcggcctcgtccaggtgccgccgagcgagaaactgcccgacgctatcggcggcccaggcttgcgcaccgccgcgatgaagggcgatgccactgccgcctacgagatcgccgtgcgctttgccgaaggcaagggcgtcgctgcaaactacgacgaagctgcgaaatggtacgaccgcgcggcgcaggccggcgtgatgcccgcaaccttccgcctcggcacgctctacgaaaagggcctcggggtgaagaaggacgccgatatcgcccgccgctactacacgcaggccgccgagcgcggcaacgccaaggcgatgcacaatctcgctgtgctcgatgccgacggcggcggacgcggcgccaattacaagagcgcggcgcagtggttcaggaaagcggccgaccgcggcgtcgccgacagccagttcaatctcggcatcctctatgcccgcggcatcggcgtcgagcagaacctcgccgagtcctacaaatggttcagcctggcagccgcccagggcgatgcggacgctgccggcaagcgcgacgacgtcgccaagcgcctcgatccgcaatcgctcgccgccgccaagctcgcgatccagactttcagcgccgaaccgcagcccgacgatgccgtcaacgtcccagccccgaacggcggctgggacagcgcgccgcaggcgaacgccaagcccgcgccgaagccggtcgcgacgaagcggtcggcgtcagcggcgcactga

SEQ ID NO: 52940 - protein, 1165 aa, Bradyrhizobium japonicum USDA 110
MGRLESPGGAPKSEPDRVMNSRVSWSVDGIDPSVRERAEAAARRAGMSLNDWLNSTLGETAPPNFRGPYEQRPQHMPNQVPSPESREVADIHQRLDAITQQIERISKPTPRQDSSRQEVSREQGVARQLNDAISRLDARLSQISKPQQLQPQPPQAPRPAPVETRQRQADAVERAAAQVYRSSPPLSPASFDVAVAEITARQSELDGFTPRQMPPRAAPSIAPAAAPFAAPMAPPAPAYAPPPPQPGPDFSSLERHLLKITSQIESLQRPDNTEQAINAFRSELAEIRHAITEAMPRRAIESIENEIRSLHRRIDETRSSGTDGQVLSGIEHALSDIKQVLRTLTPAEQLTGYDEAIRNLGAKLDLILRANDDPSTVRQLEGAISALRGIVSNVASNEALARLSEDVQLLSSKVDQITRSSGPGDSFAVLEQRIAALTAALETRERPQPAESTEHLEAAIRALSDRFDRMQVGSDSASTFAHLEQRVSYLLERIEAASDPRNTNLSRVEDGLHDILRHLERQQATYSALAESRSSAPSPDSGMVDLVKRELSDIRFSQAETNRSTQDSLEAVHSALGHVVDRLSMIEGDLRAVRTAPPAPAPQPMPMPMAAPMEPAPMAREARQQAQQPKYDPKPELPNPAAMQQPAHSAFVAAPREFHAAAAPAAPPPVPMAPTAPQAAPPLPPRAISEILEPHTAPARAALAPELPPDHPLEPGTRPGGRVATPSERIAASESAISGIPTAPKEPVSSSSFIAAARRAAQAAAAQPPEKPARGAKAAIARAKDKGQEGASTITSKIRSLLVGASVVVIVLGTFKMAMNLLDGGSTPPAPQAMENSVSEPAPQASPPPVETKPAIPEQVTPSMTSPTPIGRQSQNNAAPAPTPNSGSSASVEIPPAPAAVPPAASDVTGALSGASRARLGLVQVPPSEKLPDAIGGPGLRTAAMKGDATAAYEIAVRFAEGKGVAANYDEAAKWYDRAAQAGVMPATFRLGTLYEKGLGVKKDADIARRYYTQAAERGNAKAMHNLAVLDADGGGRGANYKSAAQWFRKAADRGVADSQFNLGILYARGIGVEQNLAESYKWFSLAAAQGDADAAGKRDDVAKRLDPQSLAAAKLAIQTFSAEPQPDDAVNVPAPNGGWDSAPQANAKPAPKPVATKRSASAAH

SEQ ID NO: 52941 - DNA, 1530 bp, Salmonella enterica subsp. enterica serovar Typhi Ty2
  CDS (1)..(1530): transl_table=11
atgcgtttttcatcaattttcaaaataataatattaaatatatttatttcaaaaatggctcacgctgctgtctgcgaggagcgctatccccccgactcagaagaatgccagtacgttcaggaattagagcaaaaagcggaacaaggagatgaaggcgcgcagttctcgcttggaagctggtatgcggaggggcgatacgttaagcctgattataaactagccataaaatggctggagaaagcgggtaaacaaggttctgatttttcctatttcatccttggctatcattacaactatggtgaaaattttccacttagtcggcaaaaagcgctggagtggtatcgcaaggcggcagaactaggggatagtagtacgcaagaaatcctcggtgacgcctatatgtatggcgatgggtttccccaaaatacccagctagcgctggagtggtatcgaaaagccgcctctccaaccaatgatgcgggcgttgtccgcggccagggttcagcttcgtcagcacaatttaagcttggagtaatgtacgcccacggtcagggcgttcctcaggattatcagcaaacggcgatcttgatgcgtaaagcggcggaaaatatgtactaccccgcgcaactttatctcggtgttgcctatttttatggtgaaggcgtgcctcaggattatcgtcaggcagtttactggcttaatgaaggtataccaggcagctatacgccaggccacattccgctgaatgcgctctatgataaagcgcatcccgctgaccaggttcactctcagacgtggtatcgaaaaacagcgcaacgcgtgatggcaaaggtacagttcaattttggcgtatggtattacaacggttatcacttattgaaagatcacaatctggcgctggagtggtatcgcagagccgcagcgcagggattggccgaggcgcaggatgcgatcggcgtgatgtttatgcagggcgaggccgtttctcaggactaccaacaggcgctggcgtggtatcgcaaagccgcacgccagggactgcctgctgcgcaaacgcatctgggcatcatgtctgcttttggtcgcggcgtcgcgcaaagcgacagacaggctatcgcatggtatcgaaaagcagcaaaacaggattttgcgaaagcgcaatatcagcttggcgtagcatatagcatgggaagaggcgtgcctgaaaatagccggaatgcgctgaagtggtaccttaaagcggcagagcaggggtttactccggcacaattagcgcttggggaaatttatgctcatgggcgccagggggtgcctaaagataataagcaggcctatatttggtattacatggcaagtatatatacggaaaaatctaaggatgattgttcagcgctcattgccgaaagaaaccgactcaagggaacgcttaccccagatcaacttagcgagacatatgccgcctttgatctcatcaggcgaaaaatcaaccagtcaaaggaggcgaaaaagattgccaggaagaagtattga

SEQ ID NO: 52942 - protein, 509 aa, Salmonella enterica subsp. enterica serovar Typhi Ty2
MRFSSIFKIIILNIFISKMAHAAVCEERYPPDSEECQYVQELEQKAEQGDEGAQFSLGSWYAEGRYVKPDYKLAIKWLEKAGKQGSDFSYFILGYHYNYGENFPLSRQKALEWYRKAAELGDSSTQEILGDAYMYGDGFPQNTQLALEWYRKAASPTNDAGVVRGQGSASSAQFKLGVMYAHGQGVPQDYQQTAILMRKAAENMYYPAQLYLGVAYFYGEGVPQDYRQAVYWLNEGIPGSYTPGHIPLNALYDKAHPADQVHSQTWYRKTAQRVMAKVQFNFGVWYYNGYHLLKDHNLALEWYRRAAAQGLAEAQDAIGVMFMQGEAVSQDYQQALAWYRKAARQGLPAAQTHLGIMSAFGRGVAQSDRQAIAWYRKAAKQDFAKAQYQLGVAYSMGRGVPENSRNALKWYLKAAEQGFTPAQLALGEIYAHGRQGVPKDNKQAYIWYYMASIYTEKSKDDCSALIAERNRLKGTLTPDQLSETYAAFDLIRRKINQSKEAKKIARKKY

SEQ ID NO: 52943 - DNA, 1848 bp, Rattus norvegicus
  CDS (1)..(1848)
atgcaggaagcagaagccatctatcagagcgggatgaagatcctgaacggcagcaccaggaagaaccaaaagagagaagcatatcggtaccttcagaaggcagcaggcatgaatcacaccaaagccctggagagagtgtcctatgctctcttgtttggtgattacctcacacagaatatccaggcagctaaagagatgtttgagaaactgactgaggaagggtctcccaaaggacaaactggtcttggctttctctacgcttctggacttggtgttaattcaagtcaggcgaaggctcttgtgtattacacttttggagctcttggaggcaacctgatagcacatatggttttgggttaccgctactgggctggcatcggagtcctccagagttgcgagtcggcactgacccattatcgtcttgttgccaatcatgtcgctagtgatatctccctaactggaggctctgtagtccagagaatacggctgcctgatgaagtggaaaacccagggatgaacagtgggatgctggaagaagatctgattcagtattaccagttcctagctgagaagggtgatgtccaagcacaggttggtctgggacagctgcatctgcatggagggcgtggagtagaacagaatcaccagagagcatttgactacttcaacttagcagcaaatgctggcaattcacatgctatggccttcctgggaaagatgtattctgagggaagtgacatcgtgcctcagagtaacgagacggcacttcactacttcaagaaagctgctgacatgggcaacccggtgggacagagcggacttggaatggcctacctctacggaagaggagttcaagttaattatgacctggcactcaagtatttccagaaagctgctgagcaaggctgggtggacgggcagctgcagcttggctctatgtactacaatggcattggagtcaagagagattataaacaggccttgaagtattttaatttagcttctcagggaggccatatcttggctttctataacctagcacagatgcacgccagcggcacaggggtgatgagatcctgccacactgcagtggagttgtttaagaacgtgtgtgagcgtggtcgctggtcagagaggctgatgactgcctacaacagctataaagacgacgactacaacgccgctgtggtccagtacctcctgctggcggagcagggctacgaggtggcgcagagcaacgcagccttcatcctcgaccagagagaagcaaccattgtaggtgagaatgaaacttaccccagagctttgctgcattggaatagggccgcctcccaaggttatactgtggctagaattaaacttggagactaccatttctatggatttggcactgatgtggattacgagactgcgtttattcattaccgcctggcctcagagcaacagcacagtgcccaagctatgtttaacctggggtacatgcatgagaagggcctaggcattaaacaggatatccacctggcaaaacgcttttatgacatggcagccgaagccagcccagatgcacaagtacctgtattcctcgcactctgcaaattaggtgtcgtctatttcttacagtacatacgggaagcaaacattcgagatctattcacacaactggatatggaccagctcttgggacctgagtgggatctttacctcatgaccatcattgcactgctgttgggtacagtcatagcctacaggcagcgacagcaccaggacataccagttcccaggcccccagggccacggccagctcctccccagcaggaaggacccccagagcagcagccaccacagtag

SEQ ID NO: 52944 - protein, 615 aa, Rattus norvegicus
MQEAEAIYQSGMKILNGSTRKNQKREAYRYLQKAAGMNHTKALERVSYALLFGDYLTQNIQAAKEMFEKLTEEGSPKGQTGLGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDDDYNAAVVQYLLLAEQGYEVAQSNAAFILDQREATIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIREANIRDLFTQLDMDQLLGPEWDLYLMTIIALLLGTVIAYRQRQHQDIPVPRPPGPRPAPPQQEGPPEQQPPQ

SEQ ID NO: 52945 - DNA, 3135 bp, Coxiella burnetii RSA 493
  CDS (1)..(3135): transl_table=11
atgaaacgaatagctgtttttatcttaacgttaagttttttttcaattagttattctgataaaaaccctgtcttccaggagtattacgaaggcaactatcgcgcggccgaaactggcttaaaacaattagcggaaaaaaataatggggaagcgacattttatttggccaccatgtatatgaatggttttggagttcggagagattttgagaaaggatttgattatatgacgcgcgcggcggaattaaaatatttgccggcccaattatatctggggaattattattttcaacagcagaaagatttggaaaaggccgtgccttggtttaaaaaagcagcggatgctggggatgctggtgcgcaactttttactggaattagttatttgaatggatacggtgttaaaaaaaatattgatattgctagaaaatatttcattagagccgctcaaaacgaaattccaatgggtcaatatgagctagccaaaattttcttagccagcaggcacgctggcgatagacgaatgggaagaatttggttaaccaaagcggctgataaatataactatccagatgctcagtatttactgggtacaatgctatatactggaaatgaagcagaaaaagatcctgtcaaaggggttgaatggttggaaaaagcggctgctaacggaagtaaagaagcaagcaaaacattggataaaattaatcgaattaataccagcgatgccaaggcgaatagtgagaatcgttctgagcccacgccttggcaaatcatggttggactcatgcaaaaagcaggcgttcagttaaacaaccccattacagtcactgcgtctatcaacaattttactaaaacgccgaaatccatggccttagataaaaattctataattaaattaaatttaaatttagtaaattctaaagacattccgcccgaaaaaattctatcttacatgacacaattaaattataaagaagaaaaatttgatctaaccgtccctgcttatccttttgaaatgccgcctggagctaataactacaaagaggcttttcaatccctctcccgagtggccaattacggttatgctcaatcactctttagattggggcaaatgtatgagaatggattaggtgttcaaaaagaccctgaaactgcatttcaattgtatatgaaagcggcggaacaaaattatttaaaagcccaatacgctattggaacttattatttacaagggaaaggggttcctcaagattatgagaaagccatcagttggtttataagggctgctctgaaaggcagtttacaagctcaatttgtcctaggcaacatttatgagcgaggcattaaagctagcaataataaaattcttttcaagaactttgatagggcgaaagctatgtacagcttagctgtgggtggaaacttacctattgctgcgtatcgtttagcagaactttatgtcagcggttttctaaatcccgataataatgtttctttagaaacacaaaattggaaaaaagcctatgcactttaccaaaaagcagcaaaaagtggcctagagaaagctgatgtggctctaggttatttttatttgcaacaaaatcagaccactttggcagagaaaacgtttgagatagcacaaaaagcttatcaaacgaatgatccagaagccgctatgttattagctattttatatgatcgtggtttcggagttaatagaaacagccgaaaatcagccgaaattttagaaaaactttcaaaacaaaacaatgctattgcacaatttatgttaggtaattattaccttaaaaacaagcgaaaagagaatatagcaatcagtcttttagaaaagtcagctaatcaaggaaacggttatgcgaagtataatttagctattttagcgaaacaaaataaatacaccaagccgggagaaaactttttatcgttactgattagagccgctaaccattacgataaaataaaagagattttggcggattattatcttttagacaccccagttcccggatcagaaaaaaaagctgtcgctatttaccaagaattagctaataaacaagatccagcagcggagttaaaattaggatttatgaatgagcatggtcttctttttccgaaagattaccataaagcagaagagtggtaccaaaagtcggctgaacaagggaatcccatcgctcaatatttattaggaaacatgtactatttgggtcggggcgttgatcgcgatgttaacaaggccatcgattggttaaaaaaatcggctgcccaaaattacgtgcccgctaaagtaggacttggctttatttatgaaatgagcaaacataattatccagaggctaaaaagtggtataccttagcttctaagtttcataaccctcaagcgctctataatctgggtttaatgtatgagtatggaaaaggagttaaaagtgatccacaaaaagctttccgcttatacaaagacgcggcccaaaacgggctcgatttggcggcggttcaggttgcaggaatgtatctaaagggaacgggcattggttttgatcctaacaccgcattaaaaatgtatagccaagcggcgcaaaaaaataattcatttgcgacttatcaattaggtttgatgagcgagtcaggcgttgcgcaaaaaatcgatcttaataaagctcgattgtactatgaaaaagccgctaaagagggaagcgtagaagcacaattagcgctagctcgattttatgaatttggtatcagcgttccagcagacatttcaaaatcgattaacttttaccaagccgcagctgctgaaggaaatgaatttgctaaacaacaattaacccgtttatcgaatcaaggaaaatcttcctctaatgcaatgccatttcaatgtgtgaatcaagtagctctggaaaaagtaaaaaattcattctggaaaaaagtcaccgactggattgcaccggtgcccaatattgattacatgaatgccattgattatttaaattctggtaaagttgagcaagcaacaacggctttgcagaaaattataaaagtaagacctaatttccagcccgcaagagagacggtttctcattatttctgtcaaaaagcagatagaaaatag

SEQ ID NO: 52946 - protein, 1044 aa, Coxiella burnetii RSA 493
MKRIAVFILTLSFFSISYSDKNPVFQEYYEGNYRAAETGLKQLAEKNNGEATFYLATMYMNGFGVRRDFEKGFDYMTRAAELKYLPAQLYLGNYYFQQQKDLEKAVPWFKKAADAGDAGAQLFTGISYLNGYGVKKNIDIARKYFIRAAQNEIPMGQYELAKIFLASRHAGDRRMGRIWLTKAADKYNYPDAQYLLGTMLYTGNEAEKDPVKGVEWLEKAAANGSKEASKTLDKINRINTSDAKANSENRSEPTPWQIMVGLMQKAGVQLNNPITVTASINNFTKTPKSMALDKNSIIKLNLNLVNSKDIPPEKILSYMTQLNYKEEKFDLTVPAYPFEMPPGANNYKEAFQSLSRVANYGYAQSLFRLGQMYENGLGVQKDPETAFQLYMKAAEQNYLKAQYAIGTYYLQGKGVPQDYEKAISWFIRAALKGSLQAQFVLGNIYERGIKASNNKILFKNFDRAKAMYSLAVGGNLPIAAYRLAELYVSGFLNPDNNVSLETQNWKKAYALYQKAAKSGLEKADVALGYFYLQQNQTTLAEKTFEIAQKAYQTNDPEAAMLLAILYDRGFGVNRNSRKSAEILEKLSKQNNAIAQFMLGNYYLKNKRKENIAISLLEKSANQGNGYAKYNLAILAKQNKYTKPGENFLSLLIRAANHYDKIKEILADYYLLDTPVPGSEKKAVAIYQELANKQDPAAELKLGFMNEHGLLFPKDYHKAEEWYQKSAEQGNPIAQYLLGNMYYLGRGVDRDVNKAIDWLKKSAAQNYVPAKVGLGFIYEMSKHNYPEAKKWYTLASKFHNPQALYNLGLMYEYGKGVKSDPQKAFRLYKDAAQNGLDLAAVQVAGMYLKGTGIGFDPNTALKMYSQAAQKNNSFATYQLGLMSESGVAQKIDLNKARLYYEKAAKEGSVEAQLALARFYEFGISVPADISKSINFYQAAAAEGNEFAKQQLTRLSNQGKSSSNAMPFQCVNQVALEKVKNSFWKKVTDWIAPVPNIDYMNAIDYLNSGKVEQATTALQKIIKVRPNFQPARETVSHYFCQKADRK

SEQ ID NO: 52947 - DNA, 1851 bp, Streptomyces avermitilis MA-4680
  CDS (1)..(1851): transl_table=11
atggacgttatgggggacaaggcaactctgttggaaacagggcgttttgcgcagcctgccgactttgtgcagcctgccgacattgcgcagccttccgaccgggacgaaaccggcgaggctgcagaggaggcgcgccgtcggctcgccgccgaagcgggcgacgtggaggcgaagagcgtcctcggagccatgctgctgcgacgcggcgatctcgacggcgcggagccccagctgcgcgccgcgaccgccgccggtgaccgtgccgccgccaacaacctgggtgtcctcctgcatcagcgtggatacgccgaggaggcggccggctggtggcggatcgccgccgtcgccggttccgccgcggccgcgcacgcgctcgggcgccaccaccgcgagcgcggcgacgagcccgcagccgagtactggctgcgccagtccgccgagcagggccacgccctcggcgcgtacgcgctcgccgacctgctggagcaccgcaacgacgcccgcgcggagcagtggatgcgggccgcggccgagcgcgggcaccgcgaggccgcctaccggctggcgcgcgcgcttgatcgcaaggtcgcggacgcgggtgagccgggcgctgacaacggtgtcataggagcaggcggtgaagaggccgcgcagtggtaccggcaggccgccgcgcgcgggcaccggcgcgcggcgctgcatctcggggcgatcctggagaagcggggcgagctcaaggaggccgggcggtggtatctgacgtccgccaaggacggcgaggcgcgcgccgcatgcgccctcggcttcctgctgcgggacgcgggcgacagcgagagcgccgccgtgtggtggctgcgggccgcccaggacggcgacgggaacgcggcgaacgcgctcggcgccctgcacgccgagcgcggcgagacccagaccgccgagcggtggtaccgggccgcgatggacgcgggcgatgtgaacggcgcgtacaacctgggcctgctctgcgccgagcagggacggaccgcgcaggccgaccagtggtaccggcgtgcggcgtacgccggacaccgggaggcggccaacgcgctcgccatcctgctgctccaggtcggcgacgcggccggggccgagccctggttctccaaggccgcggaggcggggagcgtggacgccgcgttcaacctcggcatcctgcacgccgggcgcggcaccgaggaagacgatgcggcggcactgcgctggtacgagcgggcggctgccgccgggcacaccgaggcggcgctccaggtcggcatcgcgttgctgcgcgacggggacgagcaggcggcggagcggcaccttcggtgcgcggcgggcgggggcagtgccgaggccgcgtaccggctggcgtccgtgctggacgcgcgccggccgcccgcgcccgcgcacgagctgggcgagcccgcgcacgagaagaccgagtgcgaggagtggtacgagcgcgcggcgtcccaggggcaccggcgggcgcaggtgcgggtcgggatgctggcggcggcccgaggggacgtggtggaggcggcccggtggtaccgggaggcggcggaagcgggctcccggaacggggcgttcaatctggggctgctgctggcccgcgagggaagtgagccggaggccgcgctgtggtggacccgggcggccgatgccgggcatggacgggcggcgttgcggctggccctggtctacgcgcgtcgcggggagcttgtcgaggggcagcggtgggcggaccgagcggtgtctctgggacccgccgaggtctccgagcgtgccgcccggctacgggatgccttgcggcaggagctgtcggcctga

SEQ ID NO: 52948 - protein, 616 aa, Streptomyces avermitilis MA-4680
MDVMGDKATLLETGRFAQPADFVQPADIAQPSDRDETGEAAEEARRRLAAEAGDVEAKSVLGAMLLRRGDLDGAEPQLRAATAAGDRAAANNLGVLLHQRGYAEEAAGWWRIAAVAGSAAAAHALGRHHRERGDEPAAEYWLRQSAEQGHALGAYALADLLEHRNDARAEQWMRAAAERGHREAAYRLARALDRKVADAGEPGADNGVIGAGGEEAAQWYRQAAARGHRRAALHLGAILEKRGELKEAGRWYLTSAKDGEARAACALGFLLRDAGDSESAAVWWLRAAQDGDGNAANALGALHAERGETQTAERWYRAAMDAGDVNGAYNLGLLCAEQGRTAQADQWYRRAAYAGHREAANALAILLLQVGDAAGAEPWFSKAAEAGSVDAAFNLGILHAGRGTEEDDAAALRWYERAAAAGHTEAALQVGIALLRDGDEQAAERHLRCAAGGGSAEAAYRLASVLDARRPPAPAHELGEPAHEKTECEEWYERAASQGHRRAQVRVGMLAAARGDVVEAARWYREAAEAGSRNGAFNLGLLLAREGSEPEAALWWTRAADAGHGRAALRLALVYARRGELVEGQRWADRAVSLGPAEVSERAARLRDALRQELSA

SEQ ID NO: 52949 - DNA, 3099 bp, Nitrosomonas europaea ATCC 19718
  CDS (1)..(3099): transl_table=11
atgacaggggcagtccgtcgaaatgtccgaaaaaggctcaataaaaatcagaagcaattaaggcagaactgggaaggttatcaccttttggaatttgccaagactatccggccagtcaaacaggatacaaaaagaagaaaagagcttgatgatcatctcgttagcaatggtatcggcggatttgaaacacttcagaaactgccagctgacaacaagactgcttttactactgaaaaatcagatggtgtttttgaaagcttggcagaatttcaagacatacccacttttgtttgctttttaaactttctggaattctgtcggaattccattccccgcaggccgttggatgtgtttgatggcaatgacacattatcaatcgaaattgacggaaaacgcaaagccgtaacgctggattatgcaatcgatgatttcaagaggcacgccaagactgttgaagaaagacttaaacttgaatcttcccagagcagcactggacaggcagacccaatccagccacgcctaaccatacctcaagcaagagagaacaatcccaattactttgccaatgctgttttggatgtgattggtcgtgacgagcaaaaatctcgtttaaaagcgtttttggaatgcgataaaaatgttgcatggtttcagcttgcaggtgttgccggacaaggcaaaagtcgcttggcatttgatttaatcaaagttgccgaagagttaggttttcgagccggttttcttacagaaaatgacatcaagtttttcaaagatcagtggaaggactggcaacccgacaagccctatttgctgatattcgattatgtgattgggcgcgaagaacaaatcaaacccatttttcaaactctaatttccaatcaagatggttattgtcacaatatccgtattctcttggttgaaaggcagcgatgggatcagggaaacgtaatagaaacacaagatcaaatcaacaaagatgcaccacggcaattaatagctatcagcaataaagcgccatggtttctcaagctgtgtgaagaaggtgactctgaaggtgaacgtctcgccccctttcgttttgataacggtgttgaagaacttaaagaacttggtcaagataatctggcttcaatagttaagcagttattatccggcaaaaccctcaccctatccgatgatgtgttagaagaaacattggaacggatcgataatactggccgtccattgtatgcttatttactagcacaacaattaagcgaaagtgaggaaggttttcgaagctggacaaagatcgatttgctgaatggtcagctgaagcgagataaaagacgctgggagcaggcttttaacgataaagcgccaacttggggggattctcatgaagctatgaagctagctgtacttgcaaccattgttcgccagataaattttgaggatgaaataattaaatcaaattttggccatatcgattcatctcttggaaaagaagccttagctattacgaacagctatcttgttaataatgataatcgtcctcataaaattcatgcattagaacctgacttattgggtgaatggtttgttttgtattgtttttaccaaggccttaatttcgaagaattattaaacattgcctgggaatattcaccaaatgatacagcaatgtttctaataagagttatgcaagattttattgatttaacaaaaacatataatgactggaacttaaccgaaaaactgttagcgcataaacccccgcatgaaaaccattatctagttttagccagagttgcagtctttatctcttatgaactaggtcgtagaaatttaacaatacctcataacattatcattgcattagaacatgctgcaaatttgtctaatgttattgctatggattaccttggtttcttttaccaacaaggcctaggagttgtaagaaatcctgaaaaagctatttattggtttcaaatggctgttaataaaaaaagcgatacagccatggttaatctaggaatttgctatcaaaaaggcgaaggggttaaacagaatctaaatgcagcattcaaactgtttcaacgagcagttaagctagataacagcacagccatgttctatcttggcctttgctatcaaagaagtgaaggagttaaggaggacttaaatgaagcttttgctctatatcagcaggcggctgataaaggtaacagtacggctacagcatatcttggtctttgttatcagtatgaagtgggagttaagcaggatttagacaaagccatttctcaatatcaacgggcagttgatgaaggcaatagtttggctatggtatttcttggacgctgctatcaatatggcgaaggagtcaaccagaacataaataaggctattgcactgtatcagaaggcgactgataaaggtgacagtacggctatgacatgtcttgcactttgttaccaagatggcaaaggagttgatcaagactggaataaggctattaacttgtatcagcaagcagttaaaaaaaatgattgtacagccatgtactatcttggcgcttgctatgaaaatggttatggagttaaacaaaatcggagtagtgctatcgaattgtatcggatggctgcaaatcaaggtaatagtaacgcgatggttaatcttggcttttattatcgaaatggcataggagtgaagcagaatcggaaagaggcagttaagttatttcaacgcgccgctaaagtaggtgattacagagcaatgtgcaatcttggtgtctgctatgaaaatggtgaaggagttgatcaagattggaataaagctattagcttgtatcagcaagcaactaaggctggtgagattagagccattagtaatattcaaaatatactcttacgaaattttctaggtgaaggtaattacaaaagtcgaaaaactaatggttgtacaagaaataagctttcacacttagtcgagaaacttgcatttgaccctcccattcttggaggagattggaagccacttctcactgaagaaataaaagcttgtatcgataaagttattgtaccttttgaaattttagatgtagtagttgagatctga

SEQ ID NO: 52950 - protein, 1032 aa, Nitrosomonas europaea ATCC 19718
MTGAVRRNVRKRLNKNQKQLRQNWEGYHLLEFAKTIRPVKQDTKRRKELDDHLVSNGIGGFETLQKLPADNKTAFTTEKSDGVFESLAEFQDIPTFVCFLNFLEFCRNSIPRRPLDVFDGNDTLSIEIDGKRKAVTLDYAIDDFKRHAKTVEERLKLESSQSSTGQADPIQPRLTIPQARENNPNYFANAVLDVIGRDEQKSRLKAFLECDKNVAWFQLAGVAGQGKSRLAFDLIKVAEELGFRAGFLTENDIKFFKDQWKDWQPDKPYLLIFDYVIGREEQIKPIFQTLISNQDGYCHNIRILLVERQRWDQGNVIETQDQINKDAPRQLIAISNKAPWFLKLCEEGDSEGERLAPFRFDNGVEELKELGQDNLASIVKQLLSGKTLTLSDDVLEETLERIDNTGRPLYAYLLAQQLSESEEGFRSWTKIDLLNGQLKRDKRRWEQAFNDKAPTWGDSHEAMKLAVLATIVRQINFEDEIIKSNFGHIDSSLGKEALAITNSYLVNNDNRPHKIHALEPDLLGEWFVLYCFYQGLNFEELLNIAWEYSPNDTAMFLIRVMQDFIDLTKTYNDWNLTEKLLAHKPPHENHYLVLARVAVFISYELGRRNLTIPHNIIIALEHAANLSNVIAMDYLGFFYQQGLGVVRNPEKAIYWFQMAVNKKSDTAMVNLGICYQKGEGVKQNLNAAFKLFQRAVKLDNSTAMFYLGLCYQRSEGVKEDLNEAFALYQQAADKGNSTATAYLGLCYQYEVGVKQDLDKAISQYQRAVDEGNSLAMVFLGRCYQYGEGVNQNINKAIALYQKATDKGDSTAMTCLALCYQDGKGVDQDWNKAINLYQQAVKKNDCTAMYYLGACYENGYGVKQNRSSAIELYRMAANQGNSNAMVNLGFYYRNGIGVKQNRKEAVKLFQRAAKVGDYRAMCNLGVCYENGEGVDQDWNKAISLYQQATKAGEIRAISNIQNILLRNFLGEGNYKSRKTNGCTRNKLSHLVEKLAFDPPILGGDWKPLLTEEIKACIDKVIVPFEILDVVVEI

SEQ ID NO: 52951 - DNA, 699 bp, Nitrosomonas europaea ATCC 19718
  CDS (1)..(699): transl_table=11
atgaagacaatcgcagttcttttgacagccctcctgctggccaccggctgcgggaataaggaatccaccggtgaaacagcatctgatgaaccagaaatcgtaatgatggatgaatccacttccgtcggcgaactcccctcgattctgaaagaaggtttgtcgaataaagaacaggatgagctgaagaaacagatcatgccgatactggatgatggcctcacaccggaacaacgtttcctgaacctgcgcaaggatgcggaggctggcaacgcagaagcgcagaacagcctcggttccatgtatttctccggagaagccatttcccgcgatgcacaagggaaggtgaaggataaagatccagaaacagctgcaggatggttcttccgggcggctgaacaaggccatgccggcgctcagttcaacctcgggctactgtatttcagtggcgagggtgttaccagggacactgccaaagcagtcgaactatttaccaaatctgccgaacagggaaatatcgacgcgcagaacaaccttggcgtcatctatctgatgggcgaaggtgtcaagcagaataccgacaaagctatcgaatggtttgagaaagcggccgaacagggcaatgaagaagctatcaaaaaccttgaagcagtccgcgcatcacagcaagattccaaagaagctgcggacaaacaaaaataa

SEQ ID NO: 52952 - protein, 232 aa, Nitrosomonas europaea ATCC 19718
MKTIAVLLTALLLATGCGNKESTGETASDEPEIVMMDESTSVGELPSILKEGLSNKEQDELKKQIMPILDDGLTPEQRFLNLRKDAEAGNAEAQNSLGSMYFSGEAISRDAQGKVKDKDPETAAGWFFRAAEQGHAGAQFNLGLLYFSGEGVTRDTAKAVELFTKSAEQGNIDAQNNLGVIYLMGEGVKQNTDKAIEWFEKAAEQGNEEAIKNLEAVRASQQDSKEAADKQK

SEQ ID NO: 52953 - DNA, 1467 bp, Helicobacter hepaticus ATCC 51449
  CDS (1)..(1467): transl_table=11
atgcgttgtttgtattttgtaatttgtatgataatgcttggagcgtgtgtaaatccagagccaccactgctaccttgtgatgataaagaaagttgtgagaaagctatcactttattgtttgattctaaattttctgaaaaaaaatttatcaaagtaatagaatatgctactaaagcctgtgatttgggtagtagtaagagctgtatttttttaggtaagttgcatcaagacagctatgaatcttattttcaaaaagaattagcaaagttagcaaagagaaatatagttttagattaccataaggcaaaagcattttatgaaaaagccattagctatggtgcttttgaagcttatatttatttagggtcgctctattttaggggcattggtgtaaaacaagatgacacaaaaggtataggcttacttaccaaggcgtgtgataaaaaaatagttaaaggttgccaaactttaggggatttatatgagtttggaagcgaaactattaaacaaaacttgcttaaagctagtgagttttatacaaaggcttgtgttttggagggtagtttcagaggttgtcatcaattaagtcgtttaggcttacaatattttaaaggcaatggtgtcaaacaagactatgtcaaggcaagagagctttttaccaaagcttgtaatgttgatataggtgagagttgcacaaatttgggcgttttatatggcaatggtatgggtgtgaagcaagattttgcaaaagcacgaacactttacaataagggttgtgatttagagaatggcagagggtgttataatctaggcttacactattttttaggcaaagaaattaaacaagactatacaaaagcaagagaattttttacccaaagttgcaatttatatgattctttaggttgttatgaattaggcactatgtattatcgtggcgaaggtgttttgcaagatgatagaatcgcatatgaatttttgagtaaggcttatgaaattgatgagagtttagattataatgaattgggtttgctgttaacgtggagtgaaaatattaaacacgactatgcaaaggcaaaagcaatctttagtaagtcttgtagtgagggtaacggcattggttgtgtgaatctaggcattttgtatgcctttggtagaggggtaatgacagattatacaaaagcagtggaactctatacgcaagcttgtaatatgaataatcgtgttggttgttataatctaggattactttatagcgagggtaaaggagttaggcaggattatataaaggctagagaattatacacaaaagcttgcaatatgggtgaagcgggggcttgtaataatttgggagttttttatacttatggaaaaggtgtgaggcaagataaggctaaagcaagagaactctttggtaaagcctgtgatatgggaaatcaaaagggttgcgataattataaagactaa

SEQ ID NO: 52954 - protein, 488 aa, Helicobacter hepaticus ATCC 51449
MRCLYFVICMIMLGACVNPEPPLLPCDDKESCEKAITLLFDSKFSEKKFIKVIEYATKACDLGSSKSCIFLGKLHQDSYESYFQKELAKLAKRNIVLDYHKAKAFYEKAISYGAFEAYIYLGSLYFRGIGVKQDDTKGIGLLTKACDKKIVKGCQTLGDLYEFGSETIKQNLLKASEFYTKACVLEGSFRGCHQLSRLGLQYFKGNGVKQDYVKARELFTKACNVDIGESCTNLGVLYGNGMGVKQDFAKARTLYNKGCDLENGRGCYNLGLHYFLGKEIKQDYTKAREFFTQSCNLYDSLGCYELGTMYYRGEGVLQDDRIAYEFLSKAYEIDESLDYNELGLLLTWSENIKHDYAKAKAIFSKSCSEGNGIGCVNLGILYAFGRGVMTDYTKAVELYTQACNMNNRVGCYNLGLLYSEGKGVRQDYIKARELYTKACNMGEAGACNNLGVFYTYGKGVRQDKAKARELFGKACDMGNQKGCDNYKD

SEQ ID NO: 52955 - DNA, 1815 bp, Rhodopirellula baltica SH 1
  CDS (1)..(1815): transl_table=11
atgcagtgtcgacactggattctatcggtagcagtcgctttcggctgtcaggcaatgccgacgaccgccgcctcaaaggaaaacggcgactctcatgttgctcagcagaccggtcgaaaaccaatcgtcgacgagtccatcaccgaccgcggcgaaagcgaccccagtcagactccttcattcgatcaaacgccttcgatgcctaaaaatgtgcctcagcagggcaaaacggcatggagttctttgatcctcggtcgcttgcgagaaatcgacaagacgcccttccgggatgagctggaagcaggccagattcagaagtacgcagaccttgggcatgcacatgcacaatttgtgcttggttgcatgcacgcggaggggcttggcgttccgcagaatgacgttgaagcggttcgctggttccagcgtgctgccgagcaagatttcgcggtcgcacaaaattggctcggttccatgcaccagcagggccgtggaatccgccaggatgatgttcaagcatttcgttggtttcatcgagctgctcaacagggtttgtcagatgcccagttcaaccttgcactttgctaccgccgtggaacaggcacgcctcaagatgattttggggcggttcactttcttaagctggcggcagagcaggatcatagatgggcacaattcgatcttgggtggatgtgctacgaacggagaggtggtgcaggaaacgatgtggactccgttaactggtaccgtcgtgccgcagtcgcgggtttggactcggcgcaatacaaccttggctacatgtacgacgtcggactgggagtggaacaagatttcgtcgaggcctcttcgtggtatcagaaagctgccgatcagaaccatgtcatggcccagcgagcgattggaatgatgtaccgcgacggcgacggggtgacacaagatcactcattggatgtggaatggtttcgcaagtctgcagcgcaagggtatgcgctcgcgcaagaatcgctggcgagcatgtacttccatggtcgcggtgtgccgcatgactaccacgaggcacaggagtggtaccacgctgctgcgacgcagggagagcggtggtcgcagcagaagcttgcctggatgcacatggttggacgtggtgtttccacagatgaagcacttgctttctattgggtgcagaaagccgccatgcaagatctctcatggtctcaagccgagcttggtaggctgtactatccgggccagggtgtgtcgctagacgacgccgacgcgctcagatggtttcgaatggccgcagaacaagatagccccgcggcgcagtacatgatcgggctgatgtatagcgaagggcgaggagtcgaggcggacgaaacaaaggcaatccagtggtatcgaaaagccgccaagcaacactacgccctcgcacaaaacaacctgggcagagctcaccagaagggactgggcgtcgctcaggatgatttgatcgcggtgcattggtatcgcaaagccgcagaacaacagcttcccgtcggccaatccaatctcggattcatgtacttgcatggcaagggcgtcgaggcagacgaagaattggctgttgagctttttagagaagctgctgaggccggtgacgcggaagccatcacggtactcgctcagcgcgatgaatttcatcgatcccggcggctgaagcgtattgcttcaatggtttctaccatcggagcatcactggcattggttctcgtcatggcgagaatcttgagacgtccaaagatgaaaacgttgccgaccgggttgagtggaatgggtggatag

SEQ ID NO: 52956 - protein, 604 aa, Rhodopirellula baltica SH 1
MQCRHWILSVAVAFGCQAMPTTAASKENGDSHVAQQTGRKPIVDESITDRGESDPSQTPSFDQTPSMPKNVPQQGKTAWSSLILGRLREIDKTPFRDELEAGQIQKYADLGHAHAQFVLGCMHAEGLGVPQNDVEAVRWFQRAAEQDFAVAQNWLGSMHQQGRGIRQDDVQAFRWFHRAAQQGLSDAQFNLALCYRRGTGTPQDDFGAVHFLKLAAEQDHRWAQFDLGWMCYERRGGAGNDVDSVNWYRRAAVAGLDSAQYNLGYMYDVGLGVEQDFVEASSWYQKAADQNHVMAQRAIGMMYRDGDGVTQDHSLDVEWFRKSAAQGYALAQESLASMYFHGRGVPHDYHEAQEWYHAAATQGERWSQQKLAWMHMVGRGVSTDEALAFYWVQKAAMQDLSWSQAELGRLYYPGQGVSLDDADALRWFRMAAEQDSPAAQYMIGLMYSEGRGVEADETKAIQWYRKAAKQHYALAQNNLGRAHQKGLGVAQDDLIAVHWYRKAAEQQLPVGQSNLGFMYLHGKGVEADEELAVELFREAAEAGDAEAITVLAQRDEFHRSRRLKRIASMVSTIGASLALVLVMARILRRPKMKTLPTGLSGMGG

SEQ ID NO: 52957 - DNA, 666 bp, Chromobacterium violaceum ATCC 12472
  CDS (1)..(666): transl_table=11
atgagatggggaatcttgctggcgttgctgctggcggcatcgggcgcgcaggcggccgaagccgaggtgccgggctggaaggactaccaggccggccgactggcggccgcccgcatcgccttctggcaggcggcgcagaatggcgaccgggtggcggccttcgacctggcgatgatggactggaagggcgaggccggcgcggcggacaaggcgcgggcggtgtactggctgcagcgttcggcgcagctggggctggaccgggcgcagcacgcgctgggcctgctggccgagcgcggcgatggcctgcccaaatcgctgaccgaggccacgcgctggttcgcgctggccgcgcgccagggttatctgccggcgcagatcgacctggggacccagtatttcctcggccgcggcgcgccgcaggacgaccgcctggccgcctactggtacgaggaggcggccaagcagggcgacgtcggcgcgcagtatctgatcgccagcatgtacgagcatggccagggggtgaagcgggacatcccggcggcgatacgctggtacgcgcgcgccggcgcgcagggcgacgccggcgcgcgggccaaggcgctggacctggccaggcgcgaaacggcgcgccgcgctcagagcgcgtccagcggcagcttcaggtag

SEQ ID NO: 52958 - protein, 221 aa, Chromobacterium violaceum ATCC 12472
MRWGILLALLLAASGAQAAEAEVPGWKDYQAGRLAAARIAFWQAAQNGDRVAAFDLAMMDWKGEAGAADKARAVYWLQRSAQLGLDRAQHALGLLAERGDGLPKSLTEATRWFALAARQGYLPAQIDLGTQYFLGRGAPQDDRLAAYWYEEAAKQGDVGAQYLIASMYEHGQGVKRDIPAAIRWYARAGAQGDAGARAKALDLARRETARRAQSASSGSFR

SEQ ID NO: 52959 - DNA, 849 bp, Wolinella succinogenes DSM 1740
  CDS (1)..(849): transl_table=11
atgaaattgaaaatagtcatcctctcagccctcgcccttgcaacgcttcaggcgggattcatcaaagagggaatggaagccaaagaggggggcgaccatcaaaaactagtcgagatctacgaaaaagcgtgcaatgaaggtaaggcttcggggtgctataacctcggtgtgctttatgaggagggaagcggaaatgtcgttaaggatgtgaaaaaagcgatagggctttatgagaaggcttgtaaggcggacttctcctcagcgtgctataacctcggcgtgctttacatcaaaggggttgatgttaagcaagatattaatagagccaaagagctatatgaaaaagcgtgtaaagcggatgatgatatcgcttgcaatagtttagggcttctctatgccaatggctcaggagtggctcaagattatcagaaggcgagcgagctctatagtcgagcttgccaaagcgggaatctctatgcctgcaataatctaggcttcctctataacgaggggcggggtgtggatcgagattataaaaaggcgagcgaacattaccaaaaagcctgcaatggaggcctagccatgggttgcgataatcttgggctgctccatgcttcgggcaagggagtggccaaggattacaaaaaagccgctcagcttcacgaaaaggcttgccaaaatggctatgagaaggggtgtaataacttagggattctctatgcagaaggcagaggcgtagagcttaatcaagatagggctagagagctttttaagcagagctgcgagaagggattgcaggtgggatgtgagaacggacgccttcttgattctcctcatgtaaagccctaa

SEQ ID NO: 52960 - protein, 282 aa, Wolinella succinogenes DSM 1740
MKLKIVILSALALATLQAGFIKEGMEAKEGGDHQKLVEIYEKACNEGKASGCYNLGVLYEEGSGNVVKDVKKAIGLYEKACKADFSSACYNLGVLYIKGVDVKQDINRAKELYEKACKADDDIACNSLGLLYANGSGVAQDYQKASELYSRACQSGNLYACNNLGFLYNEGRGVDRDYKKASEHYQKACNGGLAMGCDNLGLLHASGKGVAKDYKKAAQLHEKACQNGYEKGCNNLGILYAEGRGVELNQDRARELFKQSCEKGLQVGCENGRLLDSPHVKP

SEQ ID NO: 52961 - DNA, 1044 bp, Vibrio vulnificus YJ016
  CDS (1)..(1044): transl_table=11
atgcgagttcttaaaacaatcataatggacttattaactatgacacgtcgttgtaccgcgtggttggctgcgcttccccttcttctttccagtgtttctcatgcgtatgatcttacttacgaagattttgacgaagaaacgttagcagtgttaaagcaagccgaaacgtctaaagatgcacaactgcttttcaaagcgtcagaaatcctcatcgacgaatcgatgatgcaagaaaacgttgatcaagggttgctttatctcaagcagtccgccgatctcgataacctagaagcactgagtactttggcggagcactattactatgaggaagcatatcagcaggctctaccgctctatcaaaaactggccgagaaaggtgatgccattgcgctttactacttgggtgtgatgtattttgatggtgaaggtgttgaacaggatcagaaaaaaggcaacgaatactacctcgcatccgcgcagaaaggcgatgaagatgcgatgttccaactggctttttcatacaatgacggtttaggcattgagcaagattttaagcaggcgaaccattggttcgcgagcgccgctgaaaagggacatgcattggcgacttttaatcttggtgtcagttacttgcaaggtgaaggcgtggcgcgtgactgccaaaaagccattactctgtttgagcacgccattgaacttgatgacgaatcaaaggcctatcagatcatgggtaaaatctactccgagcctagatacatgcgatcttgtggaatcaaatcggcagactacaaaaaagcgctggagtatttccaatatgcagcggaatggggtgaggagtacagccagtttatgattggttctttccactttaaagggcgtggtgtggagcgtaattacgtcaaagcactggcttggtacaacatcgcttatgaaaatggttatgatgaagctgaaaaggcgatcaaagaagtgaaaggaaaaatgaacgagaaagagatcgccaaagcaggtgaatatcaagaagcgattgaagaaacgctataa

SEQ ID NO: 52962 - protein, 347 aa, Vibrio vulnificus YJ016
MRVLKTIIMDLLTMTRRCTAWLAALPLLLSSVSHAYDLTYEDFDEETLAVLKQAETSKDAQLLFKASEILIDESMMQENVDQGLLYLKQSADLDNLEALSTLAEHYYYEEAYQQALPLYQKLAEKGDAIALYYLGVMYFDGEGVEQDQKKGNEYYLASAQKGDEDAMFQLAFSYNDGLGIEQDFKQANHWFASAAEKGHALATFNLGVSYLQGEGVARDCQKAITLFEHAIELDDESKAYQIMGKIYSEPRYMRSCGIKSADYKKALEYFQYAAEWGEEYSQFMIGSFHFKGRGVERNYVKALAWYNIAYENGYDEAEKAIKEVKGKMNEKEIAKAGEYQEAIEETL

SEQ ID NO: 52963 - DNA, 3396 bp, Rhodopseudomonas palustris CGA009
  CDS (1)..(3396): transl_table=11
atgacgcggaggtgtgcgggcacggctagggccggcttgggtgcggacaagagcatgaatcgcgtgtcgtggagtgtcgaggagatcgagccgtcagtgcgcgagaaggccgaggccgccgcaaagcgcgccgggctgtcgctcaccgactggatcaatgctcagctcggcgaggctgccccgcagcagccggccaccgaacaactgcgcatgcccggccgcccggcgatgcccgagcgcagcgccaccgaagtcgctgaaatccatcagcggctcgacgccatcgctcgccagatcgatcatatttcccgcgccccggcgcgcagcgaaccgccggtcgcccggcagctgaatgacgcgatttcccggctcgacgcccgcttggcgcggatcaccgagccgaagcccgcggcggctcggcctgctgaggccgcagcagtgccgccgcagacgcccaccgaccgggtcgaacgcgccgctgcgcaggtttacccgtccccgacgctcgacccgaacgctctcgacaaggcgattgccgagatcgccgcgcggcagagcgagcttgatgccagcatcggccggatgccgcggcagccggcgtcgtttgctccgccgatcgcgcccgcgatggctccgccgcccccgcaggccggaccggatttcaccagcctggagaagcagctccacaagatcaccagccagatcgacgcgctgcagcgctccgacaaggtcgagcaatcgatcgcggcgttccgcgccgacctggccgagatccgccagaccatcaccgaagcgatgccgcgcaaggcgatcgaaacgctggaaggcgagatccgctcgctggcgcagcgtctcgacgaaagccgcgccaatggcagcaacagcgaagtcatcgtcggcatcgaacgcgcactcggcgagatccacgccgcgttgcgttcgctgacgccggccgagcagctcgccggcttcgacgaagcgatccgcaatctcggcggcaagatcgacatgatcgtccgcaacagcgacgatcccggcacggtgcagcagctcgaaaacgccatcggcgcgctgcgcggcattgtctccaatgtcgcctcgaatgaagcgctggggcagctcagcgccaacgtccacgcgctcggcgagaagatcgagcagctggcgcaggccgacaaccatagcatttcgttcgccgccctggagcagcgcatctcggcgctgaccgcggcgctggaaagccgcgagcgccctgcgccgagcgaatccaccgagcagctcgaaagcgccgtgcggacactgtccgagcggatcgaccatctgccgatcggcaacgataatcagtccgccttcgcgcatctcgaacagcgcgtcgcgcatctgctggagcggatggaagccgcaaccgagcagcgcgacggcagtgccaatctcggccgcgtcgaggaaggcctgcacgacatcctgcggatgctcgagcggcagcagtcgcaatttgacgtgctggctgacatcgaccgccgaccggcaccggccctggatccgagcttcgtcgacaccatcaagcgcgaactttccgacatgcgcttcagccagtcggaaaccgatcgtcacacccaggattcgctcgaggcggtgcacaacaccctcggccacgtcgtcgaccggctggcgatgatcgaaggcgatctgcgcaccgcgcgcgcaacgcctccgctggccccgccgccggctcccgctccggcgcccgaacaggcgaagcccgccttcctggccgcggcgccgatcgcgcctgctccggctgctcccgtggccgcgcctgtcccgccgcagcctcagccggagatggccaatccggccgccgagccgttcgcagccgcgccgcgcgaatttgctgccgccaaacccgccgtcgagccgccggccccggcacccgaaccgcgtgggccgcgggctttccacgacatccacgagtccgccgccggcccgcgtcagccgcagaagatcgagccggtcgttgctgtgccgcagccggcgcgccgggaagccacgttgccgccggaccatccgctcgagcccggtaccaagccgccggcccgggtcgcttcgccgtcggagcggatcgccgcctccgaaagcgcgctcggcgaaatcgctccggcgcagcccgagccggccaacgccaccagcttcatcgcggccgcgcgccgcgccgcacaagcggcggcgtccgccagctccagcgccggcaaggccaagcccggcaagccgaagaccgatggcgacaagcccgatccggacggcggcaccccgggctcgccgctcggctccaagatcaagtcgctgctggtcggcgccagcgtggtggtgatcgtgctgtccagcttccagatggcgatgaaactattcgacagcggcgaagcgccgccggtcgccagcgtcaccgcgccgaagctgagcccggcgccggacaaacagcgcctgcctgcggacgagcggcaatctgatccgactgagcccaccgcgccgccgtctgtggcgccggtggctccgccgccctcgatgatttcgccgactccggtcgagcgccagtcgctgtacacgccgccagccccgccgcagaccgagccggccgcgcccagcgacatcaccgggacaattccgtcgcagccgagcgcggcgccggagaagttcggcaccgtcgcgattccgtccgccgaacggctgcccgacaccatcggcggcgcgacgctgcgcaccctcgcgctcaagggcgatgccgccgccgcttacgaagtcgccacccgctacgccgaaggcaagggcgtgccggtgaactacgacgaagccgccaaatggtatcagcgcgcagcggatgccggcgtgacgccggcgatcttccggatcggcacactgtacgagaagggactcggcgtgaagcgcgacctcgacgtcgcgcggacgctgtattcgaccgctgccgatcgcggcaacgccaaggcgatgcacaatctggccgtgctgtacgccgacggcggcagcaagggcgcgaactacaagaccgccgcggcctggttccgcaaggccgccgaacgcggcgtggccgacagccagttcaacctcggcatcctgtatgcccgcggcatcggcgtcgatcagaacctcgccgagtcgtacaagtggttctctctcgccgccgctcagggcgatgaggatgcgggccgcaagcgcgaagacgtcgccaagcgcctcgacccgcaatcgctggcagccgccaagctcgcgatccagaccttcacggccgagccgcagcccgacgccgccgtcaaggtcgcggcgcccgccggcggctgggacgggcagccggccgctgcggctaagcgcgccgcccgctaa

SEQ ID NO: 52964 - protein, 1131 aa, Rhodopseudomonas palustris CGA009
MTRRCAGTARAGLGADKSMNRVSWSVEEIEPSVREKAEAAAKRAGLSLTDWINAQLGEAAPQQPATEQLRMPGRPAMPERSATEVAEIHQRLDAIARQIDHISRAPARSEPPVARQLNDAISRLDARLARITEPKPAAARPAEAAAVPPQTPTDRVERAAAQVYPSPTLDPNALDKAIAEIAARQSELDASIGRMPRQPASFAPPIAPAMAPPPPQAGPDFTSLEKQLHKITSQIDALQRSDKVEQSIAAFRADLAEIRQTITEAMPRKAIETLEGEIRSLAQRLDESRANGSNSEVIVGIERALGEIHAALRSLTPAEQLAGFDEAIRNLGGKIDMIVRNSDDPGTVQQLENAIGALRGIVSNVASNEALGQLSANVHALGEKIEQLAQADNHSISFAALEQRISALTAALESRERPAPSESTEQLESAVRTLSERIDHLPIGNDNQSAFAHLEQRVAHLLERMEAATEQRDGSANLGRVEEGLHDILRMLERQQSQFDVLADIDRRPAPALDPSFVDTIKRELSDMRFSQSETDRHTQDSLEAVHNTLGHVVDRLAMIEGDLRTARATPPLAPPPAPAPAPEQAKPAFLAAAPIAPAPAAPVAAPVPPQPQPEMANPAAEPFAAAPREFAAAKPAVEPPAPAPEPRGPRAFHDIHESAAGPRQPQKIEPVVAVPQPARREATLPPDHPLEPGTKPPARVASPSERIAASESALGEIAPAQPEPANATSFIAAARRAAQAAASASSSAGKAKPGKPKTDGDKPDPDGGTPGSPLGSKIKSLLVGASVVVIVLSSFQMAMKLFDSGEAPPVASVTAPKLSPAPDKQRLPADERQSDPTEPTAPPSVAPVAPPPSMISPTPVERQSLYTPPAPPQTEPAAPSDITGTIPSQPSAAPEKFGTVAIPSAERLPDTIGGATLRTLALKGDAAAAYEVATRYAEGKGVPVNYDEAAKWYQRAADAGVTPAIFRIGTLYEKGLGVKRDLDVARTLYSTAADRGNAKAMHNLAVLYADGGSKGANYKTAAAWFRKAAERGVADSQFNLGILYARGIGVDQNLAESYKWFSLAAAQGDEDAGRKREDVAKRLDPQSLAAAKLAIQTFTAEPQPDAAVKVAAPAGGWDGQPAAAAKRAAR

SEQ ID NO: 52965 - DNA, 1092 bp, Rhodopseudomonas palustris CGA009
  CDS (1)..(1092): transl_table=11
atgaaggcgctgcgcgcgttcgcgattgttgcggcttcactgctgcttgccaccggcgcggcggcgcaagtttcgctgtcgccgccgtctggccccaacccattcccgaagccgctggagccggaaaagccgaagcccaggccgccggccccggccaaggcacccgccaccgaggcgaaggacaaggccaagaagccgggagacaaacccgacgccaaggccgcccccgagggcggcgcggccacggccgaagatcccaacgtcgacctggtgtacggcgcctatcagcgcggcttctacaagaccgcgttcgaactggcgcagaagcgcgccgccgacaacgacgccaaggccatgaccatgctgggcgagctctatgccaatgccctcggcgtgaagcgcgactacaagaaggcggcggagtggtactcgcgagcggccgatctcggcgaccgcgaggcgatgtttgccctggccatggcccggatgggcggacgcggcggcccgccgaaccgcgaggaagccgccaaatggctcgcacaggctgccaagcttggcgagccgaaggcagcctataatctggcgctgctctatctcgacggccagaccttcccgcaggacgtcaagcgcgccgcagaactgctgcggatggccgcagacgccggcaatccggaagcccaatacgcgctggcgaccttctacaaggaaggtacaggggtaaccaagagcatcgagcagtcggtgcggctgctgcaggccgccgcgctggccggcaacgtccccgcccaggtcgaatacgccatcgcgctgtacaacggtaccggcaccccgaagaacgagccggccgccgtcgcgctgctgcgcaaggcggcgcgcgccaacaacccgatcgcccagaaccgcctcgcccatgtgttggtctccggccagggcgcgccgcgcgacatcaacgaggcgatgaaatggcacctgatcgccaagaccgccggcaagggcgatctgcagctcgaccagacgctggcccagatgtcggccgaggaccgcgccaaggccgaagaggcggcgcggacctggatcggcggcggcaaatga

SEQ ID NO: 52966 - protein, 363 aa, Rhodopseudomonas palustris CGA009
MKALRAFAIVAASLLLATGAAAQVSLSPPSGPNPFPKPLEPEKPKPRPPAPAKAPATEAKDKAKKPGDKPDAKAAPEGGAATAEDPNVDLVYGAYQRGFYKTAFELAQKRAADNDAKAMTMLGELYANALGVKRDYKKAAEWYSRAADLGDREAMFALAMARMGGRGGPPNREEAAKWLAQAAKLGEPKAAYNLALLYLDGQTFPQDVKRAAELLRMAADAGNPEAQYALATFYKEGTGVTKSIEQSVRLLQAAALAGNVPAQVEYAIALYNGTGTPKNEPAAVALLRKAARANNPIAQNRLAHVLVSGQGAPRDINEAMKWHLIAKTAGKGDLQLDQTLAQMSAEDRAKAEEAARTWIGGGK

SEQ ID NO: 52967 - DNA, 642 bp, Geobacter sulfurreducens PCA
  CDS (1)..(642): transl_table=11
atgaagcgcactatcactttaatattattttgtattttagctcagaatgtaacgatgaactattgtttcgccgatgttctttccgaagcatatacatatttcaaaaacaaaaattacgataatgccttaccattactagaaaatcttgtaacagaaggaaatctcgacgcttataatttgctaggaacaatgtacaaaaaaggatattcagtaccacaaaatcctaataaagcaattgagttatatgagtttgccgcaaagaaagggcatgcaggagcacaatataacctaggactaatgtatgaatctggctccggtatattgcaggattattctcaagccataaaatggtataaactcgcagctattcaaaacgattctggtgcgttaaacaatttaggccatatttatcacaatggattaggtgttaagaaaaatatgaaagaggcatgcaattattacggtaaagcagccgcaatgggtgacgcgttgggcaaatgtaatatggctggatgctatgctcaaggcgaaggtgtaaagaaagattataagaaagcaaaagttcttgcaaaagagggctatgaacaaggtgaagcggcttgtagtgaggtctgggatatttttgaactagcaaaacactag

SEQ ID NO: 52968 - protein, 213 aa, Geobacter sulfurreducens PCA
MKRTITLILFCILAQNVTMNYCFADVLSEAYTYFKNKNYDNALPLLENLVTEGNLDAYNLLGTMYKKGYSVPQNPNKAIELYEFAAKKGHAGAQYNLGLMYESGSGILQDYSQAIKWYKLAAIQNDSGALNNLGHIYHNGLGVKKNMKEACNYYGKAAAMGDALGKCNMAGCYAQGEGVKKDYKKAKVLAKEGYEQGEAACSEVWDIFELAKH

SEQ ID NO: 52969 - DNA, 738 bp, Geobacter sulfurreducens PCA
  CDS (1)..(738): transl_table=11
atgctgaatcgcaccacaagaaagatcgccctggttaccggcctgtccctggctcttgcccttccgtcgctgtcatgggcagattttgccgccgggcagcaggcattccggaacggcgactatgagacggcgttgcgggagtacagggaggacgggggcgcccaggcctgttaccggatcggaaccctctacgacaacgggttcggggtccccgaaaacaagcaggaggccctgaagtggtaccacaaggcggcagatctcggcctggaccaggcacagcaccggatcggagaaatgtacgacaacgggcgcggcgtcgaagagaacccggtcaccgccctgagctggtatctgaaggctgccgagcagggaatggcgatcgcccagttcaaggtgggcgacatgtattacaccggaaagggggtcaaacaggacgtggcgctgggggtcaaatggctgcagcaggcggccaagatgggaaacatcagggcccagtacgaaatagcgaccatgtacgagacgggcagggagctgaaaaaggacatctccgaggcggcgaagtggtatctccgggcagcggagcaggggcacagcagggcccagtacaccattgcgctccttttcctcaagggcgaaggcgtcaggcaggatcgggcggaagccgtgaaatggctgcgcaaggccgcggaaggcgggcacaccaaagcccaaatggacctggcaagcctgagccagtaa

SEQ ID NO: 52970 - protein, 245 aa, Geobacter sulfurreducens PCA
MLNRTTRKIALVTGLSLALALPSLSWADFAAGQQAFRNGDYETALREYREDGGAQACYRIGTLYDNGFGVPENKQEALKWYHKAADLGLDQAQHRIGEMYDNGRGVEENPVTALSWYLKAAEQGMAIAQFKVGDMYYTGKGVKQDVALGVKWLQQAAKMGNIRAQYEIATMYETGRELKKDISEAAKWYLRAAEQGHSRAQYTIALLFLKGEGVRQDRAEAVKWLRKAAEGGHTKAQMDLASLSQ

SEQ ID NO: 52971 - DNA, 804 bp, Treponema denticola ATCC 35405
  CDS (1)..(804): transl_table=11
atgaaaaaaatatttttttgtttaatattgtttatgatagctcttttatgctttgcagataaaaaatttgaaaaggtaaaagcagctgccgaacagggagatgcattcgctcagtttaatcttgctgctatgtatgataaaggggacgaatctcttgtcgataaaaaacaagctgtttattggtatacaaaagctgccgaacagggatatgatgtagctcagctttttcttgcttttatgtatgatataggtgatggaattcctattgacaaaaaacaggctttttattggtatacaaaagccgcagaacagggaaatgtagcagcacagtgtattcttggtctaatgtattctaatggagatgggaccccggtagataaaaaacaagctttttattggttcaaaaaagctgccgaacagggatatgcaaaagcacagtttaatcttggtggtatgtattacaaaggcaatggaatactgactgataaaaaacaagctttttattggttcaaaaaagctgccgaacagggatatgcagaagcacagtttaatcttgctcttatgtattataatggagatggaatactggctgacaaaaaacaagctttttattggtacactaaatctgccgaaaaaggactcgcattcgcccagtttaatcttggtctaatgtattctaatggagatggaatactggctgacaaaaaacaagctgcatattggataaagcaagcctatgagaatggttatgagccggcaaaagaactctgggatgcagacgaactttggaaatatcaggattaa

SEQ ID NO: 52972 - protein, 267 aa, Treponema denticola ATCC 35405
MKKIFFCLILFMIALLCFADKKFEKVKAAAEQGDAFAQFNLAAMYDKGDESLVDKKQAVYWYTKAAEQGYDVAQLFLAFMYDIGDGIPIDKKQAFYWYTKAAEQGNVAAQCILGLMYSNGDGTPVDKKQAFYWFKKAAEQGYAKAQFNLGGMYYKGNGILTDKKQAFYWFKKAAEQGYAEAQFNLALMYYNGDGILADKKQAFYWYTKSAEKGLAFAQFNLGLMYSNGDGILADKKQAAYWIKQAYENGYEPAKELWDADELWKYQD

SEQ ID NO: 52973 - DNA, 2397 bp, Eremothecium gossypii
  CDS (1)..(2397)
atggaatcaccgcgttcataccccccatcagaccaggcagaccaggcagaccaggcagaccagcagaagggctccactacgtatgaagagtccgcagtgtactcagaaaactcatacctacattcgctggtggagaatgacggaggtagtggggaaccgcaggctgggaagggccttccgccaatggatgcgctacacatcatggtacccgaccagattgacacaatacagctggatgggaatgtgccagtactagatgataggcttgacctgggtgtcggagagccaccgctagagctgcaagcactggactttgttgctgtggccgacagcttccaagcccaagctgaagcgctgactgttgcgccatatatcaacatagaactgaacggagcatttgataccgaggatttatctgagaaaccgcagcttgcagccggccccctaagcgaagatgctcgtgcttcgggatcatcaacgtcgtcaagggcacaaggatgctcctccttatcacttttaaactcccagagcacttcaactatgcatttaggttcaagtcatggcatgcgttcgagtgtcacaggctcctatgattccagaaaaccaaagatcaaaccagtagatctatcgcatttgtatttggtcaacaacagtgatagtataaccctaacacaaacaaatgaatcggtggcccacttctctcacaagatgataagtgagtgtttaggagatgactcagaatctattttagtgccgaggctgaaggcattggagatgtacaagaagaacgtaaagaagtccaaagatcctgatgttttattccaatacgcccagtatatgctacaaactgcattgactatggatgtcagtccaattatcgaaacggaagaccccagaagaaagggattgtgcaaaaaattgtcacccacagagaaccttaaggagcagtttctcaaagaggctaaggtttatttgactaaacttagtgtcaaaggctacaaagatgcacagtatttgctcgcagatgcatattcttcgggtgcatttggaaaagtaaaccataaagacgcattcatcctgttccagtcctctgccaagcacggccatgtggaggcagcatatcggacggcggtatgcttcgagaagggattaggcaccaccagggattcacggaagtgtatcgagtttttgaaatttgcggcttccaaaaatcatccagccgctatgttcaaactcgggctatattccttccatgggcgcatgggtttgcctaacgatgtcaatacgaaacagaatggtattaaatggctctcccgcgctgccgctagggctactgaacttacatgtgctgcaccctacgagcttgcacaggtttacgaaaacggcttcttggatatcattattccggatgaaagttatgccaccgaactataccttcaagcagctgctcttggacatgttccatcaacaacaaagttaggaaagctctatgagcagggcaatgaaattgttcctcaagatacctccctaagtgtgcattactataccgatgctgccatgaaaggggatccagaagccatgttaggcctctgtgcctggtacctcattggcgcgcaaccggcattcgaccgcgacgaccgtgaggcctttcagtgggcactaaaagcagctaagaaaggatacggaaaggcccagtatacagtgggatacttccatgaaaacggtaaaggatgtaagaaagatattgacatggcctacaagtggtatgagtgtgctgccgataatgaagatccaagagctcttcgcaaattggctagtcgtacggataaaaagaagagaaacagtaccgttttcaacttctcctttctgaagccagacgatttcgagtcgaaattacaacgtatggatgttggtgagtattcccctttatgtctggatttccagggcacattagcacggaccaatgcagcatcccgcagtaaacacggtatcaatacaagctgcagctacgatgttataaacgtcataactgatgaccaatctctgggaatggagatggatgacggcatgcaacgtccagctcaacaaagatgtctaacaccaatatcacgacagacttctagcttcttatcggaagtcagcccataccaaagctcaaacaaccctatggcgcctaactatgcggctgaaaatcaagcagtggaactaagacctgttgccacaggtcagacatcgaacagtagtacgagttgtggcccacgggaaaaagatcaagaaataatgccaagtaatatacctggagaacgttggcatacatctgctgcccctgaaggggcaccattcaataacgttgcgccaaaaaaggtaacggacagaaacgtctgtgttataacttaa

SEQ ID NO: 52974 - protein, 798 aa, Eremothecium gossypii
MESPRSYPPSDQADQADQADQQKGSTTYEESAVYSENSYLHSLVENDGGSGEPQAGKGLPPMDALHIMVPDQIDTIQLDGNVPVLDDRLDLGVGEPPLELQALDFVAVADSFQAQAEALTVAPYINIELNGAFDTEDLSEKPQLAAGPLSEDARASGSSTSSRAQGCSSLSLLNSQSTSTMHLGSSHGMRSSVTGSYDSRKPKIKPVDLSHLYLVNNSDSITLTQTNESVAHFSHKMISECLGDDSESILVPRLKALEMYKKNVKKSKDPDVLFQYAQYMLQTALTMDVSPIIETEDPRRKGLCKKLSPTENLKEQFLKEAKVYLTKLSVKGYKDAQYLLADAYSSGAFGKVNHKDAFILFQSSAKHGHVEAAYRTAVCFEKGLGTTRDSRKCIEFLKFAASKNHPAAMFKLGLYSFHGRMGLPNDVNTKQNGIKWLSRAAARATELTCAAPYELAQVYENGFLDIIIPDESYATELYLQAAALGHVPSTTKLGKLYEQGNEIVPQDTSLSVHYYTDAAMKGDPEAMLGLCAWYLIGAQPAFDRDDREAFQWALKAAKKGYGKAQYTVGYFHENGKGCKKDIDMAYKWYECAADNEDPRALRKLASRTDKKKRNSTVFNFSFLKPDDFESKLQRMDVGEYSPLCLDFQGTLARTNAASRSKHGINTSCSYDVINVITDDQSLGMEMDDGMQRPAQQRCLTPISRQTSSFLSEVSPYQSSNNPMAPNYAAENQAVELRPVATGQTSNSSTSCGPREKDQEIMPSNIPGERWHTSAAPEGAPFNNVAPKKVTDRNVCVIT

SEQ ID NO: 52975 - DNA, 2163 bp, Yersinia pestis biovar Medievalis str. 91001
  CDS (1)..(2163): transl_table=11
ttgaaaaaaaaactggtggcactcttaatactctcttatccgtcggttgcatatctaaagcaaccccctccggcagtacctaaacccattacctttgttgctaaaattgataacattgattttaacaaaacggccattgatagtgatatgaaattactgctggccgatcggttccactttaaaaccaaaaccccctgtaacaagaatacgctttcaggccggccagaatcatttggtttaacgtcagaagtatacgcggcaaaaatcaagagtttgctcgttgagatcttaagtgaacgttaccttttcctgacaatagatcaatgtgaccgcggtggcacaccgatgctcaccaatatagaagtttgcactgaagcactgtgcggtgctgaattcatgaaaaaagaatcttatctttggttaaatcaagacttaaaggccacggtgaaacgccaggcgacatcggtgatccctatgccattaacctttgataaagaaaagcaactgtggaaagtggccgggtggtttattgagtcatcagaagaaactgaggaacttataccgagcaaactgctggcctttgaaggttatactgacgatgaaacattcaaaacacaaaaattcgtctctaccttcaaatcctattactccagtggaaatattcaacatattctcacttataataaagagggaaaagaggatgggaaatacgactcatattatgatgaaaaagggaaattagctgagacgttggtatttaaaaatggcttggtcaatggtgagtatattatctaccatgaaaatggtgctattgaaagcaaacgacattttattgacagcaaaatagccgacggagagtgccctcattattacgacaatggaaaaattaaagagaaccatagctatttgaataataaactcgaagggaaatactttgagtattttcctgatggtaaaattaaagatgaaagaacctaccatgctggcaaagtcgttggtaaatacacagtctactttgaatcaggtaaaattagagctatttataataaaaacaataaagatcagtaccatggaactaacgaggaatacagccccgaagggcagttagtgtctaaatcaacgtataaagaaggaaaacaactctctagccagacttggtataaaaatggaaaaatgcgacaggaagaaatctacgataacgaaggccgcaaaaatggcgtatcaagagagtggtttgataatggacaacttaatacatcaaccagctataaaaatgatatcttagatggtgatagccagaaatggaacgaacagggtgaaatagtatcactctcaccgtataaagacggcaaacttcagggtgaacataaatattatgattcaggaaaactactttataccacaatgtataagaacgataaaaaagatggtccggatagacgatggagtatcaatacagggaagttaattgaagaaatgccctatgttgaaggcataagaagcggcatcaaaaaagagtttaatgatcgtaccggtagactgttaacaaccaccccttatgtgaataatgaaatacagggcaccggagaaacatataatgccgatggtgttagcattattcactgctatatcaataataaaagtattgactcgctatacaatcctattgaaatacgcgagaaagcctcacagagtgatgataatgcacagtatgaactgggtaagtatcattatacttgtcaagactatgatagaggtcttaagtggctagaaaaatcagcagaccataaaaatattaaggcgttatttcttttagctcaaatgtataatgaaggtgacggcgttaaagaagatcaaaccaaatatttctcctatttactcaaagcagcgcagttagggctaagtgatgctcaagtggaaattggctatctgtatctcgtcggtgaaggggtagaaaagaacttaccagaagcctatcagtggcacataaaagctgccgaacaaggaaacgtgcacgcccattataaccttggttggatatatcaaaatggagacggcaccgagaaaaatttggataaggcaaaattccactttaccgttgcagctaaaagtgggatgagagaagcctatgaagaattaaaaaaattagaatccaacaagtaa

SEQ ID NO: 52976 - protein, 720 aa, Yersinia pestis biovar Medievalis str. 91001
MKKKLVALLILSYPSVAYLKQPPPAVPKPITFVAKIDNIDFNKTAIDSDMKLLLADRFHFKTKTPCNKNTLSGRPESFGLTSEVYAAKIKSLLVEILSERYLFLTIDQCDRGGTPMLTNIEVCTEALCGAEFMKKESYLWLNQDLKATVKRQATSVIPMPLTFDKEKQLWKVAGWFIESSEETEELIPSKLLAFEGYTDDETFKTQKFVSTFKSYYSSGNIQHILTYNKEGKEDGKYDSYYDEKGKLAETLVFKNGLVNGEYIIYHENGAIESKRHFIDSKIADGECPHYYDNGKIKENHSYLNNKLEGKYFEYFPDGKIKDERTYHAGKVVGKYTVYFESGKIRAIYNKNNKDQYHGTNEEYSPEGQLVSKSTYKEGKQLSSQTWYKNGKMRQEEIYDNEGRKNGVSREWFDNGQLNTSTSYKNDILDGDSQKWNEQGEIVSLSPYKDGKLQGEHKYYDSGKLLYTTMYKNDKKDGPDRRWSINTGKLIEEMPYVEGIRSGIKKEFNDRTGRLLTTTPYVNNEIQGTGETYNADGVSIIHCYINNKSIDSLYNPIEIREKASQSDDNAQYELGKYHYTCQDYDRGLKWLEKSADHKNIKALFLLAQMYNEGDGVKEDQTKYFSYLLKAAQLGLSDAQVEIGYLYLVGEGVEKNLPEAYQWHIKAAEQGNVHAHYNLGWIYQNGDGTEKNLDKAKFHFTVAAKSGMREAYEELKKLESNK

SEQ ID NO: 52977 - DNA, 1473 bp, Cryptococcus neoformans var. neoformans JEC21
  CDS (1)..(1473)
atggcagccaccaacgcccagatatatcaacagtctcagatgcccatgcctatgcccatgcctatgcccaccccgtctctcaaccccaacatcaactcggccccaactccaggcccaaatgccatgagcgtctacgacgactgtcagagcccgcttgataccagtgtcagtggcatgtatcctggagatagaggaagccgtgtcgtcagccaacctgctcctttattagatcagtcccacctacgaccgggcaatcaggccaaccttctctctcatgaccgcactattgaactgtaccgcgaaaatgccaaaaagacgaacgatcccgaactcatattcgagttctctgcgttcatgatcgatgcggccaaagcgatgattcctcctgagcaggaaaatgacaccaacccttcgcctgcggtcataaaacaaatggaaaaacgagaagagattatcaaggaggctacatcgttacttaaacgattagccgataggggtttcccagacgcccagtactttttggccgactgttatgccaatgggattggtacagcgagaggcaagcaagactttgacagggcattccccctctttattcttgctgccaaacacggccatccggatgcttgctacagagctggaacatgttgtgagcatggatgggggtgtaggagggatagtgcaaaggccgtttccttttacaacaggaaagccgcagtcggtctccaccctggggcaatgtaccgacttggcactgctgaactcaatggcgctcttggattcccccgtcgcccaaaggaaggtgtcaaatggctcaagcgatccgcggaacacgccactgaagaattccctcacgcccttcatgaactcgcccttttgcatgaaagaggtattgaaaatgttgttttcgtagacaatgattatgctgctgagcttctcgctcaaagcgcagagctgggatatgctccgagcgctttcaagctgggagagtgttacgaatacggcaagatgggatgccctgtcgatcctgccttgtctatccactactataacatttctgcccagcaaaatcacaaagatgcctgtttcgccctcacagcatggtacctcgtcggttcgcccggtgtcctcccacaatcagatacagaagcctacctctgggctaagaaagcggccgagctaggattggccaaggcgcagtatgccgttggatactttaccgagactggtataggaatagaagccaaccctcaagccgcacttacatggtacaaaaaagcagctgagggaggtgataaacgtgctgcaaagagattggctactggatccaggagttcagcactagataggagattagaaatggaggctttgaaggaagaaaagagattgggagccgcagaccttgcgcaaaggtccggcagcggcagtggtgcaagtggaaaggatgggaaggacgggtgtttgatcatgtaa

SEQ ID NO: 52978 - protein, 490 aa, Cryptococcus neoformans var. neoformans JEC21
MAATNAQIYQQSQMPMPMPMPMPTPSLNPNINSAPTPGPNAMSVYDDCQSPLDTSVSGMYPGDRGSRVVSQPAPLLDQSHLRPGNQANLLSHDRTIELYRENAKKTNDPELIFEFSAFMIDAAKAMIPPEQENDTNPSPAVIKQMEKREEIIKEATSLLKRLADRGFPDAQYFLADCYANGIGTARGKQDFDRAFPLFILAAKHGHPDACYRAGTCCEHGWGCRRDSAKAVSFYNRKAAVGLHPGAMYRLGTAELNGALGFPRRPKEGVKWLKRSAEHATEEFPHALHELALLHERGIENVVFVDNDYAAELLAQSAELGYAPSAFKLGECYEYGKMGCPVDPALSIHYYNISAQQNHKDACFALTAWYLVGSPGVLPQSDTEAYLWAKKAAELGLAKAQYAVGYFTETGIGIEANPQAALTWYKKAAEGGDKRAAKRLATGSRSSALDRRLEMEALKEEKRLGAADLAQRSGSGSGASGKDGKDGCLIM

SEQ ID NO: 52979 - DNA, 900 bp, Parachlamydia sp. UWE25
  CDS (1)..(900): transl_table=11
atgcaattaaaatatatagatggcgatgctcctagcaactactttgctctttcttctagcccagatccaaaattaagccaaagtacaataaacaatggtaaaacatatatccttttaggaagctttgaaaaaacataccctttaatgcgtagaattggaattggaatatatataacttttaagactttatgtacgttaggcttggggcttttttctgaaaatgttcgagaagattggaagtctttttggagcggtaaaaaaagtaaaattatttactcttcttctccctcatttttaccaattaaacttttggcagaccaaggcgatgcaaaagctcaatataaacttggagtcatatatgccaatgggcggggtattacacaatcagatacagaagcttttaaatattttaaactcgctgccgatcaaggtcatgcagttgctcaatataaccttggagtcatatatgacaatgggcagggtattacacaatcagagcaagaggctattaaatattacaaactcgctgccgatcaaggtgatgcagatgctcaatataatcttggagtcatatatgccaatgggcagggtattacacaatcagatgcagaagcttttaaatattttaaactcgctgccgatcaaggtgatgcagatgcccaatacgagcttggagtcaggtatgccaatgggcagggtattacacaatcagatacagaagcttttaaatattttaaactcgctgccgatcaaggtgatgcagatgctcaatacaacctcgaagtcagatattccaatggacgaggtgttatacaatcagatcaagaagcttttaaatattttaaactcgctgccgatcaaggtgatgcagatgcccaatacgagcttggaactctgtaa

SEQ ID NO: 52980 - protein, 299 aa, Parachlamydia sp. UWE25
MQLKYIDGDAPSNYFALSSSPDPKLSQSTINNGKTYILLGSFEKTYPLMRRIGIGIYITFKTLCTLGLGLFSENVREDWKSFWSGKKSKIIYSSSPSFLPIKLLADQGDAKAQYKLGVIYANGRGITQSDTEAFKYFKLAADQGHAVAQYNLGVIYDNGQGITQSEQEAIKYYKLAADQGDADAQYNLGVIYANGQGITQSDAEAFKYFKLAADQGDADAQYELGVRYANGQGITQSDTEAFKYFKLAADQGDADAQYNLEVRYSNGRGVIQSDQEAFKYFKLAADQGDADAQYELGTL

SEQ ID NO: 52981 - DNA, 930 bp, Parachlamydia sp. UWE25
  CDS (1)..(930): transl_table=11
atgacagtaaaatacatagatagcaatgttctccccaataaatatgctaatttctccccctgcttgaattcagaattaaatcaaagcaaagtttacaatggtaaaacttatacccttttaggaagctttgaaaaaacatatcctttaatacgtaggattgaaattggaatacgtgcagttttcaaaactctattttctttaggattcggacttctttttgaaagtgttagagaggattggaagactttttggaatggtaagaaaagaaaaatcatttatactttttcctcttttttaccggttaaacttttggcagaccaaggcgatgctaaatctcaatacctctttggattaaggtatataaacggccaaggtgtcgcacaatcagatcaagaagcttttaaatattttcaacttgctgccaatcaaaattatgcagatgctcaatacagccttggttgtatgtatgaaaacggccaaggtgtcgcacaatcggatcaaaatgctgcgcaatgttatcagctcgccgctaatcaaaatcatgtaaaagctcaatataacctgggtgtcatgtatatgcatggccaaggtgtcgcgcaatcggatcaagaagccgctcgatattatcaactcgctgctaaacaaggccatgcaaaagctcaattcagccttggattcatatatgcacatggaaaaggtgttgagcaatcggatcaaaaagctgtgaaatattatcaacgcgctgctaaacaaggaaacgcctctgcacaatgcaatctcggagttatgtattcaagcggtcgtggtgtcccacaatcggatcaagaagccgctcgatattatcaactcgctgccgatcagggtgatctaattgctcaaaggaacctcagaactatgcgtgaaaatggacgccttaataatatagcgtag

SEQ ID NO: 52982 - protein, 309 aa, Parachlamydia sp. UWE25
MTVKYIDSNVLPNKYANFSPCLNSELNQSKVYNGKTYTLLGSFEKTYPLIRRIEIGIRAVFKTLFSLGFGLLFESVREDWKTFWNGKKRKIIYTFSSFLPVKLLADQGDAKSQYLFGLRYINGQGVAQSDQEAFKYFQLAANQNYADAQYSLGCMYENGQGVAQSDQNAAQCYQLAANQNHVKAQYNLGVMYMHGQGVAQSDQEAARYYQLAAKQGHAKAQFSLGFIYAHGKGVEQSDQKAVKYYQRAAKQGNASAQCNLGVMYSSGRGVPQSDQEAARYYQLAADQGDLIAQRNLRTMRENGRLNNIA

SEQ ID NO: 52983 - DNA, 1140 bp, Parachlamydia sp. UWE25
  CDS (1)..(1140): transl_table=11
ttgttagtaaaatacataaacgacaacgctatttccaataaatattttaatgctacttcctgtttgaatctagaattcgaacaaagtaagatgtacaaaggtagaacatatctactcttgggaaattttgaaaaaacatattctttaataagtagatttgaaattggaataagggtaatttttaaaactttattttctgtaggatttgggcttttttttgaatcagttagagaagattggaaatctttttggaatggtagaaaaaaacaagttatttacagctcctccccttttttagctacaaaaattttagtaaagcaaggaaatgcaactactcaatacaagcttggagttatgtatttagaaggaaaaggtactatccagtctcatcaaaaagctgcgaaatattttcaactcgccgccaatcaaaatcatgcagctgctcagaataatcttggactcctgtatgcaaatggatggggcattgcccagtctgatcaagaagctgtaaaatattaccaacttgctgctaaacaaggaaacgcttctgctcaatgcagactcggagatttatatgtacatggacgaggtgtttcacaatcttaccaaaaaagttttgaatattaccaacttgctgctaaacaaggaaacgcttctgctcaatgcaaactcggagcaatgtatgcagagggcctaggtgtcccacaatctgatcaagaagctgtggaatattttcaactcgctgccaatcaaaatcatgcagctgctcagtattgcttaggagttttttatgcacatggacgaggtgttacacaatctgatcaaaaagctttagaatattgccaactcgctgctaatcaaggtattgcaaccgctcagtatagccttggactcatgtatgcacatggccactgtgtcccacaatctgatcaagaagctgtaaaatattaccaactcgctgctaatcaaaatcatacaatcgctcaacgcaacctcggattgatgtataaaaatggccaaggtgtcgcacaatcggatcaagaagcggttaaatactttcaactcgctgccaaccaaggtgatttaactgcccagcataatcttgaggttatgaatgaaaatggccaaaacattacataa

SEQ ID NO: 52984 - protein, 379 aa, Parachlamydia sp. UWE25
MLVKYINDNAISNKYFNATSCLNLEFEQSKMYKGRTYLLLGNFEKTYSLISRFEIGIRVIFKTLFSVGFGLFFESVREDWKSFWNGRKKQVIYSSSPFLATKILVKQGNATTQYKLGVMYLEGKGTIQSHQKAAKYFQLAANQNHAAAQNNLGLLYANGWGIAQSDQEAVKYYQLAAKQGNASAQCRLGDLYVHGRGVSQSYQKSFEYYQLAAKQGNASAQCKLGAMYAEGLGVPQSDQEAVEYFQLAANQNHAAAQYCLGVFYAHGRGVTQSDQKALEYCQLAANQGIATAQYSLGLMYAHGHCVPQSDQEAVKYYQLAANQNHTIAQRNLGLMYKNGQGVAQSDQEAVKYFQLAANQGDLTAQHNLEVMNENGQNIT

SEQ ID NO: 52985 - DNA, 1239 bp, Parachlamydia sp. UWE25
  CDS (1)..(1239): transl_table=11
atgcaattaaaatttatagatggcaacgctcctagcaactactctgccctttcttctagcatggattcaaaattaagccaaaataaaataatcaatggtaaagcgtacatacttttaggaagctttgaaaaaacatatccactagtgcgtagaatttggattggaatccgtgcattttgcaattctctattttctttaaaagtcgggcttttttctgaaagtgttcgagaagattggaagtctttttggaacggtaaaaaatgtaaaattatttactcttcttctcccccatttttaccaactaaaaatttggcagaccaaggcgatacaaaagctcaatacaaactcggattgatgtatgatgaaggctgtggtgtgacacaatcaaagcaagagacttttaaatattttaaactcgctgccgatcaaggccatgtaatggctgaatatagcctcggagccatgtatgatgaaggctgtggtgtgacacaatcaaagcaagaggcttttaaatattttaaattcgctgctgatcaaggcgacgcaacggctcaatataaacttggagccatgtatgatgaaggcagcggtgtgacacgctcagagcaagaggcttttaaatattttaaactcgctgccgatcaaggccatgcaacggcccaatataaacttggaatcatatatggctatggaaggtgtgttacaaattcagagcaagaagcttttaaatattacaaactcgctgccgatcaaggccatgtaatggctcaatatagccttggattaacgtatgcttatggatggggcgttaagcaatcaaagcaagaggcttttaaatattttaaactcgctgctgatcaaggccatgcaaaggctcaatatcagctcggagacacgtataaaaatgggcgaggtgttaagcgatcaaagcaagaggctattaaatattacaaacttgctgccgatcaaggttatgcagatgctcaatattatcttggaatcatatatgataaaaaacgagatgctatacaatcaaaacaagaggcttttaaatattttaaactcgctgctgatcaaggccatgcagatgctcaatactttgtcggaatgatgtaccaaaaaggaagaggtgtctctccatcagaagaaggggctattaaatattacaaacttgctgccaaacaaggcgatacaatggcagcaagtaaaattaactctataatctctcgacagaactag

SEQ ID NO: 52986 - protein, 412 aa, Parachlamydia sp. UWE25
MQLKFIDGNAPSNYSALSSSMDSKLSQNKIINGKAYILLGSFEKTYPLVRRIWIGIRAFCNSLFSLKVGLFSESVREDWKSFWNGKKCKIIYSSSPPFLPTKNLADQGDTKAQYKLGLMYDEGCGVTQSKQETFKYFKLAADQGHVMAEYSLGAMYDEGCGVTQSKQEAFKYFKFAADQGDATAQYKLGAMYDEGSGVTRSEQEAFKYFKLAADQGHATAQYKLGIIYGYGRCVTNSEQEAFKYYKLAADQGHVMAQYSLGLTYAYGWGVKQSKQEAFKYFKLAADQGHAKAQYQLGDTYKNGRGVKRSKQEAIKYYKLAADQGYADAQYYLGIIYDKKRDAIQSKQEAFKYFKLAADQGHADAQYFVGMMYQKGRGVSPSEEGAIKYYKLAAKQGDTMAASKINSIISRQN

SEQ ID NO: 52987 - DNA, 1344 bp, Parachlamydia sp. UWE25
  CDS (1)..(1344): transl_table=11
atgcgatcaaaatttatagatggcgatattcctagcagctactctgctctttcttccagtccggatctaaaattaagccaaagtacgataaacaatggtaaaacatatatccttttaggaagctttgaaaaaacataccctttaatgcgtagaattggaattggaatatatgcagcttttaagactttatgtacgttaggcttagggcttttttctgaaagtgttcgagaagattggaagtctttttggagcggtaaaaaaagtaaaattatttactcctcttctccctcatttttaccaattaaacttttggcagaccaaggcgatgcaaaagctcaatgcgagcttggactcatgtataaaaatggtcaagttgtcgcacaatcagatgcagaagcttttaaatattttaaacttgctgctgatcaaggtgatgtaaaggctcaatacaaccttggatgcatgtatatcaatgggcggggcgttgtgcattcagagcaagaggctattaaatattttaaattcgctgctgatcaaggccatgcagatgctcaattcattattggaattagatataaaaagggtcgaggtgtctcccaatcgaatcaagaagctactaaatattttcagcttgctgccaaacaaggccatgcagaagcgcagcttgagctcaagctcattatagaaagccatgatattgcacaaacgaatcaagaaacttttaaatattttaaactcgctgccgatcaaggcgatgtaaatgctcaatccaaacttggaactatgtataaaaaggggttaggagttgagcaatccaatcaagaagctattaaatattttaaactcgctgccgatcaaggcgatgtaaatgctcaatataatcttgcattcatgtatgcaaaaggaaaacgggttccacaatctcaccaagaagctattaaatattttgaactcatagctgaccaaggtgaggcaattgctcaatgtgctcttggatttatgtatttccagggaaaaggtattacacaatcccatcaagaagccgctaaatactttaaatttgcagccgatcaaggtgaggcagatgctcaatgtgctcttgggtttatgtatgccaatggactaggcgtcacacaatctgatcaagaagctgctaaatattacaaactcgctgccgatcaaggccatgcagatgctcaatacgagcttgggactatgtataaaaaggggctaggagttgaacaatccagtcaagaagctctgagatattatcaacttgctgctgaacaagggaatactcaggcagcaataaaaattgactctattatttctcaaaaaaactaa

SEQ ID NO: 52988 - protein, 447 aa, Parachlamydia sp. UWE25
MRSKFIDGDIPSSYSALSSSPDLKLSQSTINNGKTYILLGSFEKTYPLMRRIGIGIYAAFKTLCTLGLGLFSESVREDWKSFWSGKKSKIIYSSSPSFLPIKLLADQGDAKAQCELGLMYKNGQVVAQSDAEAFKYFKLAADQGDVKAQYNLGCMYINGRGVVHSEQEAIKYFKFAADQGHADAQFIIGIRYKKGRGVSQSNQEATKYFQLAAKQGHAEAQLELKLIIESHDIAQTNQETFKYFKLAADQGDVNAQSKLGTMYKKGLGVEQSNQEAIKYFKLAADQGDVNAQYNLAFMYAKGKRVPQSHQEAIKYFELIADQGEAIAQCALGFMYFQGKGITQSHQEAAKYFKFAADQGEADAQCALGFMYANGLGVTQSDQEAAKYYKLAADQGHADAQYELGTMYKKGLGVEQSSQEALRYYQLAAEQGNTQAAIKIDSIISQKN

SEQ ID NO: 52989 - DNA, 1338 bp, Parachlamydia sp. UWE25
  CDS (1)..(1338): transl_table=11
atgcaattaaaatatatagatggcgatattcctagcagctactctgctctttcttccagtccagatctaaaattaagccagagtacaataaacaatggtaaaacatatattcttttaggaagctttgaaaaaacataccctttaaagcgtagaattggaattggaatatatgcagcttttaagactttatgtacgttaggcttagggattttttctgaaagtgttcgagaagattggaagtctttttggagcggtaaaaaaagtaaaattatttactcttcttctccctcatttttaccaactaaacttttggcagaccaaggcgatgcaaaagctcaatacaaactcggattgatgtatgatgaaagctgtggtgtgacacaatcagatgcagaagctattaaatattttaaactcgctgccaaacaaggtcatgcagatgctcaatataaccttggggtcaggtatgccaatgggcggggtgtgacacaatcagatcaagaagctattaaatattacaaactcgctgccgaacaaggccatgcagatgctcaatatgctcttggatttatgtatgccaataggtggggtattgcacaatcagagcaagaagctattaaatattacaaactcgctgccgaacaaggtcatgcagatgctcaatatgctcttggatttatatatgccaatggactgggtgttacacaatcagatgcagaagcttttaaatattttaaactcgctgccgaacaaggccatgcaaatgctcaatacaacctcggagtcagatattccaatggacgaggtgttacgcaatcagatcaagaagcttttaaatattacaaacttgctgccgatcaaggtcatgcagatgctcaatataatcttggagtcaggtatgtgaatgggcaaggcgttatgcgatcagagcaagaagccgctaaatattacaaactcgctgccgatcaaggctatgtagatgctcaatacaaccttggagtcagatattccaatggacgaggtgttatgcaatcagatcaagaggctattaaatattacaaacttgctgccgatcaaggtcatgcaaaggctcaatacaaccttggagtcagatattccaatggacgaggtgttacgcaatcagagcaagaggctactaaatattataaacttgctgccgatcaaggtgatgcaaaggctcaatacaaccttggagccaggtatgcgaatgggcgaggcgttacgcaatcagagcaagaggctgctaaatattacaaacttgctgccgatcaaggccatgcagatgcccaatacgagcttgaaactctaactctgtaa

SEQ ID NO: 52990 - protein, 445 aa, Parachlamydia sp. UWE25
MQLKYIDGDIPSSYSALSSSPDLKLSQSTINNGKTYILLGSFEKTYPLKRRIGIGIYAAFKTLCTLGLGIFSESVREDWKSFWSGKKSKIIYSSSPSFLPTKLLADQGDAKAQYKLGLMYDESCGVTQSDAEAIKYFKLAAKQGHADAQYNLGVRYANGRGVTQSDQEAIKYYKLAAEQGHADAQYALGFMYANRWGIAQSEQEAIKYYKLAAEQGHADAQYALGFIYANGLGVTQSDAEAFKYFKLAAEQGHANAQYNLGVRYSNGRGVTQSDQEAFKYYKLAADQGHADAQYNLGVRYVNGQGVMRSEQEAAKYYKLAADQGYVDAQYNLGVRYSNGRGVMQSDQEAIKYYKLAADQGHAKAQYNLGVRYSNGRGVTQSEQEATKYYKLAADQGDAKAQYNLGARYANGRGVTQSEQEAAKYYKLAADQGHADAQYELETLTL

SEQ ID NO: 52991 - DNA, 972 bp, Parachlamydia sp. UWE25
  CDS (1)..(972): transl_table=11
ttggcttatttagctttcaaagacaaaaaacaagcaagaataaaagttttattagttctagcgaaagtggtgggggtcattatgaacgcagtggatttttattgcggtcaatacttagtcaatccagtcaatcaattgatactaagtccctttccaactgagcttaataaacctctgttggtaagactgtcaatgctttatcatgcgactgtggtgttagttaattcacaaatgacttcaatcttttacttcttacttggtagagtcaataattttatttcgtgtgcatgttctgaacgaaatacagctttagcggtgaaaattttggccagtcaaaaaaatgctcgagctcaaaattatttaggttacttatatgagtcaggcaagggagttaaacaaaataacgaaaaagctttttattactatcgattagctgcccatcaaaatattacgaacgcgcaacttaaaattggtctgatgtatttagaaggaaagggaattacacaatcggatgagcaacaagccgttttttatttaaaactcgctagtgataatggttctttagaggcgagatatcgactttcgttgctatatttaagcgggcatggagttgaaaaaaatgaaaagaaggctttacagctttgtcagtctgccgctaataatggatacatgttggctcaatttaaacttgccaagagttatgaatatggcttaaatggtgtctctaaaaatcagcaaaaagctgcagaatattataaaggagctgcagatcaggggcatcttgaagcaaaacatcgttatggcattttctgttgtttaggacaaggttgttcacaaaataatcaagaggcaattaaatatttgcagtctgcctatgatttaggatatttaggatctaaaatttaccttgataaaattctcagttatgagaatagactgagaatatatcattattggaatatgagagaataa

SEQ ID NO: 52992 - protein, 323 aa, Parachlamydia sp. UWE25
MAYLAFKDKKQARIKVLLVLAKVVGVIMNAVDFYCGQYLVNPVNQLILSPFPTELNKPLLVRLSMLYHATVVLVNSQMTSIFYFLLGRVNNFISCACSERNTALAVKILASQKNARAQNYLGYLYESGKGVKQNNEKAFYYYRLAAHQNITNAQLKIGLMYLEGKGITQSDEQQAVFYLKLASDNGSLEARYRLSLLYLSGHGVEKNEKKALQLCQSAANNGYMLAQFKLAKSYEYGLNGVSKNQQKAAEYYKGAADQGHLEAKHRYGIFCCLGQGCSQNNQEAIKYLQSAYDLGYLGSKIYLDKILSYENRLRIYHYWNMRE

SEQ ID NO: 52993 - DNA, 1428 bp, Desulfovibrio vulgaris subsp. vulgaris str. Hildenborough
  CDS (1)..(1428): transl_table=11
atgtcccgcaccattgccgaaacaccccgtcccgccgtagcgtccatgtccagcggctgcataccgccccaccatcgccctgacacgttgaagcagcgatggggcaccccggctgcggtctgcctgctggtgacctgtcttttcgcgatgacgctgctcaccaccggctgcaagcccccccgcaggaccccgcccacgctccccgaccggcccgacatggctacggtggaacagcccgtcgtcccgcccgccactgtggacggcaaggaccttgacgccccccagacaccgaaagaacgcatcgcgctcgccttgcgccttctcgatgacggcggcgacggggccgacccgacgcaggctgtgcaactcatcgaacaggatgccacgacgggatacgcccccgcgcaagacctgctcgcccgtctttcgctggaagggtacggcacggccaaggacccggcgcgcgccttcgcactggccatcgaagccgcccgacagggattgcccgatgcacaaaggcttgccgggaccatgtacacactcggactgggtaccgcccgcgaccttgagcagggaatgcgctggctgcgcgaagccgccgacgcaggcgacggtgaagccgcagccatggtagccgactattaccggcaaggcctcggggtggaacggaacgacacggaagccttcctctggacccaccgcgcagccgaacgcggcgtgaagcgtgccgcgctatggcttggcctgcactaccactacggtgtaggcactcctgcagaccagaaacaggccttcgcccttctcagacctttcgcagacgaaggcgatgcagaggcgctgaccatcatcgccctgctactgcacaagggggaaggcgtcgcacaggacaggaaggcggcccttcgctatttcgagaagggagcagcagcgggggacccggtggcacaactcgacctcggggtgctgtaccatcagggtgacggcgtcacgcgtgacatggacaaggcgcgcggcctcttccgtcaatgcgcggaaggcggcaacgcccggtgcatgaccctgtacgccagcatgctcgaagaaggggaaggcggaccgtcagacccggctgaagccctcgcatggtacatggtcgcgtccatggccggagatgatgacgcaacgccgttccttgacgacctgcgaagccgcatcaccgcggaacaggcagcacagggcaaggtcagggccaccgccatcatcaggtcgttgaccgcaagccccgccgctgacgaagcgtcacggcaatcatccgggcagactgcgggccaagcatcgggccacgcttcgggccagacgccagagagtacctcggcgcggacatcggccccggtgccatctgcccttccccgcgaggcggcaggcaagcgtccgaccgtactgccctga

SEQ ID NO: 52994 - protein, 475 aa, Desulfovibrio vulgaris subsp. vulgaris str. Hildenborough
MSRTIAETPRPAVASMSSGCIPPHHRPDTLKQRWGTPAAVCLLVTCLFAMTLLTTGCKPPRRTPPTLPDRPDMATVEQPVVPPATVDGKDLDAPQTPKERIALALRLLDDGGDGADPTQAVQLIEQDATTGYAPAQDLLARLSLEGYGTAKDPARAFALAIEAARQGLPDAQRLAGTMYTLGLGTARDLEQGMRWLREAADAGDGEAAAMVADYYRQGLGVERNDTEAFLWTHRAAERGVKRAALWLGLHYHYGVGTPADQKQAFALLRPFADEGDAEALTIIALLLHKGEGVAQDRKAALRYFEKGAAAGDPVAQLDLGVLYHQGDGVTRDMDKARGLFRQCAEGGNARCMTLYASMLEEGEGGPSDPAEALAWYMVASMAGDDDATPFLDDLRSRITAEQAAQGKVRATAIIRSLTASPAADEASRQSSGQTAGQASGHASGQTPESTSARTSAPVPSALPREAAGKRPTVLP

SEQ ID NO: 52995 - DNA, 1179 bp, Acinetobacter sp. ADP1
  CDS (1)..(1179): transl_table=11
atgggtaccaatatatctggaatgatttttaaatgttctagcgaccaagatgatattgaaaatttagttcataaatggataaaagatgaagattcattttttgatcaacaatcaactatacatattgaatttttaaataataatttaattcttattcataatcatgagatttttgagtctgcaaaaaataatcctaaattatgggaaaaactactactcaatttaaaggaatcggagtggacagttttctttaaatgtgtcgatagctttgaatcatttagttatatcatatatcaaaatcgtaaagaaatacgtaaagtaatccaatatcagggatcaaatctttatcaaactggccaacctttgaattgcgaaaaatcttggctgaattttactattttttatgaacgagaaagttacactgatggttcttataaaattgaaagatatgagattccagatctaaatgatgagagcaatccagatattcaatatcacaagtactattatattatagaaaaaagcttatctttttatcatcattaccttgctcgtgcacttttagtagaagtgcttcaatatcacttaggttttgatattattgatagcgactacaatacatctcaatctttaattatcaactgtgaagatattccaaactttaaacgaacattaaaacaagctcaagaaggatgtatcaaggctcaaaatcaattagcatctatgtatctaaatggtttagatgttactcaaaatatgtctttagcgcttttttggtatgaaaaaacggcgtctcaaaatgatcctgaaggagaactaaatctaggtaaactctatttgaacggcctagggatagaaaaaaattatgagttaggattaacttggattaaaaaatcagtaaagcagaattatccagatgcctattttaccttggcggagttgtatgaaaaaggtcatattgttcaaaaagatattcaacaagctttaatattttataaaaaggctgcaaatcttagacatgcaacttccgcttatagattaggccaaatatttgaattaggtcaaggagttaccctagatttaaaattagctaaaaggttttatcatcaagcagcaagtaactttagctcagaggccaaaaatcgtttagatattttagatcagttgataaataagtag

SEQ ID NO: 52996 - protein, 392 aa, Acinetobacter sp. ADP1
MGTNISGMIFKCSSDQDDIENLVHKWIKDEDSFFDQQSTIHIEFLNNNLILIHNHEIFESAKNNPKLWEKLLLNLKESEWTVFFKCVDSFESFSYIIYQNRKEIRKVIQYQGSNLYQTGQPLNCEKSWLNFTIFYERESYTDGSYKIERYEIPDLNDESNPDIQYHKYYYIIEKSLSFYHHYLARALLVEVLQYHLGFDIIDSDYNTSQSLIINCEDIPNFKRTLKQAQEGCIKAQNQLASMYLNGLDVTQNMSLALFWYEKTASQNDPEGELNLGKLYLNGLGIEKNYELGLTWIKKSVKQNYPDAYFTLAELYEKGHIVQKDIQQALIFYKKAANLRHATSAYRLGQIFELGQGVTLDLKLAKRFYHQAASNFSSEAKNRLDILDQLINK

SEQ ID NO: 52997 - DNA, 723 bp, Acinetobacter sp. ADP1
  CDS (1)..(723): transl_table=11
ttgcagatcattgtgaccatcattatgcgcaaaagaatgtttccaattacactgatcatatctctaagcattgggttgatcagctttcaaacttacgccgagcctaccctcagcgacatcaaacaaatggcggcacaaggcaaatctacggcacaatatcatcttggcatgatgtatttaagtggtgaacaaggcgtcaccaaagatacaactcaggcgcttaaatggctcacgcttgccgatcaaaatggtagcgtaggtgctaaatatagcttgggtttgatgtatatgacaggaacgggggtatctcaaaatcaatccactgcatttgaatggttcagtaaagctgcaaagtttggacatgctcaagcacaatataccgtcggacgcatgtacagtgaaggtgtaggcgttgaaaaaaatatgcctcaagcatttgaatggattcaaaaagcagcgttgcagggttatcctcctgcggaatttagtctgggcttaatgtacaacgatggccgtggtgttgcccagaataaacagcaagccatcaagtggtatactcaagccgcagaacatcagcaaagtaatgctcaatataaccttggcatcatgtatctgaacggcgaagggacttctaaaaacccacctctagccaaaaaatggttacaacgcgctgccaatgcaggcgatcaagatgcaaaagatgtattaaaaggattaaaatga

SEQ ID NO: 52998 - protein, 240 aa, Acinetobacter sp. ADP1
MQIIVTIIMRKRMFPITLIISLSIGLISFQTYAEPTLSDIKQMAAQGKSTAQYHLGMMYLSGEQGVTKDTTQALKWLTLADQNGSVGAKYSLGLMYMTGTGVSQNQSTAFEWFSKAAKFGHAQAQYTVGRMYSEGVGVEKNMPQAFEWIQKAALQGYPPAEFSLGLMYNDGRGVAQNKQQAIKWYTQAAEHQQSNAQYNLGIMYLNGEGTSKNPPLAKKWLQRAANAGDQDAKDVLKGLK

SEQ ID NO: 52999 - DNA, 1068 bp, Desulfotalea psychrophila LSv54
  CDS (1)..(1068): transl_table=11
ttgtattattttccaacgagagtcttttgtatgaaacataaaatttttatcattgtttggcttttattattttattcaacctcttcccatgcaagcgaaatagcacaagaaattcaagccgtaaacgccgaaactcaatttcgactgggatcgctctaccacaaaagcacagcagattcaaaagatcagcaaaaggcattttcctggttccaaaagagtgcccgactgggacatgccggtgcccagtaccaactggcagtcatgtattaccaaggtaaaggaactctaaaagacctaaaaaaggcatttacctggctgaagaagagcgcccaacaaggagatgcttcggctcaatatcaactgggaattatgtattaccagggtaaaggaatgataaaagacccaaagagagcattttactggcttgaaaaaagtgcccagcagggagatggcaatgctcaatatcaactggcagccatgtaccacaacggtgagggaacgccaagaagcccgatacaagaactttcctgggtggaaaagagtgctcgacaaggacacagggctgctcaatttcgactgggagtcatgtattacagaggtgagggaacgccaaaagacccgaagagggcattgccctgggtagagaagagtgcccggcagggaaatgccatggctcaatatcaactggcagccatgtatcacactggtaagggaactctaaaggatgctaagagagcatttttctggttcaagaagagtgcacgacagggacatagggccgcccaataccaactgggagacatgtactacaggggtgagggaactctaaaggatcaggagagggcattttcctgggtggagaagagtgcccggcaaggagatagggctgctcaatatcaactggcagtcatgtactatctgggcaagggcacagcaaaagacctgaagagggcattttcctggtttgagaaaagtgccaagcagggacatagggctgcccaacgtcaactaagagtcatgtcttacaagggtgaaggacaagtaactacagaagatggcgggctgtga

SEQ ID NO: 53000 - protein, 355 aa, Desulfotalea psychrophila LSv54
MYYFPTRVFCMKHKIFIIVWLLLFYSTSSHASEIAQEIQAVNAETQFRLGSLYHKSTADSKDQQKAFSWFQKSARLGHAGAQYQLAVMYYQGKGTLKDLKKAFTWLKKSAQQGDASAQYQLGIMYYQGKGMIKDPKRAFYWLEKSAQQGDGNAQYQLAAMYHNGEGTPRSPIQELSWVEKSARQGHRAAQFRLGVMYYRGEGTPKDPKRALPWVEKSARQGNAMAQYQLAAMYHTGKGTLKDAKRAFFWFKKSARQGHRAAQYQLGDMYYRGEGTLKDQERAFSWVEKSARQGDRAAQYQLAVMYYLGKGTAKDLKRAFSWFEKSAKQGHRAAQRQLRVMSYKGEGQVTTEDGGL

SEQ ID NO: 53001 - DNA, 798 bp, Desulfotalea psychrophila LSv54
  CDS (1)..(798): transl_table=11
atgaaaggctttaggatgaaatataaaattcttattactgtttggacgttacttttttttgcaacattttgccatggaagcgaaataatggaaaaggctcaacagggaaacgccatagctcaatctcggttaggattaatgtactacactggtgagggtgtgtcgaaagacttgaaggaagcatttatctggtttgaaaagagcgctcagcagggatattccacagctcaatacaatatgggagatatgtattataatggaaagggaactacgaaaaacttgaaggaagcatttgcctggtttgaaaggagtgccctgcagggagctgctttagctcaaatgcggttaggattaatgtactacactggcgagggtactgcgaaagacttgaaggaagcatttatctggtttgaaaggagtgctctgcaggggcaggctttatctcagtttcaactaggagtaatgcactatactggtaaaggtaccccgaaaaacttaaagcaatctcttgtttggcttgaaaagagtgctctacaagaaaatagtaatgctcagtataatttaggttacatgtattataaggggcaagggactgcgaaagacttgaagaaagcattcagctggtttgaaaagagtgctctactaggggatgctgtcgctcaatatcggctaggattaatgtattataagggccaggggactgtaaaagatctgaataagacatttttctggcttgataagagcgcccaacaagggaatgctcgtgctcaggctatcatggaaggtcttgaggggtga

SEQ ID NO: 53002 - protein, 265 aa, Desulfotalea psychrophila LSv54
MKGFRMKYKILITVWTLLFFATFCHGSEIMEKAQQGNAIAQSRLGLMYYTGEGVSKDLKEAFIWFEKSAQQGYSTAQYNMGDMYYNGKGTTKNLKEAFAWFERSALQGAALAQMRLGLMYYTGEGTAKDLKEAFIWFERSALQGQALSQFQLGVMHYTGKGTPKNLKQSLVWLEKSALQENSNAQYNLGYMYYKGQGTAKDLKKAFSWFEKSALLGDAVAQYRLGLMYYKGQGTVKDLNKTFFWLDKSAQQGNARAQAIMEGLEG

SEQ ID NO: 53003 - DNA, 2163 bp, Yersinia pseudotuberculosis IP 32953
  CDS (1)..(2163): transl_table=11
ttgaaaaaaaaactggtggcactcttaatactctcttatccgtctgttgcatatctaaagcaaccccctccggcagtacctaaacccattacctttgttgctaaaattgataacattgattttaacaaaacggccattgatagtgatatgaaattactgctggccgatcggttccactttaaaaccaaaaccccctgtaacaagaatacgctttcaggccggccagaatcatttggtttaacgtcagaagtatacgcggaaaaaatcaagagtttgctcgttgagatcttaagtgaacgttacctttttctgacaatagatcaatgtgaccgcggtggcacaccgatgctcaccaatatagaagtttgcactgaagcactgtgcggtgctgaattcatgaaaaaagaatcttatctttggttaaatcaagacttaaaggccacggtgaaacgccaggcgacatcggtgatccctatgccattaacctttgataaagaaaagcagctgtggaaagtggccgggtggtttattgagtcatcagaagaaactgaagaacttataccgagcaaactgctggcctttgaaggttatactgacgatgaaacattcaaaacacaaaaattcgtctctaccttcaaatcctattactccagtggaaatattcaacatattctcacttataataaagagggaaaagaggatgggaaatacgactcatattatgatgaaaaaggaaaattagctgagacgttggtatttaaaaatggcttgatcaatggtgagtatattatctaccatgaaaatggtgctattgaaagcaaacgacattttattgacagcaaaatagccgatggagagtgccctcattattacgacaatggaaacattaaagagaaccatagctatttgaataataaactcgaagggaaatactttgagtattttcctgatggtaaaattaaagatgaaagaacctaccatgctggcaaagtcgttggtaaatacacagtctactttgaatcaggtaaaattagagctatttataataaaaacaataaagatcagtaccatggaactaacgaggaatacagccccgaagggcagttagtgtctaaatcaacgtataaagaaggaaaaaaactctctagccagacttggtataaaaatggaaaaatgcgacaggaagaaatctacgataacgaaggtcgcaaaaatggcgtatcaagagagtggtttgataatggacaacttaatacatcaaccagctataaaaatgacatcttagatggtgatagccagaaatggaacgaacagggtgaaatagtatcactctcaccgtataaagacggcaaacttcagggtgaacataaatattatgattcaggaaaactactttataccacaatgtataagaacgataaaaaagatggtccggatagacgatggagtatcaatacagggaagttaattgaagaaatgccctatgttgaaggcataagaagcggcatcaaaaaagagtttaatgatcgtaccggtagactgttaacaaccaccccttatgtgaataatgaaatacagggcaccggagaaacatataatgccgatggtgttagcattattcactgctatatcaataataaaagtattgactcgctatacaatcctattgaaatacgcaaaaaagcctcacagagtgatgataatgcacagtatgaactgggtaagtatcattatacttgtcaagactatgatagaggtcttaagtggctagaaaaatcagcagaccataaaaatattaaggcgttatttcttttagctcaaatgtataatgaaggtgacggcgttaaagaagatcaaacccaatatttctcctatttactcaaagcagcgcagttagggctaagtgatgctcaagtggaaattggctatctgtatctcgtcggtgaaggggtagaaaagaacttaccagaagcctatcagtggcacataaaagctgccgaacaaggaaacgtgcacgcccattataaccttggttggatatatcaaaatggagacggcaccgagaaaaatttggataaggcaaaattccactttaccgttgcagctaaaagtgggatgagagaagcctatgaagaattaaaaaaattagaatccaacaagtaa

SEQ ID NO: 53004 - protein, 720 aa, Yersinia pseudotuberculosis IP 32953
MKKKLVALLILSYPSVAYLKQPPPAVPKPITFVAKIDNIDFNKTAIDSDMKLLLADRFHFKTKTPCNKNTLSGRPESFGLTSEVYAEKIKSLLVEILSERYLFLTIDQCDRGGTPMLTNIEVCTEALCGAEFMKKESYLWLNQDLKATVKRQATSVIPMPLTFDKEKQLWKVAGWFIESSEETEELIPSKLLAFEGYTDDETFKTQKFVSTFKSYYSSGNIQHILTYNKEGKEDGKYDSYYDEKGKLAETLVFKNGLINGEYIIYHENGAIESKRHFIDSKIADGECPHYYDNGNIKENHSYLNNKLEGKYFEYFPDGKIKDERTYHAGKVVGKYTVYFESGKIRAIYNKNNKDQYHGTNEEYSPEGQLVSKSTYKEGKKLSSQTWYKNGKMRQEEIYDNEGRKNGVSREWFDNGQLNTSTSYKNDILDGDSQKWNEQGEIVSLSPYKDGKLQGEHKYYDSGKLLYTTMYKNDKKDGPDRRWSINTGKLIEEMPYVEGIRSGIKKEFNDRTGRLLTTTPYVNNEIQGTGETYNADGVSIIHCYINNKSIDSLYNPIEIRKKASQSDDNAQYELGKYHYTCQDYDRGLKWLEKSADHKNIKALFLLAQMYNEGDGVKEDQTQYFSYLLKAAQLGLSDAQVEIGYLYLVGEGVEKNLPEAYQWHIKAAEQGNVHAHYNLGWIYQNGDGTEKNLDKAKFHFTVAAKSGMREAYEELKKLESNK

SEQ ID NO: 53005 - DNA, 1029 bp, Legionella pneumophila subsp. pneumophila str. Philadelphia 1
  CDS (1)..(1029): transl_table=11
atgcgtttacgtcttgtcatcttagttttagccgcaattattattggtgtgggaagttattctgggatagtgaatgtcattaaagagcccatagaaaatgtgataatagggtataaaagcccatcagcctggaataatcgtggtgtagattatgtgattggcaaaagagtagcacaaaatgactctgaagctgtaaaatggttttgcaaggcagcgaaacaaggcgaagccatggcccagcgcaaccttggcttgatgtatgctgcaggcaaaggggtccctcaggataatggcaaggctatgcaatggtttcgtaaagccgctcttcaaaatgatgccgtgtcacaattaaatcttggtgtcatgtatcaaaaaggtatgggtactcagcaaaacgatagggaagcaatcaagtggattcataaagcagccgcacaaggatttccagaggctgaacgtagtcttggcatcctatattccactgctgaaaatgggcaacaaaattatgtcgaagcttttaaatggcttcacaaggcagctgagaaagaagatgccatagcccaatataatcttgcagttatgtatgtcacaggcaagggggttcggcaaaatgatacggaagcagttaagtggtttcgtaaagcaggcaaacatggcgatctcatggctcaacgaacacttggattaatgtacgcaacggggagcaatgttcaacaggatgattttcaagcgatgaaatggtttcgtctggccgcgaaacaaggagatgctgtggctcaatataatataggtatgggctttcttaacggcaaaggggtgattcgaaatcacacaaaagctctgaaatggtttcatttagctgctagtcaaggattgccccaagctcaatatgtgcttgctgcactttatcatgatggagtgagtcttcctcaaaatagtatggaagcaataaagtggctccgaaaggctgctgcgcaaggtcacttgcaagctcaagagcgcctgcaggctctggttagacaggattag

SEQ ID NO: 53006 - protein, 342 aa, Legionella pneumophila subsp. pneumophila str. Philadelphia 1
MRLRLVILVLAAIIIGVGSYSGIVNVIKEPIENVIIGYKSPSAWNNRGVDYVIGKRVAQNDSEAVKWFCKAAKQGEAMAQRNLGLMYAAGKGVPQDNGKAMQWFRKAALQNDAVSQLNLGVMYQKGMGTQQNDREAIKWIHKAAAQGFPEAERSLGILYSTAENGQQNYVEAFKWLHKAAEKEDAIAQYNLAVMYVTGKGVRQNDTEAVKWFRKAGKHGDLMAQRTLGLMYATGSNVQQDDFQAMKWFRLAAKQGDAVAQYNIGMGFLNGKGVIRNHTKALKWFHLAASQGLPQAQYVLAALYHDGVSLPQNSMEAIKWLRKAAAQGHLQAQERLQALVRQD

SEQ ID NO: 53007 - DNA, 1131 bp, Legionella pneumophila subsp. pneumophila str. Philadelphia 1
  CDS (1)..(1131): transl_table=11
atgagaagttttttgttagctctattattggcgattaacaccgttgttttggccgatgagttagttggttttgcagcatttgaaaatggcgactacaccacagcctatccacatttaatgcaggcagccaaagaaggtaatgaggaagccatgtatttattggggcgcatgtatcaatacggatatggtgtgacaactaattacgaagaagccagaaattggtatcaaaaggcagctgataaaaataatgcattggctcaattaagtttgggatttatgtacgatacaggtaagggggtatctcaggattttactgaggccttcaaatggtatatgaaggcagcagagcaaggaaatccgatagcacaaagaaatatcggattaatgtatgccacaggggatggcgtagctgccagtgatgataaagcattcaactggtttaaaaaggcggcagaacaaggctatagcaaggcacaagtgaatttgggttatcaatacatgatgggtaaaggaactccaaaagatgtaaaaaaagcatttgaatggtatcaaaaagcggcagagcagggggatgaaaagggcgaatacagtctaggtctattgtatacaggccaggaaggtgggattggtgcggatgataaagccgctttttactggttttcacaagcagccaatcatggacatgtcaacgcacaaacctatttagcttactactatcttaaagggtatggtgtagatgctgatcctgtgaaagcagcttattggtatcaatctgcagcagaaaaggggcaacctgaagcacaggcacaattaggacaattgttattgactggtacaggtgttgataaagattaccaacaggcagcttactggtttggtaagtcagcacatcagggaaatcctattggacaagccaagttggggtacatgtatttagcaggattaggagtcaacaagagcttggttaaagcttacgcctggttaaaaattgctgctgaaaataaaaatgaggaagcggcaaagcaacttaaatctttggaagccaagttgaccgaacctgaaaaattggaagcagagaaaatgatcaaggatttgggcccattagaaagcaaagagaattatgaggactaa

SEQ ID NO: 53008 - protein, 376 aa, Legionella pneumophila subsp. pneumophila str. Philadelphia 1
MRSFLLALLLAINTVVLADELVGFAAFENGDYTTAYPHLMQAAKEGNEEAMYLLGRMYQYGYGVTTNYEEARNWYQKAADKNNALAQLSLGFMYDTGKGVSQDFTEAFKWYMKAAEQGNPIAQRNIGLMYATGDGVAASDDKAFNWFKKAAEQGYSKAQVNLGYQYMMGKGTPKDVKKAFEWYQKAAEQGDEKGEYSLGLLYTGQEGGIGADDKAAFYWFSQAANHGHVNAQTYLAYYYLKGYGVDADPVKAAYWYQSAAEKGQPEAQAQLGQLLLTGTGVDKDYQQAAYWFGKSAHQGNPIGQAKLGYMYLAGLGVNKSLVKAYAWLKIAAENKNEEAAKQLKSLEAKLTEPEKLEAEKMIKDLGPLESKENYED

SEQ ID NO: 53009 - DNA, 1128 bp, Legionella pneumophila subsp. pneumophila str. Philadelphia 1
  CDS (1)..(1128): transl_table=11
atggacatgaaaaaatatattttatctctttctctactgacggtgattaactcttcagctatcgctacgactcaggaaggtgaggaggcctataacaaggggtattacgaaaaagcatttattttgttgtctcctgaagcggataaaggagatgccaaggctcaatatttgctgggtaagatgtattataatgcccaaggtgtaacttataatccggaaaaaacagagcaattattacttgcctcagcgaatcaaggcaatgtcgatgcccaggtattgttagccggtttctattggtaccttaatacaccagagggctataaaaaggcgttcgaatggtatcagaaagcagcggatcaaaataatgcggatggtcaatatggcttgggctatatgtatgatacaggaactggtgtacctcagaattccgatacagccatggtatggtataaaaaagcagcagagcaaggcaactctaatgcggctttggctattggttataattatgataccggtacaggggtgaaaaaggataagactcaagctctcaactggtatgcaaaagcagctgacttaggtaatgccagcgcacaatataatcttggtttgatgtatgagcaaggggatggtgttcctaaagattatcagaaagcagcagagtatttcgagaaagcagcgaatcaaggtcatgccaaatcgcaattggagttaggttatttatatgattctggaaaattaggtaaatcggatctgcaaaaggctgctttttggtatcaaaaaagcgcagatctggggaatgccaatgcgcaatttaatttagctgatatgtatttttacggtgatggggtcggtaaaagccttgagcaatccgtatactggatgcaaaaagcagctgagcaagggtatggtaaggctcaaaatcaattaggtatctattacagagacggtattggtgttgctgctgatcctgtaaaagcttatgcttggtttacagcagccaagaataatggctttgaaaaagcggcgagcaatgccagtgatcttgagaaatctatgaacccagaggatctgagtaaggcgagaattttaggacaacaatatacggataattacaaggccaaaaaataa

SEQ ID NO: 53010 - protein, 375 aa, Legionella pneumophila subsp. pneumophila str. Philadelphia 1
MDMKKYILSLSLLTVINSSAIATTQEGEEAYNKGYYEKAFILLSPEADKGDAKAQYLLGKMYYNAQGVTYNPEKTEQLLLASANQGNVDAQVLLAGFYWYLNTPEGYKKAFEWYQKAADQNNADGQYGLGYMYDTGTGVPQNSDTAMVWYKKAAEQGNSNAALAIGYNYDTGTGVKKDKTQALNWYAKAADLGNASAQYNLGLMYEQGDGVPKDYQKAAEYFEKAANQGHAKSQLELGYLYDSGKLGKSDLQKAAFWYQKSADLGNANAQFNLADMYFYGDGVGKSLEQSVYWMQKAAEQGYGKAQNQLGIYYRDGIGVAADPVKAYAWFTAAKNNGFEKAASNASDLEKSMNPEDLSKARILGQQYTDNYKAKK

SEQ ID NO: 53011 - DNA, 3603 bp, Legionella pneumophila subsp. pneumophila str. Philadelphia 1
  CDS (1)..(3603): transl_table=11
atgaaatcactagtaccttgggtgtgtgttttagtcgcgtcagctggccaacaggcttttgccaatgaggcgttcaatgcttatagattaggcaattataatgaagcagctgagcccctaatcattaaatcaggtcaggatgctgttgccgaatactatttagggcgactttatctctatggatatgggcagttaaaaaacaatcgtgttgcgatgcgctactttaccaaatcagcggaaaaaggatatttacctgctgtcctgctcatggccaaatacagtttgctccatgaaaaaaatccggaagaagctgctcgttggtttaagcaggcagccgcagtgggagatatgagcgcacaaatgtttatggcggcagcttatttatatggtgttggcgtcaagaaaaatacagatatcgcgagacgttattatattgatgcagcaaaaaatggtaatcctattgctcaatacaccttagcaaagtatttcttagagagtaagcatgcgggtaataaaaaattagggatcatttggctgaataaagcagcagaaaatggagatccaaaagctttaacagaattgggcagattttatgtggccggacaaatggttaccaaagatactgccaaaggtgttgaattattaaataaagcagcgtcagaacaatatgctccagccatgcttgagttgggtaagttggctttaatgcaaaatcaatacgatgaggctattcaatggcttaataaggccgcgaaacaaagtacagaagctactcttgagttagcccatatttatttacaagataaaagtccagtttatgatccaaaaacaggttttttatttgtactaaaagcagcccagaatggttcggttcaagctcaaaaagaattagccaatttatatcaaaaagggattggcgtagcggctgatgaggaattgtctaaacaatggactcttaaagcagcagaaaatgagaagaaaaatgcagagcctcctcttcttgcccaagctgcattatggctaagtaatgacagaacggataaattggaagagacggcttaccagatgaatggtatatttagcccatggaataatccgtctgccttgagaaataatagctataatcaagcacctaagcttgaaaccatctctcgtcaggatattttcaaaccacaatttgagttgactcagcctaacagtattcctataagcaattactatgatgctttaatcagtaaacaagtagagtttcaatcaaatcaatgggcttatccaacttacagacttaacccattcgtagaagctctagagaggactaatagtcctgttgtacaaaagctcaacttgccagttccttataccgacgcgaattatgatgatagcgaagttggcagttttgatttgatggacatttggacaggagattggaagcggactgtcaattatatgtctgtggtcaattatttgtatttcagggcaatacttggaaatgcccaaactcaatttgaaattggtcaattgtttcaatatggcattggtttaatgcaagatgatgcttcggctattattttttatgagaatgccgcagaacaaaagcacttaggtgctgaatataatttgggaatactttatctgaaacgcggtaaagacgaaaatgattaccaacaagcattaaattggctgactgattccgcattcaaagggaataagagagcacaatatgtattggcacggatattgcgccaggggatcgttggtcctgatggaaaagagtatattaaagcaaatgatgagcaagctatggccatgctttatctttcagcggccaatgattatggtccggcagaatatgagttggcagaatatttggcaagagactacaacaatggtttaagtgtagatgtcagaaaacaaaaaattgccttaataagaaagttataccaaggtgctgtgaagaataaagtggcagaggcattgttgccattggcattttataatgcgatggatgataacaggcaaaagcaggaacaagcatttaaagtagctgaagagcaagctgaaacaggtaatgagaacgctgctcttttactgggaatgctctatgaccgtggtataggcataacagctgatccagccaaggccatgtactggtatcaacaagccggacaaaatcccgtaagtcagtttatattgggtacttacataacagaaggaaaaggggtcgcacaggataaggaaaaaggattggatttgctgaggcaatctgcaaactcccaattttcctatgccgactttaatctggcagtacttaagcaacaatcaggggaagactttttacccaatttaattgaatcttataaattagggaatagtcatgcggggatagtattggcagattattatttatctcaaagcagtgctcctgaacaaatgaatcaagctaaggaaatttataagggcttagctgataaaggcgatcaatatgcacaattaaagttggcttatatgctacaaaaaggattgggtgccgcaccggatcttgctggcgcgcaacattggtatactgcttcggcagaacaaggcaatcctgaagcacaatacttattaggtcaattttatcaactaggtgaaacaggggagcctgattataatttagccaaatattggtatcaaaaagcagcgaaacatttatctaaagccgatgtagcattaggttttatttatgaaacggtagatgatgattatgctcaagcactaaaagcctatgaaaatgcagcagcaaaaggagatatgttaggcgcttataatttggctttaatgtatgagtatggcaagggtgtgcccgtcacttactccaaagcgttatctttgtttaaagaagcatcagagaaaggtgctcctgaagcgatgagtcaattggctggaatgtatttttatggtttggggcaaccaagaaacgaacaacaagctttggtctggtataaaaaggctgcaagcttaggtaatgggaatgccttgtatgccctcggtttattatccgaaactggtgttggtgttaaattggattttccagatgctttacggtattaccaggatgcatctgataaaggtaatgaaaaagcaatgctggctttggcaagaatgtatcattatggtcttggtgtcgaaaaggatcataaaagatcagcgagtatttatcaaaaattggcacaaaagcaaaatgcttatgctcaatatcaattaggtacttattatattgagggaacggcaggcgaacgactacccgaaaaaggccgtgagctattacaacaagcgagtgaaaatggaagtttacaggcccgtagagtattgcaaagattagatgcacaaacccagggtaaagtaagttatgtcgagcccgtgttatttaataatgttcccaaatttgatggccaaagcgctgatatgatttattttgatgcattaaatgaatggaatcatggggaggaggttttgtccagaatgatcttgcaacgtctggtgacgcaatatcccaattttattcctgcaaagcgagcttatgagcagttgaatcaagccaaattaatgaataacttgggttaa

SEQ ID NO: 53012 - protein, 1200 aa, Legionella pneumophila subsp. pneumophila str. Philadelphia 1
MKSLVPWVCVLVASAGQQAFANEAFNAYRLGNYNEAAEPLIIKSGQDAVAEYYLGRLYLYGYGQLKNNRVAMRYFTKSAEKGYLPAVLLMAKYSLLHEKNPEEAARWFKQAAAVGDMSAQMFMAAAYLYGVGVKKNTDIARRYYIDAAKNGNPIAQYTLAKYFLESKHAGNKKLGIIWLNKAAENGDPKALTELGRFYVAGQMVTKDTAKGVELLNKAASEQYAPAMLELGKLALMQNQYDEAIQWLNKAAKQSTEATLELAHIYLQDKSPVYDPKTGFLFVLKAAQNGSVQAQKELANLYQKGIGVAADEELSKQWTLKAAENEKKNAEPPLLAQAALWLSNDRTDKLEETAYQMNGIFSPWNNPSALRNNSYNQAPKLETISRQDIFKPQFELTQPNSIPISNYYDALISKQVEFQSNQWAYPTYRLNPFVEALERTNSPVVQKLNLPVPYTDANYDDSEVGSFDLMDIWTGDWKRTVNYMSVVNYLYFRAILGNAQTQFEIGQLFQYGIGLMQDDASAIIFYENAAEQKHLGAEYNLGILYLKRGKDENDYQQALNWLTDSAFKGNKRAQYVLARILRQGIVGPDGKEYIKANDEQAMAMLYLSAANDYGPAEYELAEYLARDYNNGLSVDVRKQKIALIRKLYQGAVKNKVAEALLPLAFYNAMDDNRQKQEQAFKVAEEQAETGNENAALLLGMLYDRGIGITADPAKAMYWYQQAGQNPVSQFILGTYITEGKGVAQDKEKGLDLLRQSANSQFSYADFNLAVLKQQSGEDFLPNLIESYKLGNSHAGIVLADYYLSQSSAPEQMNQAKEIYKGLADKGDQYAQLKLAYMLQKGLGAAPDLAGAQHWYTASAEQGNPEAQYLLGQFYQLGETGEPDYNLAKYWYQKAAKHLSKADVALGFIYETVDDDYAQALKAYENAAAKGDMLGAYNLALMYEYGKGVPVTYSKALSLFKEASEKGAPEAMSQLAGMYFYGLGQPRNEQQALVWYKKAASLGNGNALYALGLLSETGVGVKLDFPDALRYYQDASDKGNEKAMLALARMYHYGLGVEKDHKRSASIYQKLAQKQNAYAQYQLGTYYIEGTAGERLPEKGRELLQQASENGSLQARRVLQRLDAQTQGKVSYVEPVLFNNVPKFDGQSADMIYFDALNEWNHGEEVLSRMILQRLVTQYPNFIPAKRAYEQLNQAKLMNNLG

SEQ ID NO: 53013 - DNA, 2499 bp, Bacteroides fragilis YCH46
  CDS (1)..(2499): transl_table=11
atggaaactttaaaagagaaattcgaagccctggcccatcgtatccaatcatccggaaaaccggctgccgcatggttccctcaatttacacctgttactttgttgaacgccgaaaattggtgggaagcacttgctgtgtgcgaatatgccttggacacccatgaggacgaagcactgacagccggattttttgaattaatattcagtgcatacgattgtaacgtagaagtggatcttaatgaggaagagtatgcctactggtgggagaaagtgatcagtgtatgcgatcgtgtggctgtattcaacggtgccgggtggtcacagaaaggtgcacaatattcggaagcccgttatgggaaacgtgatctcagcctgttattcccttgctatgaaaaagcggcggaaatgggaagcccggaagcagaggcaaccgttgcttattggcgttatatgggtttctactgcgaacaggatagggcagaaggagagcgtcgatttgcagctttatcctcacccgaagctttgctatggggaaaatattaccgggcttatgccgagcagcacaccggcagtaaagagaaagccctgcttatgcgaaaagagctgcttgacgaacttccccaaggccatcgcctgcgtgcccatgtatatgccgcgatgggcgacgcacttgatatagaagaaggaagtgtggctgaagaagcggcatgctatgagaagtcgctggaacttgttcctaatctatattctttaaaaaatctggcaactctctattttcgctatccggaactagggaagcaaaaagagctggcgtttgagttgtgggagaaagcctggcatgcaggtgtatggtctgcagctaatttccttggatataactatcaggaagaagagtggctcgatatgcctaaagccattgaatggctggagaaagggatgctttattgtgaatcatattgtgcctatgaattagcattgatctatctttataatgatgagtataagaatgtggaacgtgggttgatgtgcctgcagcgctgtgtcgacgacaattatgtagaagctatcgagacgcttgccaatgtttatttcaacggtgaattggtggaagagaatatctcgtatgcctgtcagttgttggagagagctatcgagctggggtccggtagtgcagcctatcgtatcggctggatgtatgagcgtggattgctttctgaagaaccggaatatcagaaggctatggagtattatgaaaaagctgtgtctatggacaatgctgacgggtatgcacgggcggctctttatttggctaatggttattccggagttacggatgccgggaagtcaaaggcctattatgaaaaagcagcagagctgggttcatgttttgcaatggtagaattggcattcttatacgaaaatggtgaggtggtggaacaaagttatgagaaagctttcgacttgctccaaaaagctgccggacaggagtatccttatgcgatgtatcgtgtaggactttatttggataggggagtcatcggtgagccacggcccgaagaagcgtttgcatggtatgcaaaggcagccgaacggggagacggagatgcgatcttcgctcttgggcgttgctataagaatggaattggtacggaagagaatccggataaggctcttgaatggtttactaagggtgcagagaataacgaaccccgttgtcttacagaaatggggttggcttatgaatacggtagtgggatagaagagaatcctcatcaagctgttgaatatatgacaaaggctgccgaacaaaattatggttatgcccaatttaaaatgggagactactttttctttggttacggtgcctgccccgaagataacaaacaagctgtggaatggtacgagaaggctgttgcaaatgatatacctttggctatgttgcgtatgggtgaatattacctttacgattatgacaaactgaacgagtcggagaaagctttcagctacttcaagaaagcagctgaagcagaatgttataatgaaggactgggaatctgctacgagatgggtatcggtgtggaagacaatgaaacagaggcattcaaatattatactttggctgcgggcagtggcaatgttatgagtatgtatcgcaccggattgtgttattacaacggagtaggtgtaaaacagaattatacagaagcttaccgatggtttaatgatgccgccggaaatgacaatgtggcttcgtattattatttaggtaagatgctgatgtatggcgaaggctgtgtgcccgatgcggaagcagggcttcaatggttgatgaaagctgctgagcataatagtgacaaggcgcagttcgaattgggcaatgcctatttgatgggcaatggagtagaggagaatgatgagatcgctatggagtggtttgagaaagcagccgaaaacggaaacgcgaaagccttgaaaattactggaagaagacaacgataa

SEQ ID NO: 53014 - protein, 832 aa, Bacteroides fragilis YCH46
METLKEKFEALAHRIQSSGKPAAAWFPQFTPVTLLNAENWWEALAVCEYALDTHEDEALTAGFFELIFSAYDCNVEVDLNEEEYAYWWEKVISVCDRVAVFNGAGWSQKGAQYSEARYGKRDLSLLFPCYEKAAEMGSPEAEATVAYWRYMGFYCEQDRAEGERRFAALSSPEALLWGKYYRAYAEQHTGSKEKALLMRKELLDELPQGHRLRAHVYAAMGDALDIEEGSVAEEAACYEKSLELVPNLYSLKNLATLYFRYPELGKQKELAFELWEKAWHAGVWSAANFLGYNYQEEEWLDMPKAIEWLEKGMLYCESYCAYELALIYLYNDEYKNVERGLMCLQRCVDDNYVEAIETLANVYFNGELVEENISYACQLLERAIELGSGSAAYRIGWMYERGLLSEEPEYQKAMEYYEKAVSMDNADGYARAALYLANGYSGVTDAGKSKAYYEKAAELGSCFAMVELAFLYENGEVVEQSYEKAFDLLQKAAGQEYPYAMYRVGLYLDRGVIGEPRPEEAFAWYAKAAERGDGDAIFALGRCYKNGIGTEENPDKALEWFTKGAENNEPRCLTEMGLAYEYGSGIEENPHQAVEYMTKAAEQNYGYAQFKMGDYFFFGYGACPEDNKQAVEWYEKAVANDIPLAMLRMGEYYLYDYDKLNESEKAFSYFKKAAEAECYNEGLGICYEMGIGVEDNETEAFKYYTLAAGSGNVMSMYRTGLCYYNGVGVKQNYTEAYRWFNDAAGNDNVASYYYLGKMLMYGEGCVPDAEAGLQWLMKAAEHNSDKAQFELGNAYLMGNGVEENDEIAMEWFEKAAENGNAKALKITGRRQR

SEQ ID NO: 53015 - DNA, 777 bp, Burkholderia pseudomallei K96243
  CDS (1)..(777): transl_table=11
atgagcgggaaacgccgcggcgcgccgctctccacgcgcacgccgcgtgtgctgctcggcgcggtaatcggttcgctcgccgcggcggcgctcggtgcggcggcgggcggcgcgcttgcgcaggcgccgggcgcgccgagccggcccgacccgcagcgcgagaccgaagcggcggtggccgactacaacgcgggcaatctgcgcgcggcgctcgtgcagtttcacgatgcggcggcgcgcggcaaccgtctcgccgcgttcgattacgcgatgatgctgatcaacggtgagggcgtgacggcgaacgtgccggaaggattgcgctggctgcggcgcgcggccgatgcggggatgacgcaggcgcagtacgtgtacggccggatgctcgacgacggcgaattcgtcgcgcgcgatccggcggccgcgcacgactggttcctgaaggccgcgcagcaagggcacgtgcaggccgagctcgcgctcgcgaaccagtttctcgacgggcgcggcacgccgcgcgacaaccggcaggcgtttgcctggtacaagcgcgcggccgacgcgggcgagccggtttcgcaatacgtgaccgcgtcgttctacgagcgcggcggcgacggcgtcgtgcgcaatctcgacatcgcccgcgcgtactatgcggccgccgccgcgcagggcgacgacgcggcggcgctcaagtatcgcgagctcacggccgcgcagaaggcggggccgggcggcgcgtcggcgccgaaggcgaccgggccgtcgtactga

SEQ ID NO: 53016 - protein, 258 aa, Burkholderia pseudomallei K96243
MSGKRRGAPLSTRTPRVLLGAVIGSLAAAALGAAAGGALAQAPGAPSRPDPQRETEAAVADYNAGNLRAALVQFHDAAARGNRLAAFDYAMMLINGEGVTANVPEGLRWLRRAADAGMTQAQYVYGRMLDDGEFVARDPAAAHDWFLKAAQQGHVQAELALANQFLDGRGTPRDNRQAFAWYKRAADAGEPVSQYVTASFYERGGDGVVRNLDIARAYYAAAAAQGDDAAALKYRELTAAQKAGPGGASAPKATGPSY

SEQ ID NO: 53017 - DNA, 747 bp, Burkholderia pseudomallei K96243
  CDS (1)..(747): transl_table=11
gtggggcgcgcggtatcgttgaaggcgctcgcggcggcgtcgcgcgaggatctcgccgggattctcgcgggcgcgcccgagcgggcggccgcatgggtcgcggcggccgcgcagaacggcatcgtcgaggcgcaggccgtctacgggcagtacctgctcgacggccacggcgtcgcgcgcgacgctgccgccgcgctcgaatggttcaagcacgcggcgcgcgccgaccatccgatggcgatgaacatggtcggccgctgctacgaattcggctggggcacggccgcgagcgcggccgtcgccgtgtactggtaccgcgaggccgcgcgcgcggggctcgactgggggatgtacaactacgcgacgatgctcgcgctcggcaacggcgtggacgaagatcgcgcggccgcgctcgcatggttcgagaaggcggcggcgctcggccacgcgaaatcgatcaacctgatcggcggcttccacgaagacggctgggtcgtcgcggccgaccgcgacgccgcgttcgactgctaccggcgcgcggccgccgcgggcgactttcgcggccagttcaactatgcgcggctgctcgccgaacgcgggcgcgtcgcggaagcgctcgaatggctcgcgcgcgtgccgcgcaccgcgacgcccgcgttcgtcgcgaagatgcgcgcgtatctcgcggcgtcgccgatcgacgcgtttcgcgcgctcgccgcgcgacaggagaaatcggcaacatga

SEQ ID NO: 53018 - protein, 248 aa, Burkholderia pseudomallei K96243
MGRAVSLKALAAASREDLAGILAGAPERAAAWVAAAAQNGIVEAQAVYGQYLLDGHGVARDAAAALEWFKHAARADHPMAMNMVGRCYEFGWGTAASAAVAVYWYREAARAGLDWGMYNYATMLALGNGVDEDRAAALAWFEKAAALGHAKSINLIGGFHEDGWVVAADRDAAFDCYRRAAAAGDFRGQFNYARLLAERGRVAEALEWLARVPRTATPAFVAKMRAYLAASPIDAFRALAARQEKSAT

SEQ ID NO: 53019 - DNA, 609 bp, Methylococcus capsulatus str. Bath
  CDS (1)..(609): transl_table=11
gtgaaggccgtcgagcgcggcgactaccctgccgcattgcgggagttcaagcaggcggccgagcggggtgagtccgcggcccaggtgaatctcggcaatctctacatgaaggggctgggcgtcgagcaggactatgcggccgccgagcgttggtatcgccaggccgccgagcacggcgatcccatggggcagagcaagctgggcatcctttactactacggtctcggcgtggacaagaacaccgacgaagccgcccgctggtttgtcaaggctgcggagcagggtgagcccggcgcggcggcggtgctgggttccatgtatgccgaaggcgagggcgtgatccgcgacaacgtgaaggcctattactggtacacgctggctgcagacgggggacagaccgatgcgctgcaagcgcgtgccaccctcgtggacgaaatgacgcccggcgagatcgccgaagccttgcagcgggtcggcgaatggcgggaggcgcagctcgaggcggccaagtcctcggcacaggatatagcggacaagccttctggcgtgaagggaaaaaagcgcaacggaagtggcggtgctcgaaaaaaatctcgaaataggggataa

SEQ ID NO: 53020 - protein, 202 aa, Methylococcus capsulatus str. Bath
MKAVERGDYPAALREFKQAAERGESAAQVNLGNLYMKGLGVEQDYAAAERWYRQAAEHGDPMGQSKLGILYYYGLGVDKNTDEAARWFVKAAEQGEPGAAAVLGSMYAEGEGVIRDNVKAYYWYTLAADGGQTDALQARATLVDEMTPGEIAEALQRVGEWREAQLEAAKSSAQDIADKPSGVKGKKRNGSGGARKKSRNRG

SEQ ID NO: 53021 - DNA, 1200 bp, Methylococcus capsulatus str. Bath
  CDS (1)..(1200): transl_table=11
gtgccgaacgggcctacttgtgcagcccggcgggctcgggcaagatcggcgttggtgggcggcgagggatttcggatggagtggagcggaaaacgggtttcggatgggagcgcaacgcgtcctacggtggccgcttgggtgtcaggcggattcgggagcggcgagtccgtggcggccttcaaggcgttggcaacggaggccgaggccggggatgcttcggcccagcggcgcctcggcctgtgtttccgtgacgggctcggcacggaccgggacatccaccgggcgaaggcgtggtaccagcgctccgcggctcaaaacgacccgatggcggcgctcgagctggggctcatgctcgaatcgggccttggaatctcctccgatcacggcgaggcggggaaatggtaccgcgtggcgctggacctgtggcgggaccgtgcggaaggcggtgatgccctggggcagttcgttctcggtctttgccatgaggtgggagcgggcgtccccgccgcccaccgggaggcactcaaatggtacggccgttcggcggagcgaggttgcgcccatgcccagtgggccttggggcgtttgcacgaggacggattgggtgtcgtccgcgattattccgaagcggttcgttgctatcgggccgctgcattccagggacatgcccgtgcctgcttcaatctgggcctgatggccgaattggggctggggatggtgcgggatgcagactgctccgccagttggtacggcaaggcgctggaagtctggcggcggtgggcggagctaggcgatcctgcggctgcaacggcgctcgcggccatgtatgaggccggccatggcgtggcaaaggactatgccgtggcggtatgctggtaccggcgggccgccaggcagggtaatccgctggcccagttcgaactggggcggttgagcatggaaggccggggggtggaacgcaacgatgtcgaagcggtaggctggttccggctcgcggccgagcgcggccatgcggacgcgcagttccacctggggctgatgcacgagcatggccggggagtgacgcgccgattcgaagaggcgttccgctggtatgacaaggcagccgatgaagggccggcgagacgttgggacgcgttccaccgtctcgtccccgcagcgggcgaggttccggaaggttgcggtctgggcgcgtggtga

SEQ ID NO: 53022 - protein, 399 aa, Methylococcus capsulatus str. Bath
MPNGPTCAARRARARSALVGGEGFRMEWSGKRVSDGSATRPTVAAWVSGGFGSGESVAAFKALATEAEAGDASAQRRLGLCFRDGLGTDRDIHRAKAWYQRSAAQNDPMAALELGLMLESGLGISSDHGEAGKWYRVALDLWRDRAEGGDALGQFVLGLCHEVGAGVPAAHREALKWYGRSAERGCAHAQWALGRLHEDGLGVVRDYSEAVRCYRAAAFQGHARACFNLGLMAELGLGMVRDADCSASWYGKALEVWRRWAELGDPAAATALAAMYEAGHGVAKDYAVAVCWYRRAARQGNPLAQFELGRLSMEGRGVERNDVEAVGWFRLAAERGHADAQFHLGLMHEHGRGVTRRFEEAFRWYDKAADEGPARRWDAFHRLVPAAGEVPEGCGLGAW

SEQ ID NO: 53023 - DNA, 1473 bp, Legionella pneumophila str. Paris
  CDS (1)..(1473): transl_table=11
atgatgaaacaattggttgttgcaggatttttcttattacttctaacttcccctttatcagcgctggatgttgatacctatcgtagttcacaaaaacaattcaatacagaggataaggcggaacagggtgatgctcaagcacagtttgaattagggctcaaatatgaaaagggtgatggagtaaataaagatttaaaaaaagcgatttattggtatcagaaagctgcagatcaaggacaagctgaggcacaaaataatctcggtgtattgtatcttaaaggagagggtgtgccccaaaacagtcagcaagcaatgtattggtttaagaaggcttcggaacagggtttggcaattggtcaaaataatataggaattctatatgaaaatggcctgggtgttaaaaaagatctgggccaggcttttatctggtatcaaaaggctgcagaaggcggaaattcagacggacaatataaccttgcagtcatgtatatgtatgggaatggtataccaaaagatatcaagaaggcgattcactggtatatcaaagcagcagagcaaggagatcttgatgctcaaaataatcttggtgttctttatgagcgaggcgaagaggttccaagagatttaaaagcagctattagttggtataccagagcagcaaatgaaggttcactgattgctcaaactaaccttggtgtattgtatatgactggtgatccttctattcaagatggcaagaaagcaatatattggtatgaaaaagcagcggcacaaggtggggaaaaagcacaaaataatcttgggtatatttacgaacaaggaattggtacagaaaaggatatgaaaaaggctatttactggtacgaaaaagccgcagagaatggatttactctggctcaaaataatttaggtgttctctattcaaatgatggcgagctgcaagattacaaaaaggcttatttatggttcaaaaaagccgcagatcaaggatttgccgaagcccaaaataacttgggtttaatgtatatgaaaggcaatggactgtcagttaattatcacgaagcagtcttgtggtacaagagagcggcagaacaaggattacctttagcgcaacataatctggcgattatgtatatgaaagggctggggataaagaaagacaataaactggccattaaatggtaccaaaaagctgctgaaaaaggattggatttggcgcaaaacaatttggcggttatgtatatacgtggtgaaggagtaaaaagagattttaagaaagccatgtattggtatcaaaaggcagctgaacaaggtttggatttggcacaaattaatctgggtattatgtatcttgatggcatgggtgttaataaagatttcgctaaagcaaagtactggattggaaaagccaaggacagtggttctcaagatgcgctgactatatggaataaaaataaattgtggaaatattag

SEQ ID NO: 53024 - protein, 490 aa, Legionella pneumophila str. Paris
MMKQLVVAGFFLLLLTSPLSALDVDTYRSSQKQFNTEDKAEQGDAQAQFELGLKYEKGDGVNKDLKKAIYWYQKAADQGQAEAQNNLGVLYLKGEGVPQNSQQAMYWFKKASEQGLAIGQNNIGILYENGLGVKKDLGQAFIWYQKAAEGGNSDGQYNLAVMYMYGNGIPKDIKKAIHWYIKAAEQGDLDAQNNLGVLYERGEEVPRDLKAAISWYTRAANEGSLIAQTNLGVLYMTGDPSIQDGKKAIYWYEKAAAQGGEKAQNNLGYIYEQGIGTEKDMKKAIYWYEKAAENGFTLAQNNLGVLYSNDGELQDYKKAYLWFKKAADQGFAEAQNNLGLMYMKGNGLSVNYHEAVLWYKRAAEQGLPLAQHNLAIMYMKGLGIKKDNKLAIKWYQKAAEKGLDLAQNNLAVMYIRGEGVKRDFKKAMYWYQKAAEQGLDLAQINLGIMYLDGMGVNKDFAKAKYWIGKAKDSGSQDALTIWNKNKLWKY

SEQ ID NO: 53025 - DNA, 1131 bp, Legionella pneumophila str. Paris
  CDS (1)..(1131): transl_table=11
atgcaaggttttgtcttggctctgttattagcaattagcagtagtgtttttgctgatgaattagtaggttttgcagcatttgaaaatggcgactacaccacagcctatccacatttaatgcaggctgccaaagaaggtaatgaggaagccatgtatttattggggcgcatgtatcaatacggatatggtgtgacaactaattacgaagaagccagaaactggtatcaaaaggcagctgataaaaataatgcattggctcaattaagtttgggatttatgtacgatacaggtaagggggtatctcaggattttgctgaggccttcaaatggtatatgaaggcagcagagcaaggaaatccgatagcacaaagaaatattggattaatgtatgccacaggagatggtgtagctgccagtgatgacaaagcattcacctggtttaaaaaggccgcagaacaaggctatagcaaggcacaagtgaatttgggttatcagtacatgatgggtaaaggaactccaaaagatgtaaaaaaagcatttgaatggtatcaaaaggcggcagagcagggggatgaaaagggcgaatacagtctaggtctattgtatacaggccaggaaggtgggattagtgcggatgataaagccgctttttactggttttcacaagcagccaatcatggacatgtcaacgcacaaacctatttagcttactattatcttaaagggtatggtgtagatgctgatcctgtgaaagcagcttattggtaccaatctgcagcagaaaagggacaacctgaagcacaggcacaattaggacaattgttattaactggtacaggtgttgataaagattaccaacaggcagcttactggtttggtaagtcagcacatcagggaaatcctgttggacaagccaaattggggtatatgtatttagcaggattaggagtcaacaagagcttggttaaagcttacgcctggttaaaaattgctgctgaaaataaaaatgaggaagcagcaaagcaacttaaatctttggaagccaagttgaccgaacctgaaaaattggaagcagagaaaatgatcaaggatttgggcccattagaaagcaaagagaattatgaggactaa

SEQ ID NO: 53026 - protein, 376 aa, Legionella pneumophila str. Paris
MQGFVLALLLAISSSVFADELVGFAAFENGDYTTAYPHLMQAAKEGNEEAMYLLGRMYQYGYGVTTNYEEARNWYQKAADKNNALAQLSLGFMYDTGKGVSQDFAEAFKWYMKAAEQGNPIAQRNIGLMYATGDGVAASDDKAFTWFKKAAEQGYSKAQVNLGYQYMMGKGTPKDVKKAFEWYQKAAEQGDEKGEYSLGLLYTGQEGGISADDKAAFYWFSQAANHGHVNAQTYLAYYYLKGYGVDADPVKAAYWYQSAAEKGQPEAQAQLGQLLLTGTGVDKDYQQAAYWFGKSAHQGNPVGQAKLGYMYLAGLGVNKSLVKAYAWLKIAAENKNEEAAKQLKSLEAKLTEPEKLEAEKMIKDLGPLESKENYED

SEQ ID NO: 53027 - DNA, 1122 bp, Legionella pneumophila str. Paris
  CDS (1)..(1122): transl_table=11
atgaaaaaatatattttatctctttctctactgacggtgattaactcttcagctatcgctacgactcaggaaggtgaggaggcctataacaaggggtattacgaaaaagcatttattttgttgtctcctgaagcggataaaggagatgccaaggctcaatatttgctgggtaagatgtattataatgcccaaggtgtaacttataatccggaaaaaacagagcaattattacttgcctcagcgaatcaaggcaatgtcgatgcccaggtattgttagctggtttctattggtaccttaatacacctgagggctataaaaaggcgtttgaatggtatcagaaagcagcggatcaaaataatgcagatggtcaatatggcttgggctatatgtatgatacaggaactggtgtacctcagaattccgatacagccatggtatggtataaaaaagcagcagagcaaggcaactctaatgcggctttggctattggttataattatgataccggtacaggggtgaaaaaagataagactcaggctctcaactggtatgcaaaagcagctgacttaggtaatgccagcgcacaatataatcttggtttgatgtatgagcaaggggatggtgttcctaaagattatcagaaagcagcagagtatttcgagaaagcagcgaatcaaggtcatgccaaatcgcaattggagttaggttatttatatgattctggaaaattaggtaaatcggatctgcaaaaggctgctttttggtatcaaaaaagcgcagatctggggaatgccaatgcgcaatttaatttagctgatatgtatttttacggtgatggggtcggtaaaagccttgagcaatccgtatactggatgcaaaaagcagctgagcaagggtatggtaaggctcaaaatcaattaggtatctattacagagacggtattggtgttgctgctgatcctgtaaaagcttatgcctggtttacagcagccaagaataatggctttgaaaaagcgacgagcaatgccagtgatcttgagaaatctatgaacccagaggatctgagtaaggcgagaactttaggacaacaatatacggataattacaaggccaaaaaataa

SEQ ID NO: 53028 - protein, 373 aa, Legionella pneumophila str. Paris
MKKYILSLSLLTVINSSAIATTQEGEEAYNKGYYEKAFILLSPEADKGDAKAQYLLGKMYYNAQGVTYNPEKTEQLLLASANQGNVDAQVLLAGFYWYLNTPEGYKKAFEWYQKAADQNNADGQYGLGYMYDTGTGVPQNSDTAMVWYKKAAEQGNSNAALAIGYNYDTGTGVKKDKTQALNWYAKAADLGNASAQYNLGLMYEQGDGVPKDYQKAAEYFEKAANQGHAKSQLELGYLYDSGKLGKSDLQKAAFWYQKSADLGNANAQFNLADMYFYGDGVGKSLEQSVYWMQKAAEQGYGKAQNQLGIYYRDGIGVAADPVKAYAWFTAAKNNGFEKATSNASDLEKSMNPEDLSKARTLGQQYTDNYKAKK

SEQ ID NO: 53029 - DNA, 3603 bp, Legionella pneumophila str. Paris
  CDS (1)..(3603): transl_table=11
atgaaatcactagtaccttgggtgtgtgttttagtcgcgtcagctggccaacaggcttttgccaatgatgcgttcaatgcttatagattaggcaattataatgaagcagctgaacccctaatcattaaatcaggtcaggatgctgttgccgaatattatttagggcgactttatctctatggatatggacagttaaaaaacaatcgtgttgcgatgcgctactttaccaaatcagcggaaaaaggctatttacctgctgtcctgcttatggccaaatacagtttgctccatgaaaaaaatccggaagaagctgctcgttggtttaagcaagcagccgcggtgggagatgtaagcgcacaaatgtttatggcggcagcttatttatatggagttggcgtcaagaaaaatacagatatcgcgagacgttattatattgatgcagcaaaaaatggtaatcctattgctcaatacaccttagcagagtatttcttagagagtaagcatgcgggtaataaaaaattaggaatcatttggctgaataaagcagcagaaaatggagatccaaaagctttaacagaattgggcagattttatgtggccggacaaatggttgccaaggatacttccaagggcgtcgaattattaaataaagcagcttcagaacaatatgccccagctatgcttgagttgggtaaattggctttaatgcaaaatcaatacgatgaggctattcaatggcttaataaggccgcgaaacagagtacagaagctactcttgaattagcccatatttatttacaagataaaagtccagtttatgatccaaaaacaggttttttattggtactaaaagcagctcagaatggttctgttcaagcccaaaaagaattagccaatttatatcaaaaagggattggcgtagcggctgatgaggaattgtctaaacaatggactcttaaagcagcagaaaatgagaagaaaaatgcagagcctcctgttcttgcccaagctgcattatggctaagtaatgacagaacggataaattggaagagacggcttaccagatgaatggtatatttagcccatggaataatccgtctgccttgagaaataatagctataatcaagcacctaagcttgaaaccatctctcgtcaggatattttcaaaccgcaatttgagttgactcagcctaataatattcctataagcaattactatgatgctttaatcagtaaacaagtggagtttcaatcaaatcaatgggcttatccaacttacagacttaacccatttgtagaagctttagagagagccaatagtcctgttgtacaaaagctcaacttgccagttccttatgccgacgcgaattatgatgatagcgaagttggcagttttgatttgatggacatttggacaggagattggaaacggactgtcaattatatgtctgtggttaattatttgtatttcagggcaatacttggaaatgcccaaactcaatttgaaattggtcaattgtttcaatatgggattggtttaatgcaagatgatgcttcggctattattttttatgagaatgccgcagaacaaaagcacttaggtgctgaatataatttgggaatactttatctgaaacgcggtaaagacgaaaatgattaccaacaagcattaaattggctgactgattccgcattcaaagggaataagagagcacaatacgtattggcaaggatattgcgccaggggatcgttggtcctgatggaaaagagtatattaaagcaaatgatgagcaagctatggccatgctttatctttcagctgccaatgattatgggccggcagaatatgagttggcagaatatttggcaagagactacaacaatggtttaagtgtagatgtcagaaaacaaaaaattgccttaataagaaaattataccaaggtgctgtgaagaataaagtggcagaggcattgttgccattggcattttataatgcgatggatgataacaggcaaaagcaggaacaagcatttaaagtagccgaagagcaagctgaaacaggtaatgagaacgccgctcttttactcggtatgctatatgaccgtggtataggaataacagctgatccagccaaggccatgtactggtatcaacaagccggacaaaatcccgtaagtcagtttatattgggtacttacataacagaaggaaaaggggtcgcacaggataaggaaaaaggattggatttgctgaagcaatcagcagactcccaattttcctatgccgactttaatctggcagtactcaagcaacaatccggggaagactttttacccaatttaattgaatcctataaattagggaatagtcatgcggggatagtgttggcagattattatttatctcaaagcagtgttcctgaacaaatgaatcaagctaaggaaatttatcagggcttagctgataaaggcgatcaatatgcacaattaaaattggcttatatgctacaaaaaggattgggtgccgcaccggatcttgctggcgcgcaacattggtatactgcttcggcagaacaaggcaatcctgaggcacaatacttattaggccaattttatcaactaggtgaaacaggagaacctgattataatttggccaaacattggtatcaaaaagcagcgaaacatttatctaaagccgatgtagcattaggttttatttatgaaacggtagatgataattatgctcaagcactaaaagcttatgaaaatgctgcagcaaaaggagatatgctaggcgcttataatttggctttaatgtatgagtatggcaagggcgtgcccgtcaattactccaaagcgttatctttgtttaaagaagcatcagagaaaggtgctcctgaagcgatgagtcaattggctggaatgtatttttatggtttggggcaaccaagaaacgaacaacaagctttggtctggtataaaaaggctgcaagcttaggtaatgggaatgctttgtatgccctcggtttattatccgaaactggtgttggtgttaaattggattttccagatgctttacggtattaccaggatgcatctgataaaggtaatgaaaaagcaatgctggctttggcaagaatgtatcattatggtcttggtgttgaaaaggatcataaaaggtcagcgagtatttatcaaaaattggcacaaaagcaaaatgcttatgctcaatatcaattaggtacttattatattgagggaacggcaggcgaacgactacccgaaaaaggccgtgagctattacaacaagcgagtgaaaacggaagtttacaggcccgtagagtattgcaaagattagatgcacaaacccagggtaaagtaagttatgtcgagcccgtgttatttaataatgttcccaaatttgatggtcaaagtgctgatatgatttattttgatgcattaaatgaatggaatcatggggaggaggttttgtccagaatgatcttgcaacgtctggtgacgcaatatcccaatttcatccctgcaaagcgagcttatgagcagttgaatcaagccaaattaatgaataacttgggttaa

SEQ ID NO: 53030 - protein, 1200 aa, Legionella pneumophila str. Paris
MKSLVPWVCVLVASAGQQAFANDAFNAYRLGNYNEAAEPLIIKSGQDAVAEYYLGRLYLYGYGQLKNNRVAMRYFTKSAEKGYLPAVLLMAKYSLLHEKNPEEAARWFKQAAAVGDVSAQMFMAAAYLYGVGVKKNTDIARRYYIDAAKNGNPIAQYTLAEYFLESKHAGNKKLGIIWLNKAAENGDPKALTELGRFYVAGQMVAKDTSKGVELLNKAASEQYAPAMLELGKLALMQNQYDEAIQWLNKAAKQSTEATLELAHIYLQDKSPVYDPKTGFLLVLKAAQNGSVQAQKELANLYQKGIGVAADEELSKQWTLKAAENEKKNAEPPVLAQAALWLSNDRTDKLEETAYQMNGIFSPWNNPSALRNNSYNQAPKLETISRQDIFKPQFELTQPNNIPISNYYDALISKQVEFQSNQWAYPTYRLNPFVEALERANSPVVQKLNLPVPYADANYDDSEVGSFDLMDIWTGDWKRTVNYMSVVNYLYFRAILGNAQTQFEIGQLFQYGIGLMQDDASAIIFYENAAEQKHLGAEYNLGILYLKRGKDENDYQQALNWLTDSAFKGNKRAQYVLARILRQGIVGPDGKEYIKANDEQAMAMLYLSAANDYGPAEYELAEYLARDYNNGLSVDVRKQKIALIRKLYQGAVKNKVAEALLPLAFYNAMDDNRQKQEQAFKVAEEQAETGNENAALLLGMLYDRGIGITADPAKAMYWYQQAGQNPVSQFILGTYITEGKGVAQDKEKGLDLLKQSADSQFSYADFNLAVLKQQSGEDFLPNLIESYKLGNSHAGIVLADYYLSQSSVPEQMNQAKEIYQGLADKGDQYAQLKLAYMLQKGLGAAPDLAGAQHWYTASAEQGNPEAQYLLGQFYQLGETGEPDYNLAKHWYQKAAKHLSKADVALGFIYETVDDNYAQALKAYENAAAKGDMLGAYNLALMYEYGKGVPVNYSKALSLFKEASEKGAPEAMSQLAGMYFYGLGQPRNEQQALVWYKKAASLGNGNALYALGLLSETGVGVKLDFPDALRYYQDASDKGNEKAMLALARMYHYGLGVEKDHKRSASIYQKLAQKQNAYAQYQLGTYYIEGTAGERLPEKGRELLQQASENGSLQARRVLQRLDAQTQGKVSYVEPVLFNNVPKFDGQSADMIYFDALNEWNHGEEVLSRMILQRLVTQYPNFIPAKRAYEQLNQAKLMNNLG

SEQ ID NO: 53031 - DNA, 1029 bp, Legionella pneumophila str. Lens
  CDS (1)..(1029): transl_table=11
atgcgtttacgtcttgtcatcttagttttagccgcaattattattggtgtgggaagttattctgggatagtgaatgtcattaaagaacccatagaaaatatgataatagggtataaaagcccatcagcctggaataatcgtggtgtagattatgtgattggcaaaagagtagcacaaaatgactctgaagctgtaaaatggttttgcaaggcagcgaaacaaggcgaagccatggcccagcgcaaccttggcttgatgtatgctgcaggcaaaggggtccctcaggataatggcaaggctatgcaatggtttcgtaaagccgctcttcaaaatgatgccgtgtcacaattaaatcttggtgtcatgtatcaaaaaggtatgggtactcagcaaaacgatagggaagcaatcaagtggattcataaagcagccgcacaaggatttccagaggctgaacgtagtcttggcatcctatattccactgctgaaaatgggcaacaaaattatgtcgaagcttttaaatggcttcacaaggcagctgagaaagaagatgccatagcccaatataatcttgcagttatgtatgtcacaggcaagggggttcggcaaaatgatacggaagcagttaagtggtttcgtaaagcaggcaaacatggcgatctcatggctcaacgaacacttggattaatgtacgcaacggggagcaatgttcaacaggatgattttcaagcgatgaaatggtttcgtctggccgcgaaacaaggagatgctgtggctcaatataatataggtataggctttcttaacggcaaaggggtgattcgaaatcacacaaaagctctgaaatggtttcatttagctgctagtcaaggattgccccaagctcaatatgtgcttgctgcactttatcatgatggagtgagtcttcctcaaaatagcatggaagcaataaagtggctccgaaaggctgctgcgcaaggtcacttgcaagctcaagagcgcctgcaggctctggttagacaggattag

SEQ ID NO: 53032 - protein, 342 aa, Legionella pneumophila str. Lens
MRLRLVILVLAAIIIGVGSYSGIVNVIKEPIENMIIGYKSPSAWNNRGVDYVIGKRVAQNDSEAVKWFCKAAKQGEAMAQRNLGLMYAAGKGVPQDNGKAMQWFRKAALQNDAVSQLNLGVMYQKGMGTQQNDREAIKWIHKAAAQGFPEAERSLGILYSTAENGQQNYVEAFKWLHKAAEKEDAIAQYNLAVMYVTGKGVRQNDTEAVKWFRKAGKHGDLMAQRTLGLMYATGSNVQQDDFQAMKWFRLAAKQGDAVAQYNIGIGFLNGKGVIRNHTKALKWFHLAASQGLPQAQYVLAALYHDGVSLPQNSMEAIKWLRKAAAQGHLQAQERLQALVRQD

SEQ ID NO: 53033 - DNA, 1131 bp, Legionella pneumophila str. Lens
  CDS (1)..(1131): transl_table=11
atgcgaggttttttgttagctctattattgtcgattaacactgctgttttggccgatgagttagttggttttgcagcatttgaaaatggcgactacaccacagcctatccacatttaatgcaggctgccaaagatggtaatgaggaagccatgtatttattggggcgcatgtatcaatacggatatggtgtgacaactaactacgaagaagccagaaattggtatcaaaaggcagctgataaaaatgatgcattagcccaattaagtttgggatttatgtacgatacaggtaagggggtatctcaggattttgctgaggccttcaaatggtatatgaaggcagcagagcaaggaaatccgatagcacaaagaaatatcggattaatgtatgccacaggagatggtgtaactgccagtgatgataaagcattcacctggtttaaaaaggcggcagaacaaggctatagcaaggcacaagtgaatttgggttatcaatacatgatgggtaaaggaactccaaaagatgtaaaaaaagcatttgaatggtatcaaaaagcggcagagcagggggatgaaaagggcgaatacagtttaggtctattgtatacaggccaggaaggtgggattagtgcggatgataaagccgctttttactggttttcgcaagcagccaatcatggacatgtcaacgcacaaacctatttagcttactactatcttaaagggtatggtgtagatgctgatcctgtgaaagcagcttattggtatcaatctgcagcagaaaaggggcaacctgaagcacaggcacaattgggacaattgttattgacaggtacaggtgttgataaagattaccaacaggcagcttactggtttggtaagtcagcgcatcagggtaatcctgttggacaagccaaattggggtacatgtatttagcaggattaggagtcaacaagagcttggttaaagcttacgcctggttaaaaattgctgctgaaaataaaaatgaggaagcggcaaagcaacttaaatctttggaagtcaagttggccgaacctgaaaaattggaagcagagaaaatgatcaaggatttgggcccattagaaagcaaagagaattatgaggactaa

SEQ ID NO: 53034 - protein, 376 aa, Legionella pneumophila str. Lens
MRGFLLALLLSINTAVLADELVGFAAFENGDYTTAYPHLMQAAKDGNEEAMYLLGRMYQYGYGVTTNYEEARNWYQKAADKNDALAQLSLGFMYDTGKGVSQDFAEAFKWYMKAAEQGNPIAQRNIGLMYATGDGVTASDDKAFTWFKKAAEQGYSKAQVNLGYQYMMGKGTPKDVKKAFEWYQKAAEQGDEKGEYSLGLLYTGQEGGISADDKAAFYWFSQAANHGHVNAQTYLAYYYLKGYGVDADPVKAAYWYQSAAEKGQPEAQAQLGQLLLTGTGVDKDYQQAAYWFGKSAHQGNPVGQAKLGYMYLAGLGVNKSLVKAYAWLKIAAENKNEEAAKQLKSLEVKLAEPEKLEAEKMIKDLGPLESKENYED

SEQ ID NO: 53035 - DNA, 1122 bp, Legionella pneumophila str. Lens
  CDS (1)..(1122): transl_table=11
atgaaaaaatatattttatctctttctctactgacggtgattaactcttcagctatcgctacgactcaggaaggtgaggaggcctataacaagggatattacgaaaaagcatttattttgttgtctcctgaagcagataaaggagatgccaaggctcaatatttgctgggtaagatgtattataatgcccaaggtgtaacttataatccggaaaaaacagagcaattattacttgcctcagcgaatcaaggcaatgtcgatgcccaggtattgttagccggtttctattggtaccttaatacaccagagggctataaaaaggcgtttgaatggtatcagaaagcagcggatcaaaataatgcagatggtcaatatggcttgggctatatgtatgatacaggaactggtgtacctcagaattccgatacagctatggtatggtataaaaaagcagcagagcaaggcaactctaatgcggctttagctattggttataattatgataccggtacaggggtgaaaaaggataagactcaggctcttaactggtatgcaaaagccgctgacttaggtaatgccagcgcacaatataaccttggtttgatgtatgagcaaggggatggtgttcctaaagattttcagaaggctgctgagtattttgagaaagcagcaaatcaggatcatgccaaatcgcaattggagttaggttatttatatgattcaggaaaattaggtaaatcggatctgcaaaaggctgctttttggtatcaaaaaagcgcagatctggggaatgccaatgcgcaatttaatttagctgatatgtatttttacggtgatggggtcggtaaaagccttgagcaatccgtatactggatgcaaaaagcagctgagcaagggtatggtaaggctcaaaatcaattaggtatctattacagagacggtattggtgttgctgctgatcctgtaaaagcttatgcctggtttacagcagccaagagtaatggctttgaaaaagcggcgagcaatgccagtgatcttgagaaatctatgaacccagaggatctgagtaaggcgagaactttaggacaacaatatacggataattacaaggccaaaaaataa

SEQ ID NO: 53036 - protein, 373 aa, Legionella pneumophila str. Lens
MKKYILSLSLLTVINSSAIATTQEGEEAYNKGYYEKAFILLSPEADKGDAKAQYLLGKMYYNAQGVTYNPEKTEQLLLASANQGNVDAQVLLAGFYWYLNTPEGYKKAFEWYQKAADQNNADGQYGLGYMYDTGTGVPQNSDTAMVWYKKAAEQGNSNAALAIGYNYDTGTGVKKDKTQALNWYAKAADLGNASAQYNLGLMYEQGDGVPKDFQKAAEYFEKAANQDHAKSQLELGYLYDSGKLGKSDLQKAAFWYQKSADLGNANAQFNLADMYFYGDGVGKSLEQSVYWMQKAAEQGYGKAQNQLGIYYRDGIGVAADPVKAYAWFTAAKSNGFEKAASNASDLEKSMNPEDLSKARTLGQQYTDNYKAKK

SEQ ID NO: 53037 - DNA, 3603 bp, Legionella pneumophila str. Lens
  CDS (1)..(3603): transl_table=11
atgaaatcactagtaccttgggtgtgtgttttagtcgcgtcagctggccaacaggcttttgccaatgatgcgttcaatgcttatagattaggcaattataatgaagcagctgagcccctaatcattaaatcaggtcaggatgctgttgccgaatactatttagggcgactttatctctatggatatgggcagttaaaaaacaatcgtgttgcgatgcgctactttaccaaatcggcggaaaaaggctatttacctgctgtcttgctcatggccaaatacagtttgctccatgaaaaaaatccggaagaagctgcccgttggtttaagcaagcagctgcggtgggagatgtgagcgcacaaatgtatatggcggcagcttatttatatggtgttggcgtcaagaaaaatacagatatcgcaagacgttattatattgatgcagcaaaaaatggtaatcctattgctcaatacaccttagcagagtatttcttagagagtaagcatgcggctaataaaaaattagggatcatttggctgaataaagcagcagaaaatggagatccaaaagctttaacagaattgggcagattttatgtcgccggacaaatggttgccaaggatactgccaagggcgtcgaattattaaataaagcagcctcagaacaatatactccagccatgcttgagttgggtaaattggctttaatgcaaaatcaatacgatgaggctattcaatggcttaataaggccgaggaacagagtacagaagctactcttgagttagcccatatttatttacaagataaaagtccagtttatgatccaaaaacaggttttttattggtattaaaagcagctcagaacggttctgttcaagcccaaaaagaattagccaatttatatcaaaaagggattggcgtagcggctgatgaagaattgtctaaacaatggactcttaaagcagcagaaaacgagaagaaaaatgcagagccccctgttcttgcccaagccgcattatggctaagtaatgacaaaacggataaattggaagagacggcttaccagatgaatggtatatttagcccatggaataatccgtctgctctgagaaataatagctataatcaagcacctaagcttgaaaccatctctcgtcaggatattttcaaaccacaatttgagttgactcagcctaatagtattcctataagcaattactatgatgctttaatcagtaaacaagtggagtttcaatcaaatcaatgggcttatccaacttacagacttaacccattcgtagaggctctagagagagccaatagtcctgttgtgcaaaagctcaacttgccagttccttatgccgacgcgaattatgatgatagcgaagttggcagttttgatttgatggacatttggacaggggattggaaacggactgtcaattatatgtctgtggtcaattatttgtatttcagggcaatactcggaaatgctcaaactcaatttgaaattggtcaattgtttcaatatgggattggtttaatgcaagatgatgcttcggctattattttttatgagaatgccgcagaacaaaagcacttgggtgctgaatataatttgggaatactttatctgaaacgcggtaaagacgaaaatgattaccaacaagcattaaattggctgactgactccgcattcaaaggcaatcaaagagcacaatacgtattggcaaggatattgcgccaggggatcgttggtcctgatggaaaagagtatattaaagcaaatgatgagcaagctatggccatgctttatctttcagctgccaatgattatgggccggcagaatatgagttggcagaatatttggcaagagactacaacaatggtttaagtgtagatgtcagaaaacaaaaaattgccttaataagaaagttataccaaggtgctgtgaagaataaagtggcagaggcattgttgccattggcattttataatgcgatggatgataacaggcaaaagcaggaacaagcatttaaagtagccgaagagcaagctgaaacaggtaatgcgaatgccgctcttttactcggaatgctctatgaccgtggtataggaataaccgctgatccagccaaggccatgtactggtatcaacaagccggacaaaatcccgtaagtcagtttatattgggtacttacatcacagaaggaaaaggggtggcacaggataaggaaaaaggattggatttgcttaagcaatcagcagactcccaattttcctatgccgactttaatctggcagtactcaagcaacaatcaggggaagactttttacccaacttaattgaatcttataaattagggaatagtcatgcggggatagtattggcagattattatttatctcaaagcagcgttcctgaacaaatgaatcaagctaaggaaatttataagggcttagctgataaaggcgatcaatatgcacaattaaaattggcttatatgctacaaaaaggattgggtgccgcgcctgatcttgctggcgcgcaacattggtatactgcttcggcagaacaaggcaatcctgaggcacaatacttattaggccaattttatcaactaggtgaaacaggagaacctgattataatttggccaaatactggtatcaaaaagcagcgaaacatttatctaaagccgatgtagcattaggttttatttatgaaacggtagatgataattatgctcaagcactaaaagcctatgaaaatgctgcagcaaaaggagatatgctaggcgcttataatttggctttaatgtatgagtatggcaagggcgtgcccgtcaattactccaaagcgttatctttgtttaaagaagcatcagagaaaggtgctcctgaagcgatgagtcaattggctggaatgtatttttatggtttggggcaaccaagaaacgaacaacaagctttggtctggtataagaaagctgcaagcttaggtaatgggaatgcgttgtatgccctcggtttattatccgaaactggtgttggtgttaaattggattttccagatgctttacggtattaccaggatgcatctgataaaggtaatgaaaaagcaatgctggctttggcaagaatgtatcattatggtcttggtgtcgaaaaggatcataaaagatcagcgagtatttatcaaaaattggcacaaaagcaaaatgcttatgctcaatatcaattaggtacttattatattgagggaacggcaggcgaacgactacccgaaaaaggccgtgagctattacaacaagcgagtgaaaacggaagtttacaggcccgtagagtattgcaaagattagatgcacaaacccagggtaaagtaagttatgtcgagcccgtgttatttaataatgttcccaaatttgatggtcaaagtgctgatatgatttattttgatgcattaaatgaatggaatcatggggaggaggttttgtccagaatgatcttgcaacgtctggtgacgcaatatcccaattttatccctgcaaagcgagcttatgagcagttgaatcaagccaaattaatgaataacttgggttaa

SEQ ID NO: 53038 - protein, 1200 aa, Legionella pneumophila str. Lens
MKSLVPWVCVLVASAGQQAFANDAFNAYRLGNYNEAAEPLIIKSGQDAVAEYYLGRLYLYGYGQLKNNRVAMRYFTKSAEKGYLPAVLLMAKYSLLHEKNPEEAARWFKQAAAVGDVSAQMYMAAAYLYGVGVKKNTDIARRYYIDAAKNGNPIAQYTLAEYFLESKHAANKKLGIIWLNKAAENGDPKALTELGRFYVAGQMVAKDTAKGVELLNKAASEQYTPAMLELGKLALMQNQYDEAIQWLNKAEEQSTEATLELAHIYLQDKSPVYDPKTGFLLVLKAAQNGSVQAQKELANLYQKGIGVAADEELSKQWTLKAAENEKKNAEPPVLAQAALWLSNDKTDKLEETAYQMNGIFSPWNNPSALRNNSYNQAPKLETISRQDIFKPQFELTQPNSIPISNYYDALISKQVEFQSNQWAYPTYRLNPFVEALERANSPVVQKLNLPVPYADANYDDSEVGSFDLMDIWTGDWKRTVNYMSVVNYLYFRAILGNAQTQFEIGQLFQYGIGLMQDDASAIIFYENAAEQKHLGAEYNLGILYLKRGKDENDYQQALNWLTDSAFKGNQRAQYVLARILRQGIVGPDGKEYIKANDEQAMAMLYLSAANDYGPAEYELAEYLARDYNNGLSVDVRKQKIALIRKLYQGAVKNKVAEALLPLAFYNAMDDNRQKQEQAFKVAEEQAETGNANAALLLGMLYDRGIGITADPAKAMYWYQQAGQNPVSQFILGTYITEGKGVAQDKEKGLDLLKQSADSQFSYADFNLAVLKQQSGEDFLPNLIESYKLGNSHAGIVLADYYLSQSSVPEQMNQAKEIYKGLADKGDQYAQLKLAYMLQKGLGAAPDLAGAQHWYTASAEQGNPEAQYLLGQFYQLGETGEPDYNLAKYWYQKAAKHLSKADVALGFIYETVDDNYAQALKAYENAAAKGDMLGAYNLALMYEYGKGVPVNYSKALSLFKEASEKGAPEAMSQLAGMYFYGLGQPRNEQQALVWYKKAASLGNGNALYALGLLSETGVGVKLDFPDALRYYQDASDKGNEKAMLALARMYHYGLGVEKDHKRSASIYQKLAQKQNAYAQYQLGTYYIEGTAGERLPEKGRELLQQASENGSLQARRVLQRLDAQTQGKVSYVEPVLFNNVPKFDGQSADMIYFDALNEWNHGEEVLSRMILQRLVTQYPNFIPAKRAYEQLNQAKLMNNLG

SEQ ID NO: 53039 - DNA, 1530 bp, Salmonella enterica subsp. enterica serovar Paratyphi A str. ATCC
  CDS (1)..(1530): transl_table=11
atgcgtttttcatcaattttcaaaataataatattaaatatatttatttcaaaaatggctcacgctgctgtctgcgaggagcgctatcccgccgactcagaagaatgccagtacgttcaggaattagagcaaaaagcggaacaaggagatgaaagcgcgcagttcgcgcttggaagctggtatgcggaggggcgatacgttaagcctgattataaactagccataaaatggctggagaaagcgggtaaacaaggttcggatttttcctatttcatccttggctatcattacaactatggtgaaaattttccacttagtcgacaaaaagcgctggagtggtatcgcaaggcggcagagctaggggatagtagtacgcaagaaattctcggtgacgcctatatgtatggcgatgggtttccccaaaatacccagctagcgctggagtggtatcgaaaagccgcctctccaaccaatgatgcgggcgttgtccgcggacagggttcagcttcgtcagcacaatttaagcttggagtaatgtacgcccacggtcagggcgttcctcaggattatcagcaaacggcgatcttgatgcgtaaagcggcggaaaatatgtactaccccgcgcaactttatctcggtgttgcctatttttatggtgaaggcgtgcctcaggattatcgtcaggcagtttactggcttaatgaaggtataccaggcagctatacgccaggccacattccgctgagtgcgctctatgataaagcgcatcccgctgaccgggttcactctcagacgtggtatcgaaaaacagcgcaacgcgtgatggcaaaggtacagtacaattttggcgtatggtattacaacggttatcacttattgaaagatcacaacctggcgctggagtggtatcgcagagccgcagcgcaaggattggccgaggcgcaggatgcgatcggcgtgatgtttatgcagggtgagggcgtttctcaggactaccaacaggcgctggcgtggtatcgcaaagccgcacgccagggactgcctgctgcgcaaacgcatctgggcatcatgtctgcttttggtcgcgacgtcgcgcaaagcgacagacaggctatcgcatggtatcgaaaagcagcaaaacaggattttgcgaaagcgcaatatcagcttggcgtagcatatagcacgggaagaggcgtgcctgaaaatagccggaatgcgctgaagtggtaccttaaagcggcagagcaggggtttactcctgcacaatcagcgcttggggaaatttatgctcatgggcgccagggtgtgcctaaagataataagcaggcctatatttggtattacatggcaagtatgtatacggaaaaatctaaggatgattgttcagcgctcattgccgaaagaaaccgactcaagggaacgctcaccccagatcaacttagcgagacatatgccgcctttaatctcatctggcgaaaaattgaccagtcaaaggaggcgaaaaagattgccaggaagaagtattga

SEQ ID NO: 53040 - protein, 509 aa, Salmonella enterica subsp. enterica serovar Paratyphi A str. ATCC
MRFSSIFKIIILNIFISKMAHAAVCEERYPADSEECQYVQELEQKAEQGDESAQFALGSWYAEGRYVKPDYKLAIKWLEKAGKQGSDFSYFILGYHYNYGENFPLSRQKALEWYRKAAELGDSSTQEILGDAYMYGDGFPQNTQLALEWYRKAASPTNDAGVVRGQGSASSAQFKLGVMYAHGQGVPQDYQQTAILMRKAAENMYYPAQLYLGVAYFYGEGVPQDYRQAVYWLNEGIPGSYTPGHIPLSALYDKAHPADRVHSQTWYRKTAQRVMAKVQYNFGVWYYNGYHLLKDHNLALEWYRRAAAQGLAEAQDAIGVMFMQGEGVSQDYQQALAWYRKAARQGLPAAQTHLGIMSAFGRDVAQSDRQAIAWYRKAAKQDFAKAQYQLGVAYSTGRGVPENSRNALKWYLKAAEQGFTPAQSALGEIYAHGRQGVPKDNKQAYIWYYMASMYTEKSKDDCSALIAERNRLKGTLTPDQLSETYAAFNLIWRKIDQSKEAKKIARKKY

SEQ ID NO: 53041 - DNA, 666 bp, Azoarcus sp. EbN1
  CDS (1)..(666): transl_table=11
atgcatcgaccgctatgccgggcactgttctgcatcacgctgacgttcgggtgcgcgcaggcggtggcggacattccggcagcggccctcgtgcagaacgcgatcggcgcctacgaggcggggcgccacgacgaagcggcgcggctgttcgaacgcgccgcgcgcgccggcaaccggctcgcccagttcaattacgcaatgatgctgtatcgcaacgaagcgcagtcgcacgacgcgaacgccgcgtggcgctggctgcgacgggctgcgggggccggtctgccacaggcgcagttcacgctggcgcgatcgtacgaacgtggcgacggcgtcccgaagtcgctgtcgaccgcggcggagtggtatcggcgcgctgccgcgcaggggcacgtcgaggcgcaggtgagcctcgcgtcgatgtatttcgtcggaggcggcgtcccgctcgatgctgcggctggggcacgctggtatcttgccgctgcgcgcgccggtcacgtcggcgcgcaacacatcatcgcgggcctgtacgagaccggcaacggcgttgccgcggatcggcgactggcggcgcactggtacctgcaggcggcccagcagggtgacacgctcgcgcgggagaagcatgctgcactgatgtcgcagatcgaggcccccacgccttga

SEQ ID NO: 53042 - protein, 221 aa, Azoarcus sp. EbN1
MHRPLCRALFCITLTFGCAQAVADIPAAALVQNAIGAYEAGRHDEAARLFERAARAGNRLAQFNYAMMLYRNEAQSHDANAAWRWLRRAAGAGLPQAQFTLARSYERGDGVPKSLSTAAEWYRRAAAQGHVEAQVSLASMYFVGGGVPLDAAAGARWYLAAARAGHVGAQHIIAGLYETGNGVAADRRLAAHWYLQAAQQGDTLAREKHAALMSQIEAPTP

SEQ ID NO: 53043 - DNA, 948 bp, Zymomonas mobilis subsp. mobilis ZM4
  CDS (1)..(948): transl_table=11
atgaagaaaattttatcttttaccaccgttcttttcccttttattttgagtgcagcgcaagcgcagcctgccgcgcaggccaaaagccaatcgataacggtaagattgcagagcgactatacgcctgctttgcaaaaagcggccgatcaaggcaatgctgatgccgaggcaaaagtgggttttggctattttagaggcaaaactttgccccatgattatgccaaaggcattttctggctgcaaaaagcggctgaccaaggacattctgatgccgagacccttttgggcaatgcctatcagcaaggcgtgggtctgcctaaaaatcaggaaaaggctatcttctggtatcaaaaggctgccgatcaggggaatttggatgctcaaaccttattaggtgccgcctatcatatggggcagggcgttcccaaaaatgaccaaaaggctattttttggttacaaaaagcagcggatcaggctttccctcaagctcaaaatttcttgggtgaagtttatgaaacgggcgatcctgctgtcagaaatattgaaaaagccatttcttggtatcagagggcagccgaaggaaattcggtcacggcgcaagcccatttgggtatggcctatcacgaaggcacaaaactgccgaaaaactacgagaaatcgactttttggtttaaaaaagccgctcttcaaggcgatgatcaggggcagttcttttatggcttagcctgcctgaaaggcgagggcgttgccaaaaatccgagagaggctgtctcttggtttcagaaagcggccgatcaaggcaatctccaagcgacgacccgtttaggcttggcttatgccagtggagagggtgtgcctgccagcaaagaaaaagcggttttctggttgagaaaagcggctggacagggtgaacctaatgcccagagaatattatcaatgatgcgctag

SEQ ID NO: 53044 - protein, 315 aa, Zymomonas mobilis subsp. mobilis ZM4
MKKILSFTTVLFPFILSAAQAQPAAQAKSQSITVRLQSDYTPALQKAADQGNADAEAKVGFGYFRGKTLPHDYAKGIFWLQKAADQGHSDAETLLGNAYQQGVGLPKNQEKAIFWYQKAADQGNLDAQTLLGAAYHMGQGVPKNDQKAIFWLQKAADQAFPQAQNFLGEVYETGDPAVRNIEKAISWYQRAAEGNSVTAQAHLGMAYHEGTKLPKNYEKSTFWFKKAALQGDDQGQFFYGLACLKGEGVAKNPREAVSWFQKAADQGNLQATTRLGLAYASGEGVPASKEKAVFWLRKAAGQGEPNAQRILSMMR

SEQ ID NO: 53045 - DNA, 1899 bp, Zymomonas mobilis subsp. mobilis ZM4
  CDS (1)..(1899): transl_table=11
atgaagcgctccctttcctatgcctcttttttgagaagatcgctcgcgatactgccttttcttctgccctgctcttcaaaaacgcatgctctaaccactatgcaaagataccagatagaggatattaaacgcatagcatcacggggagatcataaggtagaatatatcttggggactttctattctaaaggcgatgttgaaggtattccgaaagattttcatttagctctacattggtatcaagaggccgctaaagacggagataaagaagcggcccaaatgatcggcctcctttactataatggtgacggtgtcccaatagatatcgcgaaagcagcctactggtttgaaaaagcggcgaatgctggcaattgggacgcggccagacgtttggcaacactctatatcaatggagaaggtgttcctaaaaatgtcgaaaaaggcatttcgtggtataagaaagcgatccaatcaggggatattgattctgcccgtcgcctaggcatgctttattggatgggcgatgatgtgccccgcgatcaagaaaaggcactccattggctcgaaaattcagccaataacggggattgggatgcctcacaaatgctttcccgattttatattttgggagaaaatatacccttcgacaaagaaaaaggactctattggctcgaaaaatcagcaaaacagggaggtgtcatttcgcaagaaatattagcaaatctctattattcgggtcagatgcttcctcttgataaaaaaaaggcggcctactggtatgagcaagcggccaaagagcataacggctcagcagcaaaaatgctgggggctatttattacaatggtgaagatgtcaaacaaaataaggaattaggccgctattggatagaacaggccgcaaaatggggagagcccgaagcccaaagaattaccagcatgttttatcaggaatcggatacgttagaggataaggaaaaagccgaattttggcttaaaacggcagctctggcaggcgataaagaagctcaaaaacaagtaagcattctctacacgaataaagacccgaaaatttcagaaatacatccacagattataaagcttctccgcgaaaaggctgaaaaaggcgataaagaagcccaatatgatttcgctttgaaatattatgaaggcaaagaaatctctcaagatttcaaacaagcggtctattggtttcaaaaagcagcggatcaaggcgatcctagtgctactctcaatttaggcgcgctttattatgatggaaagctaggaaaaacagatttttcgaaagcggcgactctttttcaaaaaacggctgaccaaaactatcccaaagcccagctctttctagggattctctatgaaagaggtgaaggcgttcctcaagacacccaaaaagccctttctttatacaaacaggccgctaacctaggggaagctgaagcacaattcattctcggttatcactatggcacaggaaaaattgtgccactcaatttaaaaaaggcagcctcttggtataccaaagccgctcatacaggtagcttacgcggtcaaatcaatttaggcattgcctatatgctcggagcaggggttcctaaaaatattctggtagctatttactggttacaacaggcagcaaaatcagacgacatcaaagccgaaatcaatcttggcaagatttacgccgacccaaaaaatcaagaaattttcgcactggatacagcgaaagactggttcaaaaaagccgccgatcaaggttcggaagacgctaaaaactatcttgccagccttacccctgtagaagctccaaatgggacactctcaaaaacggaaattctgccacagatcaccgaagagagtcaggcaaagccagaatcctaa

SEQ ID NO: 53046 - protein, 632 aa, Zymomonas mobilis subsp. mobilis ZM4
MKRSLSYASFLRRSLAILPFLLPCSSKTHALTTMQRYQIEDIKRIASRGDHKVEYILGTFYSKGDVEGIPKDFHLALHWYQEAAKDGDKEAAQMIGLLYYNGDGVPIDIAKAAYWFEKAANAGNWDAARRLATLYINGEGVPKNVEKGISWYKKAIQSGDIDSARRLGMLYWMGDDVPRDQEKALHWLENSANNGDWDASQMLSRFYILGENIPFDKEKGLYWLEKSAKQGGVISQEILANLYYSGQMLPLDKKKAAYWYEQAAKEHNGSAAKMLGAIYYNGEDVKQNKELGRYWIEQAAKWGEPEAQRITSMFYQESDTLEDKEKAEFWLKTAALAGDKEAQKQVSILYTNKDPKISEIHPQIIKLLREKAEKGDKEAQYDFALKYYEGKEISQDFKQAVYWFQKAADQGDPSATLNLGALYYDGKLGKTDFSKAATLFQKTADQNYPKAQLFLGILYERGEGVPQDTQKALSLYKQAANLGEAEAQFILGYHYGTGKIVPLNLKKAASWYTKAAHTGSLRGQINLGIAYMLGAGVPKNILVAIYWLQQAAKSDDIKAEINLGKIYADPKNQEIFALDTAKDWFKKAADQGSEDAKNYLASLTPVEAPNGTLSKTEILPQITEESQAKPES

SEQ ID NO: 53047 - DNA, 1758 bp, Zymomonas mobilis subsp. mobilis ZM4
  CDS (1)..(1758): transl_table=11
atgaaagccgctggttcttggatgatgaagctctcgatgattttgtctgcgccgctggtgataaccccgctttgggcagaggcaaacccgcctgcggttatgacagctcctcaagcctttacgcaggcaatacataatttgaaaagtcagaataaggacgatcaagcccgcggttttatgaaaatgcagcaagctgtttctggtggcaatccaaaggcagaatataatttgggggctttatatcatgaaggcttgggaacaacgcagaattttgttcaggcgcgttactggatagagaaatcggcggaacaaggctatcctgcggccgaagccttgctaggaaatatctatcatttcggaagaaagggtatccctgaagatcttgaaaaggctttttactggacagaaaaagccgccaatcacggcgtgacctcggcgcaaagagatttagctttaatctactatcaacaagccttagcgcataaaatatcaccctcagaagggcagcaaaaagccctttattggatggaaaaggccgctgatcggggtgatttagaggctaaattccaaatggccaatgtctatttgtctggtatcccgaatttgccacaatatgcagcggataacaaaaaggccttttctttatgtaaggatgcggccgagaaggggaatctaaaagcggccgctcttttgggaaaaatatattatagcggcgatagcggcaaggtggatcaaaaagctagcttttattggacagaaaaagccgctcgtctgggtgatcctttcgcagaatataatatggctcgtttttataacccccaaaatggcagtaaaagggtcgatccagacactgctttttactggatggagaagtcagccaatcagggtttccatcctgcggagagtgcattagggcgcttttatcgtgacggtcagggcacaggaaaagacctccaaaaagccgttttctggtataatcgagcggccgaaggaggcaatattcaagggcagattgatctggctatggcctattatcatggtgatgccactgaaaaagacagcaaaaaggctttttattggtgtgaaaaagcggccaatcagggttctgaagaggctgaagagcaattggctgagatgtatcatcagggtgaaggcacccagaaagatgacgataaagcggccgaatattaccaaaaggcatgggcaaaacatcattttgacaatccagcgactgtgatgggtgacctttattttgaaggccagaaaatagaccggaattatccgaaagccttggcatggtatcagaaagcggctgcccaaaatgatagtcgcgccgaaaatgctatcgggaatatctattatagtggcttggcagtgccgcaggatttcaaacaggctctggtttggtatcgcaaggcaacggctgatttttatcatacccaagcctatgatgctgaaatgaaattgggcgatatgtattccaaggggcaggttgtcccgcaggatcttaagcaagccttttcatggtatgaaagatcggcacgccatcattacaaacccgccgagattaaattatcaaccctttatgaaaaagggatcggggttgagaaaaacaaagaacaggccgtttattggcatcgtaaggcctttgataaagcctttgccgagatagacgacaggctggacgatcatgcccaaggcatggcgatgctctatcaggccgctgaagacgccaagaaagacgcggtttctgattaa

SEQ ID NO: 53048 - protein, 585 aa, Zymomonas mobilis subsp. mobilis ZM4
MKAAGSWMMKLSMILSAPLVITPLWAEANPPAVMTAPQAFTQAIHNLKSQNKDDQARGFMKMQQAVSGGNPKAEYNLGALYHEGLGTTQNFVQARYWIEKSAEQGYPAAEALLGNIYHFGRKGIPEDLEKAFYWTEKAANHGVTSAQRDLALIYYQQALAHKISPSEGQQKALYWMEKAADRGDLEAKFQMANVYLSGIPNLPQYAADNKKAFSLCKDAAEKGNLKAAALLGKIYYSGDSGKVDQKASFYWTEKAARLGDPFAEYNMARFYNPQNGSKRVDPDTAFYWMEKSANQGFHPAESALGRFYRDGQGTGKDLQKAVFWYNRAAEGGNIQGQIDLAMAYYHGDATEKDSKKAFYWCEKAANQGSEEAEEQLAEMYHQGEGTQKDDDKAAEYYQKAWAKHHFDNPATVMGDLYFEGQKIDRNYPKALAWYQKAAAQNDSRAENAIGNIYYSGLAVPQDFKQALVWYRKATADFYHTQAYDAEMKLGDMYSKGQVVPQDLKQAFSWYERSARHHYKPAEIKLSTLYEKGIGVEKNKEQAVYWHRKAFDKAFAEIDDRLDDHAQGMAMLYQAAEDAKKDAVSD

SEQ ID NO: 53049 - DNA, 1128 bp, Zymomonas mobilis subsp. mobilis ZM4
  CDS (1)..(1128): transl_table=11
gtgatactgacgacaagaagcttgttttttcagaaaaatatctggttgccattattggtggctttaacgccggtgacatctttcccgctttatgcagcggtgaaaacggcagatgtcaaaaaggcaaatgacaattttgaatctggtcttcgctattatcacggacataatgttgcccagagctacagccaagccagagagtattttcagaaggctgcggatctcggtcatgccgaagcccaattttatttgggggcattgtatgagcggggaaagggcgtggctagaaattataaaaccgctttttcatggtatcagaaagccgccgatcagggttttgtgaaggctgaaaacaatgtgggcagcatgtatcaatatggtgtcggcgttccccagaattttcaggccgctttgacttggttacagcgtgcggcagggcaaggcgacaaagttgcccaaaccaatttgggcgatatgtattatcaaggccttggcaccccccaagagtataaaacagccgctatctggtatcaaaaggcggctgcccaaggctatgctttggctgaatataatttgggcgtgatgtatagtcaggggcagggcgtaacccaagatatggcgactgctgcgacttggtatcagaaggccgccgatcagaaatttccggctgccgaatataatatcgcctatctttatgaaaaaggccaaggcgttgttcaggatcagaaggtcgctttggcttggtatcagaaggccgccgatcaaggctttgtgaaagcgcagttgaatttggcaagcctcctttaccatcaggccaaaggcaaatcccagaattataaagaggccgccctctggtatcagaaagcggcagcgcagggtgatgtcgttgccttgtttatgttgggtaaaatggcgcatttgggcgagggggctgctcgaaatgatgtggatgcctatatgtggttcagtctggcagccggtctgggtctgaaaaatgccgaaaataattgtcaggttttaagtaaaatgatgacccctgcccagattgccgaggccaaaaaagaggcacaatcttggttggataagcatcctagctttccggtgaaaaaactgaattcggcgggatag

SEQ ID NO: 53050 - protein, 375 aa, Zymomonas mobilis subsp. mobilis ZM4
MILTTRSLFFQKNIWLPLLVALTPVTSFPLYAAVKTADVKKANDNFESGLRYYHGHNVAQSYSQAREYFQKAADLGHAEAQFYLGALYERGKGVARNYKTAFSWYQKAADQGFVKAENNVGSMYQYGVGVPQNFQAALTWLQRAAGQGDKVAQTNLGDMYYQGLGTPQEYKTAAIWYQKAAAQGYALAEYNLGVMYSQGQGVTQDMATAATWYQKAADQKFPAAEYNIAYLYEKGQGVVQDQKVALAWYQKAADQGFVKAQLNLASLLYHQAKGKSQNYKEAALWYQKAAAQGDVVALFMLGKMAHLGEGAARNDVDAYMWFSLAAGLGLKNAENNCQVLSKMMTPAQIAEAKKEAQSWLDKHPSFPVKKLNSAG

SEQ ID NO: 53051 - DNA, 741 bp, Zymomonas mobilis subsp. mobilis ZM4
  CDS (1)..(741): transl_table=11
atgacccgtgatggtttgaaatcgccgcttcaaaaagcggctgaacgaggagatgccaaagcgcaatatgctttgggtaatgcctattccaaaggccaagatgtttccaaaagtgacgaacaagctgtctcttggtatcagaaatctgccagccaaggctatgcaccggctcaggcagccttgggatatgcttattcctctggattgggtgtgacccatgatgatcaacaggcggtttctttttttcaaaaagcggccaatcagggtttggctgaggctcaatatagtttggctatcgcctattatactgggcgcggtgtgacgcagaattatgagcaggcttctttctggtttcagcgttctgccaatcaaggctttgttcctgcccaattttatcttggtgttatgtatcggaatggagcgggcataccagaggatgatgaccgcgctttattctggtttcataaggccgccgataaaggctatgccgatgcccaatataatttggggctgatttatcacgagggcaaagtcgtcaaaaaagacgagaaacaggcgaccttctggtatcagcaagccgctaatcagggacttgtcgaggctgaattcaatttgggtatcgcctatttgaaaggccaaggggtgcagaaagataaggataaagcgactttctggctcgaaaaagcggcagataaaggcgacagccatgcccaagatgtattggaaatgatgaataaatag

SEQ ID NO: 53052 - protein, 246 aa, Zymomonas mobilis subsp. mobilis ZM4
MTRDGLKSPLQKAAERGDAKAQYALGNAYSKGQDVSKSDEQAVSWYQKSASQGYAPAQAALGYAYSSGLGVTHDDQQAVSFFQKAANQGLAEAQYSLAIAYYTGRGVTQNYEQASFWFQRSANQGFVPAQFYLGVMYRNGAGIPEDDDRALFWFHKAADKGYADAQYNLGLIYHEGKVVKKDEKQATFWYQQAANQGLVEAEFNLGIAYLKGQGVQKDKDKATFWLEKAADKGDSHAQDVLEMMNK

SEQ ID NO: 53053 - DNA, 501 bp, Zymomonas mobilis subsp. mobilis ZM4
  CDS (1)..(501): transl_table=11
atgaagaaaagaattattctgttagggctgcttttgtctatcggcggccagattgtttattcgcaggtgcgtaaaacgccgtccattttttcccaaaaaaaactgcatgaattaaaactggctgccgatcagggcgatgccgaggcagaagctgccttgggagaggcctttgattttggaaaaataacgccgcaggactaccaaaaggcttttttctggtatcaaaaagcggccgatcaatctgtcgctgaggcccaatataatttaggcgggctttattataagggggcaggaaggcctaaagatggggagaaagctgtctattggtaccgaaaggcggcggatcaaggctatatagacgcgcaacggaatttagctcttttatatgctaaaggggagctggtgccccagagcgatgagcaggccgtttattggtatcaaaaagccgctgaccaaggggatgctgaagcgcaaaagttactggcaatgttggcgcgataa

SEQ ID NO: 53054 - protein, 166 aa, Zymomonas mobilis subsp. mobilis ZM4
MKKRIILLGLLLSIGGQIVYSQVRKTPSIFSQKKLHELKLAADQGDAEAEAALGEAFDFGKITPQDYQKAFFWYQKAADQSVAEAQYNLGGLYYKGAGRPKDGEKAVYWYRKAADQGYIDAQRNLALLYAKGELVPQSDEQAVYWYQKAADQGDAEAQKLLAMLAR

SEQ ID NO: 53055 - DNA, 651 bp, Zymomonas mobilis subsp. mobilis ZM4
  CDS (1)..(651): transl_table=11
atgcaagcggataaggaacgctatgaccgtgagatgatctcttctttggaagtgcgggcgaaggccggtaacagtttggcagaagaggttctgggcgaggcttatgcgcatggcagagggcggccgcaggatgatgaaaaggctgtttactggtatcagaaggcggccgataaaggcatgaaggaatcccagtataatttgggggatgcctatcttcatgggcgaggtgtcggggtagattatgaaaaagccgccttttggtatcggaaagcggctgatcagaattttatacaagcgcaatataatctcgggcttttatacgtcaaaggccaaggtctgccaaaaagtgatgaacatgcagccttttggtggcagaaggccgctgaacaaggtgaggctaaggctcaatttaatctcggtgttttttatcataatgggcgggctgtgccgaaaaatgacgcacgggctatcttctggatggagcaggccgcgcatcagggcttggtagaggctcaaatgttattagctatggcttatgccagtggtcagggcgcgccaaaggataaggaaaaggcagtctattggtatcagaaggctgcggatcagggaaatgcagcggcgcaaaaggccttacaagcattgtcttattag

SEQ ID NO: 53056 - protein, 216 aa, Zymomonas mobilis subsp. mobilis ZM4
MQADKERYDREMISSLEVRAKAGNSLAEEVLGEAYAHGRGRPQDDEKAVYWYQKAADKGMKESQYNLGDAYLHGRGVGVDYEKAAFWYRKAADQNFIQAQYNLGLLYVKGQGLPKSDEHAAFWWQKAAEQGEAKAQFNLGVFYHNGRAVPKNDARAIFWMEQAAHQGLVEAQMLLAMAYASGQGAPKDKEKAVYWYQKAADQGNAAAQKALQALSY

SEQ ID NO: 53057 - DNA, 717 bp, Zymomonas mobilis subsp. mobilis ZM4
  CDS (1)..(717): transl_table=11
atgaaaataatattatggatagtggcgctttcctttttggctgttcgccctgttcttgcaggaaatgacaggacggttaggctgctatccgatggttattcaatagtcgagattcagaaaaacgccaatgctggcgatagccaagctcaattttctttgggctatgcttatgcctttggaaaaaatctgccgcaggattatgaaaaagccgccttttggtatcggaaggcggccgaacagggctttgcacctgctcaatgtcaaatagctgtggcttatgtttctggcgcaggcgtatcccagaattataagcgggctgctttctggtttgataagtccgcccgtcaaggtgatagttcggcgcaatattatctaggtcttttatatacgcaaggtatcggcgtgccgcaaaatgacgaaaccgctgtattttggttacaaaaagctgctcatcaaaaatatcgagccgctgaatatgatttaggtaatgcctattacgatggaaaaggtgttcttagaaacggtgaaaaggcgatgttttggtggcagaaatcggctgatcaaggtttcgccgcggctcaatttagattggggcgtgcttattattggggcgacgttgttgcacaagatcaaaaggtcgctcaggcatggattaagcgggctgctgatcaaggctatgtggcagcgatagtctggcttcaaaacgcgcaacattaa

SEQ ID NO: 53058 - protein, 238 aa, Zymomonas mobilis subsp. mobilis ZM4
MKIILWIVALSFLAVRPVLAGNDRTVRLLSDGYSIVEIQKNANAGDSQAQFSLGYAYAFGKNLPQDYEKAAFWYRKAAEQGFAPAQCQIAVAYVSGAGVSQNYKRAAFWFDKSARQGDSSAQYYLGLLYTQGIGVPQNDETAVFWLQKAAHQKYRAAEYDLGNAYYDGKGVLRNGEKAMFWWQKSADQGFAAAQFRLGRAYYWGDVVAQDQKVAQAWIKRAADQGYVAAIVWLQNAQH

SEQ ID NO: 53059 - DNA, 1257 bp, Zymomonas mobilis subsp. mobilis ZM4
  CDS (1)..(1257): transl_table=11
atgaaaagaatattattgttaggggtattttttcctttgtttgtagagcctgttcaggcggcgaaggtagcgcagacgggtcatctgtcccgtggcaatgctatcatcgagcttcaggaaaaggccgaaacgggtgatgccgatgctcaatatgctttaggtggtgcgtattatcaaggtaagggtgttcagcgagattatgagaaggcggcgttttggtatcaaaaggcagccgatcaaggaaaggctgaggctcaatatgatttaggtagtgcgtattatcaagggaagggtgttccgcagggttatgagaaggcggcgctttggtggcagaaggcggctggtcaaggaaataccgctgctcaatatgttttaggtagtgcgtattatcaagggaagggtattccgcgagattatgagaaggcggcgctttggtggcagaaggctgctggtcaaggagatgccgctgctcaatatgatttaggtaatgcgtattatcaaggtgcgggtgttccgcgagattatgcgaaagcgttatcttggtatcagaaggctgctgatcaaggacatgccgctgctcaatatgatttaggtagtgcgtattatcaaggtgcgggtgttccgcagggttatgagaaagcggtgttttggtggcagaaggctgctgatcaagggtatgccgctgctcaatttaatttaggtaatgcgtattatcaaggtgcgggtgttcctcaggattatgcgaaggccgtgttttggtatcagaaagcggcagatcaagggtatgccgatgctcaatttaatttaggtgatgcttatcatgatgaagagggtgttcctcaggattatgcgaaagcggtgttttggtatcaaaaagcggctgatcaaggagacgccgctgctcaaaataatttaggggtggcgtatgctcgcggggcgggtgttcctcaggatcgtgcgaaagcggtgttttggtatcagaaggcggctgatcaaggcgatgccaatgctcaatatgctttaggtaatgcgtattatcaaggtgcgggtgttccgcagagtcatgaaaaggcggtgttttggtggcagaaggcggctgatcaaggctttgtcgctgctgaatataatttaggtgtagcgtatctgaaaggtcaaggtatcgcgcaagataaggggcgtgggcaattctggcttcagaaagccgctgataaagatgatgaagcggctaaagaggctttacaaaaattgtctcattag

SEQ ID NO: 53060 - protein, 418 aa, Zymomonas mobilis subsp. mobilis ZM4
MKRILLLGVFFPLFVEPVQAAKVAQTGHLSRGNAIIELQEKAETGDADAQYALGGAYYQGKGVQRDYEKAAFWYQKAADQGKAEAQYDLGSAYYQGKGVPQGYEKAALWWQKAAGQGNTAAQYVLGSAYYQGKGIPRDYEKAALWWQKAAGQGDAAAQYDLGNAYYQGAGVPRDYAKALSWYQKAADQGHAAAQYDLGSAYYQGAGVPQGYEKAVFWWQKAADQGYAAAQFNLGNAYYQGAGVPQDYAKAVFWYQKAADQGYADAQFNLGDAYHDEEGVPQDYAKAVFWYQKAADQGDAAAQNNLGVAYARGAGVPQDRAKAVFWYQKAADQGDANAQYALGNAYYQGAGVPQSHEKAVFWWQKAADQGFVAAEYNLGVAYLKGQGIAQDKGRGQFWLQKAADKDDEAAKEALQKLSH

SEQ ID NO: 53061 - DNA, 1011 bp, Zymomonas mobilis subsp. mobilis ZM4
  CDS (1)..(1011): transl_table=11
gtgaaaaaaacaggatggaaagcggcgatcattttggccgcgattgcgctgggtgctttgcttttttggggtgccttcaagctgaataggccaacagccaaaacgccacaggaagaattaaagctcgcgctgaaatatgcgcatggcgatagctcgaatattgataaaagcaaggctttgaccctgatccagcaagccgccaataaaggctttgctccggctgaatatgcgcttggcactttttactataaaggcgaagcggtcgcggcggataaatccaaagccctctattggtatcaacaggcggttacgcatggggatgccgatgccgcccttgctttgggtaatatgtattataatggcgacagtattgcgcccgacaaatccaaatctgttgacctttatcaacaggcggccaatcagggcaatgcccaagcgcagttaaatcttggcctgatgttttctcgtggggatgccgtttctctcgataaaaccaaagcactttactggtatcagcaagccgctgataaaggtaatccacaggctgaacttattcttggtaatatgtattataatggggaaactgtcccgcttgataaaaccaaagcttttgaatggtatcaaaaggcagccaaccaaggcaatgctgcggcagaattaaatcttggtctgatgtatgcgcatggcgatggcgtgccgctcgataagaataaaagcctttcttggtatcagaaagccgctgaacaaggcgatgcccaagccgaatacagccttggtaatatgtattataatggtgacggcgttgccgttgataaagccaaagcgctttcttggtatcaacaagcggccaatcatggcctcgctcaagctgaacttgctcttggcattatgttctataatggcgaaggcgttactgttgataaaaacaacgccgcttattggctgaaacaagccgctaatcatgggaatgatacagcaaaataccaactgaaattatggtttaattcttag

SEQ ID NO: 53062 - protein, 336 aa, Zymomonas mobilis subsp. mobilis ZM4
MKKTGWKAAIILAAIALGALLFWGAFKLNRPTAKTPQEELKLALKYAHGDSSNIDKSKALTLIQQAANKGFAPAEYALGTFYYKGEAVAADKSKALYWYQQAVTHGDADAALALGNMYYNGDSIAPDKSKSVDLYQQAANQGNAQAQLNLGLMFSRGDAVSLDKTKALYWYQQAADKGNPQAELILGNMYYNGETVPLDKTKAFEWYQKAANQGNAAAELNLGLMYAHGDGVPLDKNKSLSWYQKAAEQGDAQAEYSLGNMYYNGDGVAVDKAKALSWYQQAANHGLAQAELALGIMFYNGEGVTVDKNNAAYWLKQAANHGNDTAKYQLKLWFNS

SEQ ID NO: 53063 - DNA, 1773 bp, Gluconobacter oxydans 621H
  CDS (1)..(1773): transl_table=11
atgtcgttcaaacgtcgcctttccgctcttctttcctcccggggcaagctggaatatgcgatccatctcacggaaaccggtcaggctgttcaggggttcgcgcttctcagccgcatcgccgccacaggagacgcggaggccgcgttccgggtcgggcgcgcctatctggacgggcttggggttccacccagtctcgaagatggcgcccggtggatctatcaggccgccgaggcagggcatattgaagcggccttcgtgctggccacgctttatacagtgggcctgcccgaaggatttgaaatccgcacggccagcgaggggctggatctctcgcatgtgccgcaggcaggcccaagacatccggatttccatcttggtctgcgctgggccaaaatcgctgcggatgccggttccccggatgcacaggcccttctgggatatatcctgaccaatggaccggaagacctgcgcgatctgacgcaggcccggtcctggtacgaccgttccgcggccgcagggtgttcgcagggccatcttggtgtggcgctttccattctccatgaggcccattcagacgaggacctgtctgccgccgccaggcatctgaccgcagcgacgaaaggcggtctcggcacggctttcgatattctgggcaggatgtacgagtcaggctcgggtgtgccccgggatctcggaaaggctgccagttatttccatcaggcggcggaacgcaacatcgtaacggcccaggcgcgctatgggctgatgctgctggaaggaacgggcacgccccggcattacggccgggctgaaacctggctgaagcgcgccgcagcgaatggcgatacgcagtccgccgccctgcttggtgatctgtgtgccaatggcggcgatctgcctcccaatcttgtggaatccgccaaatggtaccgtctggcggccgagcagaaacatgccggcgccgcacgggccctcgggctgctctatctgacaggaaatggtgtccatcaggaccccgatgtcgcggcgcactggttcaaggtcgcgtcggaagcgggagacgcccatgcggatgcggatttcgggaacctgattctcgccggagcgtccgcaacccctgatgaaaaacaggccctgcatgcccgtttcgaaaaagccgccgaaaaaggcgatctggtcggggcctataatctgggtgtgtgctttgccgaaggcgtgactggcacgaaggacgggcgtgaagcggcccgctggatgcagaaagccgccgatggtgtcgtcaacgcgcagtactggtatggcaggatgctgctagaaggacggggcgtgcagcccgatcccacacaggcgctctactggatggaaaaggccgccgatgcgggcatggccgaggcacaggtcactgtggcggggctgctcgtggacgggagcatcaacggccgtcaggatcatgaaaaagccctgacgctgtaccggaaggccgccgagagcggcaacgtggacgccatgttctcgctggccgcgatgtatggcggcggccatgacgtccccgagaaccgcccgcaggcgcagctgtggttccgcaaggccgcccagcgaggaaacggcctcgcccagatgatgcttggtcgttatctcgtgcgcggactggccggtgtgacggacccggtggaaggtcgcatctggctggagcgggcaaaagcgcagaatatcagggacgctgaagcggaactcgcccttctggacgaagcgcagccggacggcgatgactga

SEQ ID NO: 53064 - protein, 590 aa, Gluconobacter oxydans 621H
MSFKRRLSALLSSRGKLEYAIHLTETGQAVQGFALLSRIAATGDAEAAFRVGRAYLDGLGVPPSLEDGARWIYQAAEAGHIEAAFVLATLYTVGLPEGFEIRTASEGLDLSHVPQAGPRHPDFHLGLRWAKIAADAGSPDAQALLGYILTNGPEDLRDLTQARSWYDRSAAAGCSQGHLGVALSILHEAHSDEDLSAAARHLTAATKGGLGTAFDILGRMYESGSGVPRDLGKAASYFHQAAERNIVTAQARYGLMLLEGTGTPRHYGRAETWLKRAAANGDTQSAALLGDLCANGGDLPPNLVESAKWYRLAAEQKHAGAARALGLLYLTGNGVHQDPDVAAHWFKVASEAGDAHADADFGNLILAGASATPDEKQALHARFEKAAEKGDLVGAYNLGVCFAEGVTGTKDGREAARWMQKAADGVVNAQYWYGRMLLEGRGVQPDPTQALYWMEKAADAGMAEAQVTVAGLLVDGSINGRQDHEKALTLYRKAAESGNVDAMFSLAAMYGGGHDVPENRPQAQLWFRKAAQRGNGLAQMMLGRYLVRGLAGVTDPVEGRIWLERAKAQNIRDAEAELALLDEAQPDGDD

SEQ ID NO: 53065 - DNA, 696 bp, Vibrio fischeri ES114
  CDS (1)..(696): transl_table=11
atgaaaatacttttaaaatcgttagttatatctgcttcattatgctcaccttttgttctagctaacagtgaagctcatagtgattatctaaaaggcacggcttatttaaatcaagataactataaagaagcaattacttggttaaccagtgctgctaataatggttctattgaagcacaaaacaaaattggaactatttatgcgaaagggatcggtactgaagcaaacacacaacttgctacccagtattttttgaaagccgcagcaaaccaaagttctatggcttactataaccttggtaaaatctacgaatcagaagaaaaatattcaacatctattgattggtataacaaagcaattgaagaaaataacagtaatgcaatgaataaccttgctgacttatatcttcatggcaaagggcttgttcaaaatactcaccaagcagaattactttatattcaagctgctgaattaggtaatgctacagcgatgcgtaatcttggtttcttatacactaacaataaagaagttaaacaagacatgagcaaagcgtatttttggtttaaccttgctgctgaaaaagacttcccagatgcagataagtaccgtgactatacagggaaaaagctaagtaaaagtaaacgcattaaagttcaaaatgaagcacttgaatggttagaacagcataatagttaa

SEQ ID NO: 53066 - protein, 231 aa, Vibrio fischeri ES114
MKILLKSLVISASLCSPFVLANSEAHSDYLKGTAYLNQDNYKEAITWLTSAANNGSIEAQNKIGTIYAKGIGTEANTQLATQYFLKAAANQSSMAYYNLGKIYESEEKYSTSIDWYNKAIEENNSNAMNNLADLYLHGKGLVQNTHQAELLYIQAAELGNATAMRNLGFLYTNNKEVKQDMSKAYFWFNLAAEKDFPDADKYRDYTGKKLSKSKRIKVQNEALEWLEQHNS

SEQ ID NO: 53067 - DNA, 2499 bp, Bacteroides fragilis NCTC 9343
  CDS (1)..(2499): transl_table=11
atggaaactttaaaagagaaattcgaagccctggcccatcgtatccaatcatccggaaaaccggctgccgcatggttccctcaatttacacctgtcactttgttgaacgccgaaaattggtgggaagcacttgctgtgtgcgaatatgccttggacacccatgaggacgaagcactgacagccggattttttgaattaatattcagtgcatacgattgtaacgtagaagtggatcttaatgaggaagagtatgcctactggtgggagaaagtgatcagtgtatgcgatcgtgtggctgtattcaacggtgccgggtggtcacagaaaggtgcacaatattcggaagcccgttatgggaaacgtgatctcagcctgttattcccttgctatgaaaaagcggcggaaatgggaagcccggaagcagaggcaaccgttgcttattggcgttatatgggtttctactgcgaacaggatagggcagaaggagagcgtcgatttgcagctttatcctcacccgaagctttgctatggggaaaatattaccgggcttatgccgagcagcacaccggcagtaaagagaaagccctgcttatgcgaaaagagttgcttgacgaacttcccgaaggccatcgcctgcgtgcccatgtatatgccgcgatgggcgacgcacttgatatagaagaaggaagtgtggctgaagaagcggcatgctatgagaagtcgctggaacttgttcctaatctatattctttaaaaaatctggcaactctctatttccgctatccggaactagggaagcaaaaagagctggcgtttgagttgtgggagaaagcctggcatgcaggtgtatggtctgcagctaatttccttggatataactatcaggaagaagagtggctcgatatgcctaaagccattgaatggctggagaaagggatgctttattgtgaatcatattgtgcctatgaattagcattgatctatctttataatgatgagtataagaatgtggaacgtgggttgatgtgcctgcagcgctgtgtcgacgacaattatgtagaagctatcgagacgcttgccaatgtttatttcaacggtgaattggtggaagagaatatctcgtatgcctgtcagttgttggagagagctatcgagctggggtccggtagtgcagcctatcgtatcggctggatgtatgagcgtggattgctttctgaagaaccggattatcagaaggctatggagtattatgaaaaagctgtgtctatggacagtgctgacgggtatgcacgggcggctctttatttggctaatggttattccggagttacggatgccgggaagtcaaaggcctattatgaaaaagcggcagagctgggttcatgttttgcaatggtagaattggcattcttatacgaaaatggtgaggtggtagaacaaagttatgagaaagctttcgacttgctccaaaaagctgccggacaggagtatccttatgcgatgtatcgtgtaggactttatttggataggggagtcatcggtgagccacggcccgaagaagcgtttgcatggtatgcaaaggcagccgaacggggagatggagatgcgatcttcgctcttgggcgttgctataagaatggaattggtacggaagagaatccggataaggctcttgaatggtttactaagggtgcagagaataacgaaccccgttgtcttacagaaatggggttggcttatgaatacggtagtgggatagaagagaatcctcatcaagctgttgaatatatgacaaaggctgccgaacaaaattatggttatgcccaatttaaaatgggagactactttttctttggttacggtgcctgtcccgaagataacaaacaagctgtggaatggtacgagaaggctgttgcaaatgatatacctttggctatgttgcgtatgggtgaatattacctttacgattatgacaaactgaatgagtcggagaaagctttcagctacttcaagaaagcggctgaagcagaatgttataatgaagggctgggaatctgctacgagatgggtatcggtgtggaagacaatgaaacagaggcattcaaatattatactttggctgcgggcagtggcaatgttatgagtatgtatcgcaccggattgtgttattacaacggagtaggtgtaaaacagaattatacagaagcttaccgatggtttaatgatgccgccggaaatgacaatgtggcttcgtattattatttaggtaagatgctgatgtatggcgaaggctgtgtgcccgatgcggaagcagggcttcaatggttgatgaaagctgctgagcataatagtgacaaggcgcagttcgaattgggcaatgcctatttgatgggtaatggagtagaggagaatgatgagatcgctatggagtggtttgagaaagcagccgaaaacggaaacgcgaaagccttgaaaattactggaagaagacaacgataa

SEQ ID NO: 53068 - protein, 832 aa, Bacteroides fragilis NCTC 9343
METLKEKFEALAHRIQSSGKPAAAWFPQFTPVTLLNAENWWEALAVCEYALDTHEDEALTAGFFELIFSAYDCNVEVDLNEEEYAYWWEKVISVCDRVAVFNGAGWSQKGAQYSEARYGKRDLSLLFPCYEKAAEMGSPEAEATVAYWRYMGFYCEQDRAEGERRFAALSSPEALLWGKYYRAYAEQHTGSKEKALLMRKELLDELPEGHRLRAHVYAAMGDALDIEEGSVAEEAACYEKSLELVPNLYSLKNLATLYFRYPELGKQKELAFELWEKAWHAGVWSAANFLGYNYQEEEWLDMPKAIEWLEKGMLYCESYCAYELALIYLYNDEYKNVERGLMCLQRCVDDNYVEAIETLANVYFNGELVEENISYACQLLERAIELGSGSAAYRIGWMYERGLLSEEPDYQKAMEYYEKAVSMDSADGYARAALYLANGYSGVTDAGKSKAYYEKAAELGSCFAMVELAFLYENGEVVEQSYEKAFDLLQKAAGQEYPYAMYRVGLYLDRGVIGEPRPEEAFAWYAKAAERGDGDAIFALGRCYKNGIGTEENPDKALEWFTKGAENNEPRCLTEMGLAYEYGSGIEENPHQAVEYMTKAAEQNYGYAQFKMGDYFFFGYGACPEDNKQAVEWYEKAVANDIPLAMLRMGEYYLYDYDKLNESEKAFSYFKKAAEAECYNEGLGICYEMGIGVEDNETEAFKYYTLAAGSGNVMSMYRTGLCYYNGVGVKQNYTEAYRWFNDAAGNDNVASYYYLGKMLMYGEGCVPDAEAGLQWLMKAAEHNSDKAQFELGNAYLMGNGVEENDEIAMEWFEKAAENGNAKALKITGRRQR

SEQ ID NO: 53069 - DNA, 996 bp, Salmonella enterica subsp. enterica serovar Choleraesuis str
  CDS (1)..(996): transl_table=11
atgaatcattccataaccagtcatccctgcgacaacgtatctttagcacaattaaccgaactggcgcagtcaggaaatagtgaagctcaatatatattaggccgtttatataatgacgaacgtatagatggcagcgaagaggataagctctctttttattggttgcagcaggcagctgaacaaggacactgcgaggcacaatattggctcggcttacgatacaaagacacgcctaccgacatgaaagataatacgctggctttattctggtcagaaaaagccgcacagcaaggacaccgccacgctttcaacacattaggctgggttcaggaaggagaaaccgggatggcgccagattatgcccaggccgttgcctggtatcgcaaaggagcagaacagagccacaaccttgcgcaatataatctcgggagaatgtatcgttcaggaactggcgtagagcaaaatgatacacaggcactctactggtttaaacaggcagcattacaaggccattgcgccagccaggaaagactggcgtatatgtatggcaatgggaaaggatgtcggaaaaatttatcccttgccgctctttggtacaagaagagcgcgctacaagagagcagctactcgcaatatcagatgggctattgttattacatcggagaaggtatcaaacaagattaccagcaggcaatatactggtttcgaaaagcggcagaccagggtgacgatggtgcctataacagtatcggctggatgtacaaatgcggtcatggcgtcgagcaaaattattcgctagcactggaatggttccacaaatcagcagaatgtaacaattcatcgggctggtacaacctcggatgcatgtacagagatggacacggtaccgcacaagacctacaacaagcgctctactggttcaaaaaagcacagcccacgggcaaatggaacgtcgatgaagagatccgcaaactggaagcccaactgcacgcttaa

SEQ ID NO: 53070 - protein, 331 aa, Salmonella enterica subsp. enterica serovar Choleraesuis str
MNHSITSHPCDNVSLAQLTELAQSGNSEAQYILGRLYNDERIDGSEEDKLSFYWLQQAAEQGHCEAQYWLGLRYKDTPTDMKDNTLALFWSEKAAQQGHRHAFNTLGWVQEGETGMAPDYAQAVAWYRKGAEQSHNLAQYNLGRMYRSGTGVEQNDTQALYWFKQAALQGHCASQERLAYMYGNGKGCRKNLSLAALWYKKSALQESSYSQYQMGYCYYIGEGIKQDYQQAIYWFRKAADQGDDGAYNSIGWMYKCGHGVEQNYSLALEWFHKSAECNNSSGWYNLGCMYRDGHGTAQDLQQALYWFKKAQPTGKWNVDEEIRKLEAQLHA

SEQ ID NO: 53071 - DNA, 1530 bp, Salmonella enterica subsp. enterica serovar Choleraesuis str
  CDS (1)..(1530): transl_table=11
atgcgtttttcatcaattttcaaaataataatattaaatatatttatttcaaaaatggctcacgctgctgtctgcgaggagcgctatcccgccgactcagaagaatgccagtacgttcaggaattagagcaaaaagcggaacaaggagatgaaagcgcgcagttctcgcttggaagctggtatgcggaggggcgatacgttaagcctgattataaactagccataaaatggctggagaaagcgggtaaacaaggttcggatttttcctatttcatccttggctatcattacaactatggtgaaaattttccacttagtcgacaaaaagcgctggagtggtatcgcaaggcggcagagctaggggatagtagtacgcaagaaatcctcggtgacgcctatatgtatggcgatgggtttccccaaaatacccagctagcgctggagtggtatcgaaaagccgcctctccaaccaatgatgcgggcgttgtccgcggccagggttcagcttcgtcagcacaatttaagcttggagtaatgtacgcccacggtcagggcgttcctcaggattatcagcaaacggcgatcttgatgcgtaaagcggcggaaaatatgtacgaccccgcgcaactttatctcggtgttgcctatttttatggtgaaggcgtgcctcaggattatcgtcaggcagtttactggcttaatgaaggtataccaggcagctatacgccaggccacattccgctgaatgcgctctatgataaagcgcatcccgctgaccgggttcactctcagacgtggtatcgaaaaacagcgcaacgcgtgatggcaaaggtacagtacaattttggcgtatggtattacaacggttatcacttattgaaagatcacaacctggcgctggagtggtatcgcagagccgcagcgcaaggattggccgaggcgcaggatgcgatcggcgtgatgtttatgcagggtgagggcgtttctcaggactaccaacaggcgctggcgtggtatcgcaaagccgcacgccagggactgcctgctgcgcaaacgcatctgggcatcatgtctgcatttggtcgcggcgtcgcgcaaagcgacagacaggctattgcatggtatcgaaaagcagcaaaacaggattttgcgaaagcgcaatatcagcttggcgtggcatatagcacgggaagaggcgtgcctgaaaatagccggaatgcgctgaagtggtaccttaaagcggcagagcaggggtttactccggcacaattagcgcttggggaaatttatgctcatgggcgccagggtgtgcctaaagataataagcaggcctatatttggtattacatggcaagtatatatacggaaaaatctaaggatgattgttcagcgctcattgccgaaagaaaccgactcaagggaacgcttaccccagatcaacttagcgagacatatgccgcctttgatctcatcaggcgaaaaatcaaccagtcaaaggaggcgaaaaagattgccaggaagaagtattga

SEQ ID NO: 53072 - protein, 509 aa, Salmonella enterica subsp. enterica serovar Choleraesuis str
MRFSSIFKIIILNIFISKMAHAAVCEERYPADSEECQYVQELEQKAEQGDESAQFSLGSWYAEGRYVKPDYKLAIKWLEKAGKQGSDFSYFILGYHYNYGENFPLSRQKALEWYRKAAELGDSSTQEILGDAYMYGDGFPQNTQLALEWYRKAASPTNDAGVVRGQGSASSAQFKLGVMYAHGQGVPQDYQQTAILMRKAAENMYDPAQLYLGVAYFYGEGVPQDYRQAVYWLNEGIPGSYTPGHIPLNALYDKAHPADRVHSQTWYRKTAQRVMAKVQYNFGVWYYNGYHLLKDHNLALEWYRRAAAQGLAEAQDAIGVMFMQGEGVSQDYQQALAWYRKAARQGLPAAQTHLGIMSAFGRGVAQSDRQAIAWYRKAAKQDFAKAQYQLGVAYSTGRGVPENSRNALKWYLKAAEQGFTPAQLALGEIYAHGRQGVPKDNKQAYIWYYMASIYTEKSKDDCSALIAERNRLKGTLTPDQLSETYAAFDLIRRKINQSKEAKKIARKKY

SEQ ID NO: 53073 - DNA, 1938 bp, Salmonella enterica subsp. enterica serovar Choleraesuis str
  CDS (1)..(1938): transl_table=11
atgggactgacgacagaagaatatattaataaaatacgcagtttaagaccggctattctcgatgaccgttatttttacctgacggtcgatcagtgcgatgctggcggcacgcccatgctgactggaatcgagctatgtaccgaagcgctgtgcggtgccgaatacatgaaaagatcgtctgacttgtggctggatgatgaactgcaaccgacggttaaacgtcaggcaacaacagtagtccatatgcccctcccctatgacaaagagaaaaaattatggaaagtcaccggcttgtatctggaatcctcagaagaaacaggggaggtgatgcaaagtaaacagatagcctttgaaggctataccaacgaagaaaacttcgctaaccgacaacgtgtttctgtatttaaatctttctatgaaagcggcaatctcaaaagtatttatcattataatgcgcaaaataagcgtgacggaaaagctgaaacttactttgatgaaaaagacaaaatagcggaaacgctgacgtttaaagatggtcaacccgaaggggaatacatcgtataccatgaaaacggagccgttgaaagtaaacgttactttgcccaaggtaaaattaaagatggcgaatgcccacatttttatgataacggcgttttaaaacaaaaacacagctatttaaatcagaaactggaaggcccggcatttgaatatttccctgatgggaaaataaaggggaaatattcatacagtaaaggcaccattgtcggcaccagtacggaatattattctaccggtaaaattcgtggtgtttaccacagaaataaccaaggtgaaaacgacggaacgttcgaacaatacagtgaagagggcaaactcctttctaaagcgacctataaaaatggcaaacagctttctgctcagagctggtatgaaaatgggcatcccaaagaagaatcctcttttgatagtgaaggccgtaaacatggtgcggtcaaagaatggttcagcaacggaaagcctgcctcatccaaaatgtataaacatgatgtgttagacggggatttcgaaaagtggtacgaaaatggtcaccgcgaatcagtctatccctataaaaacggtatgctaaatggggacgctaagcactggaatgaacagggcaaactcacctataccaccgaatataaagacgataaaaagcagggagccgatcgccgctggagcgaacgtaccggtaaacttgttgaagaggttatgtttgctaatgatgaaagaaacggcctgaaaagagagtttaacgatcgtacgggtaaggtcttaagtgcgctgccctatgtcgatggcgacaaggaaggtacagaagaagcctatgatgaagacggcataaaatacatccgttgttaccacaacgatgaagagctttcagagctatatgcgccgactgacgtcaccaataaggcaaagcagggtgacagcactgcgcaatatcatttaggtaagtacgagtttgaatgcacaaactacgatgcggcgatgaaatggttaactcagtccgcagagcaaaatcatcccggcgcgcttctctttttggcctatgcgtacaacgacggtgatggcgtagcgcaagacagcaaaaaatatctctcctatttattcaaagcggcagagcttggcgaaagtgatgcgcagttagaagtgggatatttaaatcttatcggcgaaggaatgccgaaaaacctgccggaagcctataagtggattaaaaaatccgctgaccagggaaatgctcaggcgcactataaccttggactcatgtacaggaatggtgatggcgttgagaaagacctcaacaaagccaaacttcatcttacagcggcggtaaaaggcggcgtcaaacctgcactggcagccttaaaggaattaacgcctcaaactaagtaa

SEQ ID NO: 53074 - protein, 645 aa, Salmonella enterica subsp. enterica serovar Choleraesuis str
MGLTTEEYINKIRSLRPAILDDRYFYLTVDQCDAGGTPMLTGIELCTEALCGAEYMKRSSDLWLDDELQPTVKRQATTVVHMPLPYDKEKKLWKVTGLYLESSEETGEVMQSKQIAFEGYTNEENFANRQRVSVFKSFYESGNLKSIYHYNAQNKRDGKAETYFDEKDKIAETLTFKDGQPEGEYIVYHENGAVESKRYFAQGKIKDGECPHFYDNGVLKQKHSYLNQKLEGPAFEYFPDGKIKGKYSYSKGTIVGTSTEYYSTGKIRGVYHRNNQGENDGTFEQYSEEGKLLSKATYKNGKQLSAQSWYENGHPKEESSFDSEGRKHGAVKEWFSNGKPASSKMYKHDVLDGDFEKWYENGHRESVYPYKNGMLNGDAKHWNEQGKLTYTTEYKDDKKQGADRRWSERTGKLVEEVMFANDERNGLKREFNDRTGKVLSALPYVDGDKEGTEEAYDEDGIKYIRCYHNDEELSELYAPTDVTNKAKQGDSTAQYHLGKYEFECTNYDAAMKWLTQSAEQNHPGALLFLAYAYNDGDGVAQDSKKYLSYLFKAAELGESDAQLEVGYLNLIGEGMPKNLPEAYKWIKKSADQGNAQAHYNLGLMYRNGDGVEKDLNKAKLHLTAAVKGGVKPALAALKELTPQTK

SEQ ID NO: 53075 - DNA, 759 bp, Xanthomonas campestris pv. campestris str. 8004
  CDS (1)..(759): transl_table=11
atgtctgagccggtgctggacaccgcgcaggtgatcgccgcactgcgcacgcagcccgcgcaggcggtggcgttgctacgcaaggcggccgatcgccaggatgtggccgcacagcttctgctcgcacaactctacgcagaaggccgcggcgtcgcggccgatccgatccaggcgatgctgtggtacgaagtggccgccaatgcagggcacccggaagcgatgaaccagctcgggcgctgccacgaactgggcttcggcacgccctgcaatctggagctggcggcgctgtggtttcgccgcgccgccgcgcatggcctggactggggcatgtacaacctggcccacctgtacgcctccggccgcggcgtcgcgcaggaccacacccaggcgttggcgctgtatcgccgcgctgccgaacacgggcacgccaagtcgatgaatttcgtggcgcgctatctggagcaaggcctggccggcgctgcagatccgcacgccgcccgcgcctggtaccgccgctccgccgaggccggcgatttccgcgggcaagccggttttgcgacggtgctggccgacgacggcgacatcgatcaggccgaagtctggatgcgccgcgccatcgctggcgggcatgccgggttcctgcgccaactcaccccgctgctggccgccgctccacaaccccgcctgcgcgcattgctgagcgaagtgcgtgcgcggcagtcgcctgcgccgcccgccacctccacggcggcggcctga

SEQ ID NO: 53076 - protein, 252 aa, Xanthomonas campestris pv. campestris str. 8004
MSEPVLDTAQVIAALRTQPAQAVALLRKAADRQDVAAQLLLAQLYAEGRGVAADPIQAMLWYEVAANAGHPEAMNQLGRCHELGFGTPCNLELAALWFRRAAAHGLDWGMYNLAHLYASGRGVAQDHTQALALYRRAAEHGHAKSMNFVARYLEQGLAGAADPHAARAWYRRSAEAGDFRGQAGFATVLADDGDIDQAEVWMRRAIAGGHAGFLRQLTPLLAAAPQPRLRALLSEVRARQSPAPPATSTAAA

SEQ ID NO: 53077 - DNA, 660 bp, Haemophilus influenzae 86-028NP
  CDS (1)..(660): transl_table=11
atgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgctaa

SEQ ID NO: 53078 - protein, 219 aa, Haemophilus influenzae 86-028NP
MKLTKTLLTTALFGASIFSFQSTAWADTPEQQFQQGLTAYEQSNYQTAFKLWLPLAEQGDAQAQGGLGMMYERGLGVKQDDFKAVNWYRKAAEQGDADAQLNLGAMYAIGRGVKQDGVEAVKWFRKAAEQGNAKAQNGLGMMYDGGLGIKQDYFKAVKWHRKAAEQGYGGAQVMLGFSYLSGKGVQVNKSLAKEWFGKACDNGEQVGCEYYGKLNRGER

SEQ ID NO: 53079 - DNA, 555 bp, Haemophilus influenzae 86-028NP
  CDS (1)..(555): transl_table=11
atgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgttcaagtaaataaatctttagccaaagaatggtttggtaaggcttgtgataatggtaatcaaaatggctgcgaatattatggcaagctaaatagaggggagctctaa

SEQ ID NO: 53080 - protein, 184 aa, Haemophilus influenzae 86-028NP
MKLTKTLLTTALFGASVFSFQSTAWADTLEQQFQQGLTAYEQSNYQTAFKLWLPMAEQGYAKAQFNLGVMYAKGQGVKQDDFEAVKWFRKAAEQGYAEAKFNLGHMYSKGRGVKQDDFEAVNWYRKAAEQGDADAQAILGFLYLLGERGVQVNKSLAKEWFGKACDNGNQNGCEYYGKLNRGEL

SEQ ID NO: 53081 - DNA, 552 bp, Haemophilus influenzae 86-028NP
  CDS (1)..(552): transl_table=11
atgaaactcacaaaaacacttcttaccaccgcacttttaggtgcttctgtattttcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatattgggattctcatatcttttaggaaaaggtgttcaagtaaataaatctttagctaaagaatggtttggtaaggcttgtgataatggtgatcaaggtggttgcaaatattatggcaagctaaatagaggggaacgctaa

SEQ ID NO: 53082 - protein, 183 aa, Haemophilus influenzae 86-028NP
MKLTKTLLTTALLGASVFSFQSTAWADTLEQQFQQGLTAYEQSNYQTAFKLWLPLAEQGDANVQFNLGVMYAEGQGVKQDDFEAVKWYRKAAEQGDANAQAYLGLAYTEGRGVRQDYTEAVKWFRKAAEQGHANAQAILGFSYLLGKGVQVNKSLAKEWFGKACDNGDQGGCKYYGKLNRGER

SEQ ID NO: 53083 - DNA, 918 bp, Psychrobacter arcticum 273-4
  CDS (1)..(918): transl_table=11
atgcccctgaaactactaaagcgtaagttggattctttaaaaaatccttcatatactgcacaacgtttaaatccgacaactaaattgtatcaaaaagcagcgcataacggtgatgctgaagcccagtttaaccttggattaacttacaaagacggtcaagatgttcagcaagataatagtatggcagttaaatggtatcaaaaggcagcagagcagggccatattgcttctcagtttaaccttgggtcgctgtaccgagacggcaaaggtgtccagcaggacttttctttagcagctgaatggtatcaaaaggcagcagagcagggccatattgcttctcagtttaaccttgggtcgctgtaccgagacggcaaaggtgtccagcaggacttttctttagcagctgaatggtatcaaaaggcagcagagcagggccatattgcttctcagtttaaccttgggtcgctgtaccaagatggcaaaggtatccagcaggactttgctttagcagttaaatggtatcaaaaggcagcagagcaaggccatattgcttctcagtttaaccttgggtcgctgtaccaagagggtaaagatgtccagcaagattttgctttagcagctaaatggtatcaaaaggcagcggagcagggccatattgcttctcagtttaaccttgggtcgctgtaccaagagggcaaagatgtccagcaagattttgctttagcagctaaatggtatcaaaaggcagcggagcagggccatattgcttctcagtttaaccttgggtcgctgtaccaagagggcaaaggtttgcgtcaagataagaatcaagcaaaagaatggttcggtaaagcttgtgataacggggatcaagctggctgtgataattatcgaatattaaatgaactaggatattaa

SEQ ID NO: 53084 - protein, 305 aa, Psychrobacter arcticum 273-4
MPLKLLKRKLDSLKNPSYTAQRLNPTTKLYQKAAHNGDAEAQFNLGLTYKDGQDVQQDNSMAVKWYQKAAEQGHIASQFNLGSLYRDGKGVQQDFSLAAEWYQKAAEQGHIASQFNLGSLYRDGKGVQQDFSLAAEWYQKAAEQGHIASQFNLGSLYQDGKGIQQDFALAVKWYQKAAEQGHIASQFNLGSLYQEGKDVQQDFALAAKWYQKAAEQGHIASQFNLGSLYQEGKDVQQDFALAAKWYQKAAEQGHIASQFNLGSLYQEGKGLRQDKNQAKEWFGKACDNGDQAGCDNYRILNELGY

SEQ ID NO: 53085 - DNA, 741 bp, Colwellia psychrerythraea 34H
  CDS (1)..(741): transl_table=11
atgcgtactaaaatattactgcttaccttcacactgctaagcagtttttcagtattgagccaaggtaatgaccttgagcagggaatgtatgaattaaaccgaggggaatttaaagcggctatcgagcagtttcgtccactggttaatgaaggttatgctccagcccaatatcaaatggccttggtatatcttcacggttattctgttcgtaaagatagtatgaaagcactggagttatttgaactttctgctgcacaaaactacccagatgcacaatttgaactggccttaatttattcagacggtaagttagtaaaacaaaaccttaaaaaagcgtttgagcttactcataaagcggcaaacaaagacttacctagtgcgcaatttaatttggcagtaatgtatgctaacggtacggggattaaacaagatgattttaaagcatcgcgttggtatcagcgtgctgcaaatcaaaattatgccctagctcaatttaatttggcgttactttatagtgaaggtaaaggtgtagagaaaagtactgaactgtcctatgtctggaataccatagcatcatggaacggctaccctaatgctgaaaaaagtcgtttaatggatgaaagagatttatctaagcttaaaattgaaaaaagtatcgaaaaagcgaatgatatctatcaaaaaataagagatcagcaggaaatgaaagcaaaaatggcagaaaagcagaacttctattga

SEQ ID NO: 53086 - protein, 246 aa, Colwellia psychrerythraea 34H
MRTKILLLTFTLLSSFSVLSQGNDLEQGMYELNRGEFKAAIEQFRPLVNEGYAPAQYQMALVYLHGYSVRKDSMKALELFELSAAQNYPDAQFELALIYSDGKLVKQNLKKAFELTHKAANKDLPSAQFNLAVMYANGTGIKQDDFKASRWYQRAANQNYALAQFNLALLYSEGKGVEKSTELSYVWNTIASWNGYPNAEKSRLMDERDLSKLKIEKSIEKANDIYQKIRDQQEMKAKMAEKQNFY

SEQ ID NO: 53087 - DNA, 708 bp, Colwellia psychrerythraea 34H
  CDS (1)..(708): transl_table=11
gtgcgtttattcccccactttttatttctacttgtatcgttttcttcaattgcaaatgatgattttgacaaaggaaaagaagcatataaaaataataattacccccaagctattactctctttaataaagctgctggccaagggagtgcaaaggctcaaagctatcttggttatatgtatacgaaaggaaaaggagtcaaacaagattacaccaaagccgttgactggtatcgaaaagccgctgaacaaggtaatgctagggatcaatatagcctagccatcatttatgaaaaagggagaggagttgctcaggattataaccaagctattgagtggcacactaaggcagccgaacaaggcaatcctagatctcaatatcaccttgcgcttatatattataatggtaaaggtgttacacaagattataaacaagcgttaaaatggtattccaaagccgctgaagacggtaatgcaggggttcagtatagtcttggagtaatgtatgaaaatgggcagggagttgctcaggattacaagcaagcatttgattggtacagcaaagcagcagaacaaggtgatgcaaaggctcagtataaccttggacttttgtatgccgatggcaaaggtattacagcggataaagaaaaggccattctctggtctaaaaaagcggaagaacaaggctattcaggcaagtcattaccgtga

SEQ ID NO: 53088 - protein, 235 aa, Colwellia psychrerythraea 34H
MRLFPHFLFLLVSFSSIANDDFDKGKEAYKNNNYPQAITLFNKAAGQGSAKAQSYLGYMYTKGKGVKQDYTKAVDWYRKAAEQGNARDQYSLAIIYEKGRGVAQDYNQAIEWHTKAAEQGNPRSQYHLALIYYNGKGVTQDYKQALKWYSKAAEDGNAGVQYSLGVMYENGQGVAQDYKQAFDWYSKAAEQGDAKAQYNLGLLYADGKGITADKEKAILWSKKAEEQGYSGKSLP

SEQ ID NO: 53089 - DNA, 750 bp, Ralstonia eutropha JMP134
  CDS (1)..(750): transl_table=11
atgcctcaagcccgccccccgctctggcccgccgcggcagccggcctggcctgtcgccgtccgttggccatcgccacgctggccttggcgctggcgctttgtcctgacccgctgattcacgcggcgcctgcccccgctcagccggcccaggcgcagacacgcgaggcactcgccgcctatgaggccggcgcgttcgataccgcactgcgcggcttcgccgccgccgcacgggaaggcaaccggctggcccagttcaactacgcgatgatgctgctgcgcggcgagggcacgcccgtcaagccgcaggaagcgctggtctggctgcgcaaggccgctgacaaccagatgacacatgcgcagttcacctttggtgacctgtacgagcgcggcgagttggtgccgcgctcgctcgaagaggccaaccgctggtatgaacgcgccgcgcagggcggccacattcaagcgcaggtggcgctggcgaccaactacttcaccggccgcggggtgccgcgagactatgccaaggccttcgagtggtacaaccgtgccgccgcggcgggcgacggtggtgcacagtacatcgttggcagttactacgaacgcggcgagcctggcgtggtcggcaaggacatcgaacaggccaagatctggtatgcgcgctcggcggcgcatggcgatccgggcgcgctggccaagctgcgttcgctgctggaggaatccgtacgcgcgaaggccggcagctcgatgtaa

SEQ ID NO: 53090 - protein, 249 aa, Ralstonia eutropha JMP134
MPQARPPLWPAAAAGLACRRPLAIATLALALALCPDPLIHAAPAPAQPAQAQTREALAAYEAGAFDTALRGFAAAAREGNRLAQFNYAMMLLRGEGTPVKPQEALVWLRKAADNQMTHAQFTFGDLYERGELVPRSLEEANRWYERAAQGGHIQAQVALATNYFTGRGVPRDYAKAFEWYNRAAAAGDGGAQYIVGSYYERGEPGVVGKDIEQAKIWYARSAAHGDPGALAKLRSLLEESVRAKAGSSM

SEQ ID NO: 53091 - DNA, 1047 bp, Haemophilus influenzae R2846
  CDS (1)..(1047)
ttgcttcttttcattctatctattgcctgggcggatacgctggaacagcaattccaacaaggtcttgaagctacaaaaaggggcgattatcaaaccgcctttaaactttggttacctctggcggagcagggaaatgcaagtattcaatttaatttgggcttgatgtataaaaaaggacaaggcatcaaacaagatgattttgaagcggtgaaatggtatcgcaaagcggcggagcagggagttgcagatgctcaattaaatttgggcaatatgtatgctaagggactaggcgtcaaacaagatgatgttgaagcggtgaaatggtatcgccaagcagcggagcagggaaatgcaaaggctcaatttaatttgggcttgatgtatgataatggacgaggcgtcaaacaagattattttgaagcagtgaaatggtttcgcaaagcggcggagcagggatatgcggatgctcaatttaatttgggcaatatgtattacaacgggcatggagtaaaacaagatgattttgaagcggtgaaatggtatcgcaaagcggcggagcagggatatgcggatgctcaatttaatttgggcaatatgtattacaacgggcatggagtaaaacaagatgattttgaagcggtgaaatggtatcgcaaagcggcggagcaaggacatgcaaaggctcaatataatttgggtaatatgtatgccaatggacgtggcgtaaaacaagattattttgaagcggtgaaatggtatcgcaaagcggcggagcagggatatgcagatgctcaggctaatttaggttcggcttatagtgcagggcatggcgtaagacaagattatatcgaagccgtgaagtggtttaagaaagcagcagaaaatggtagtgctgatggtcagtttaagttaggtctggtgtatcttattggacaaggtattcaaaaagatagaacactcgccaaagaatggcttggtaaggcttgtgataatggtaatcaaaatggctgcgaatattatggcgagctaaatagaggggaacgctaa

SEQ ID NO: 53092 - protein, 348 aa, Haemophilus influenzae R2846
MLLFILSIAWADTLEQQFQQGLEATKRGDYQTAFKLWLPLAEQGNASIQFNLGLMYKKGQGIKQDDFEAVKWYRKAAEQGVADAQLNLGNMYAKGLGVKQDDVEAVKWYRQAAEQGNAKAQFNLGLMYDNGRGVKQDYFEAVKWFRKAAEQGYADAQFNLGNMYYNGHGVKQDDFEAVKWYRKAAEQGYADAQFNLGNMYYNGHGVKQDDFEAVKWYRKAAEQGHAKAQYNLGNMYANGRGVKQDYFEAVKWYRKAAEQGYADAQANLGSAYSAGHGVRQDYIEAVKWFKKAAENGSADGQFKLGLVYLIGQGIQKDRTLAKEWLGKACDNGNQNGCEYYGELNRGER

SEQ ID NO: 53093 - DNA, 1026 bp, Chlorobium limicola DSM 245
  CDS (1)..(1026): transl_table=11
atgaaacgttatatcatcggattacttgcagcttgtatgctgatgcagccagccggagctcgttgtgaaattcccttgctggacaatatttctcagttgcagaaagaggctcaacagggaaatgcagtagcacagaacaagcttggactgctgtactacactggtcagggggtcaagcgggactatgtcgaagcgctgcgatggtatcgtatggctgccgagcaacaacgcgcatgggcgcaagtcagtcttggcgtaatgtactacactggtcagggagttaagcaggaccatgcggaagcggcaacctggtttcgcaaggctgccgagcaagggcttccaaagggggaatactatctgggagtagtatatgaaaaaggtcagggagtaaagcaggaccatgcagaagcggcaacctggtttcgaagggctgccgggcagggtcttgcagaggctcagaacaagctgggccttatgtactactcaggtcaaggcgttaaacaggactatgtggaagcggcaacctggtttcgaaaggctgcagttcaggaattcgcactggcacaaaacagccttggcgtcatgtactacactggtcagggagtaaagcaggaccatgcggaagcggcaacctggtttcgaaaggctgccgggcacggcctttctgtagcagaaaacaagctgggccttatgtactataccggccaaagtgttaaacaggactatacagaagccgcaggatggtttcgtaaagctgcagttaaaggactcgcagaagcgcaattaaatatcgggatgcagtactacgcaggacaaggagtaaatcaggactatacagaagctgcaggttggtatcgtaaggctgccgagcagggtcttgcagaggcacagtataatttaggagcagtttacctgaatgggagtggcataacgaaggacgaacaaaaagcaagagaatggtataaaaaagcctgtaacaatggatatcgaccagcttgcgatgactacctgaagattaacgagtga

SEQ ID NO: 53094 - protein, 341 aa, Chlorobium limicola DSM 245
MKRYIIGLLAACMLMQPAGARCEIPLLDNISQLQKEAQQGNAVAQNKLGLLYYTGQGVKRDYVEALRWYRMAAEQQRAWAQVSLGVMYYTGQGVKQDHAEAATWFRKAAEQGLPKGEYYLGVVYEKGQGVKQDHAEAATWFRRAAGQGLAEAQNKLGLMYYSGQGVKQDYVEAATWFRKAAVQEFALAQNSLGVMYYTGQGVKQDHAEAATWFRKAAGHGLSVAENKLGLMYYTGQSVKQDYTEAAGWFRKAAVKGLAEAQLNIGMQYYAGQGVNQDYTEAAGWYRKAAEQGLAEAQYNLGAVYLNGSGITKDEQKAREWYKKACNNGYRPACDDYLKINE

SEQ ID NO: 53095 - DNA, 2496 bp, Magnetococcus sp. MC-1
  CDS (1)..(2496): transl_table=11
atgaaaatccattgggcaaaagggttgggttttggcatattgcttgtgttggcgggtgggctatttgcgtggaattttttcttatcccatccaccaagggccaaaacagctgcccaacgagctgtggctgagatttttgcgccgatttaccgtgaaccgaggtgggatcacgtacggaccatcggattgcagccaaaatttacgggttgtgagacggtggacgaacaccattataagacggcattggtgccgatggctggtcctaaactctcgcttcgcgagcggggcggggatttgcaggccctttttgcggatgaagccatgattcgccgtctgtttaatcatgaagtaacatccgaaaagtcggcgcataccctaataaaaatagagcatgtacaagcgcttttgcttggacaatgtgtggagcagaagctttttttaaaattggtcacaacggcccatggagatattgtggcaaccgttgagatagccctgggagatgcagccgaagccgagcagcgtgccgccgagcaggccagagttaaagaggaggaggagcgcctaacccgtatacgggtcaaagcgcaagaggccgagcagcgtgccgccgagcaggccagagttaaagaggaggaagagcgcctaacccgtatacgggtcaaagcgcaagaggccgagcagcgtgccgagcaggccagagttaaagaggaggaggagcgcctagcccgtatacgggtcaaagcgcaagaggccgagcagcgtgccgccgagcaggccagagttaaagaggaggaagagcgcctaatccgtattcgggtcaaagcgcaagaggccgagcagcgtgccgagcaggcgcgtgaacatgcgaaggatgccgctaagatagccctgggggatgccgccaagctggccaatccctctgttcaattcaatcttggcgttatgtatgacaaaggacagggcgtcacgaaagacgccaaagaggcggtgaagtggtttaggaaatctgctgaacaggggtatgcccaagctcaacacaatcttggcgttatgtatgacaaaggagagggcgtcacgaaagacgccaaagaggcggtgaagtggtttaggaaatctgctgaacaggggcatgcccaagctcaacacaatcttggcgttatgtatgacaaaggacagggcgtcacgaaagacgccaaagaggcggtgaagtggtttaggaaatctgctgaacaggggcatgcccaagctcaacacaatcttggcgttatgtataacaatggagagggcgtcacgaaagacgccaaagaggcggtgaagtggtatcggaaagcggctgaacaggggcatgcccgagctcaaaacaatcttggcgttatgtataacaatggagagggcgtcacgaaagacgccaaagaggcggtgaagtggtatcggaaagcggctgaacaggggcaagctgaagctcaaaacgatcttggcgttatgtatgacaaaggagagggcgtcacgaaagacgccaaagaggcggtgaagtggtatcggaaagcggctgaacaggggcatgcccgagctcaaaacaatcttggcgttatgtataacaatggagagggcgtcacgaaagacgccaaagaggcggtgaagtggtatcggaaagcggctgaacaggggcaagctgaagctcaacacaatcttggctttatgtatgacaaaggagagggcgtcacgaaagacgccaaagaggcggtgaagtggtatcggaaagcggctgaacaggggcaagctaaagctcaacacaatcttggcgttatgtataacaatggagagggcgtcacgaaagacgccaaagaggcggtgaagtggtttaggaaatctgctgaacagggggaagctaaagctcaacacaatcttggcgttatgtataacaatggagagggcgtcacgaaagacgccaaagaggcggtgaagtggtttaggaaatctgctgaacagggggaagctgaagctcaaaacaatcttggctttatgtatgacaatggagagggcgtcacgaaagacgccaaagaggcggtgaagtggcttaggaaagcggctgaacaggggcacgctaacgctcaagcctttcttggacaaagctatgatgtaggatatggagtcacgaaagacgccaaagaggcggtgaagtggtataggaaatctgctgaacaggggcaagctgaagctcaaaacaatcttggcgttatgtatgacaaaggacagggcgtcacgaaagacgccaaagaggcggtgaagtggtatcggaaagctgctgaacagggagatgctcgagctcaattcaatcttggagataagtatgacaaaggagagggcgtcacgaaagacgccaaagaggcggtgaagtggtatcggaaagcggctgaacagggcttaacggaagcaagtaccaggctgaagcggctacgctttaacgttgttggacacgaaaatgagggaaaatga

SEQ ID NO: 53096 - protein, 831 aa, Magnetococcus sp. MC-1
MKIHWAKGLGFGILLVLAGGLFAWNFFLSHPPRAKTAAQRAVAEIFAPIYREPRWDHVRTIGLQPKFTGCETVDEHHYKTALVPMAGPKLSLRERGGDLQALFADEAMIRRLFNHEVTSEKSAHTLIKIEHVQALLLGQCVEQKLFLKLVTTAHGDIVATVEIALGDAAEAEQRAAEQARVKEEEERLTRIRVKAQEAEQRAAEQARVKEEEERLTRIRVKAQEAEQRAEQARVKEEEERLARIRVKAQEAEQRAAEQARVKEEEERLIRIRVKAQEAEQRAEQAREHAKDAAKIALGDAAKLANPSVQFNLGVMYDKGQGVTKDAKEAVKWFRKSAEQGYAQAQHNLGVMYDKGEGVTKDAKEAVKWFRKSAEQGHAQAQHNLGVMYDKGQGVTKDAKEAVKWFRKSAEQGHAQAQHNLGVMYNNGEGVTKDAKEAVKWYRKAAEQGHARAQNNLGVMYNNGEGVTKDAKEAVKWYRKAAEQGQAEAQNDLGVMYDKGEGVTKDAKEAVKWYRKAAEQGHARAQNNLGVMYNNGEGVTKDAKEAVKWYRKAAEQGQAEAQHNLGFMYDKGEGVTKDAKEAVKWYRKAAEQGQAKAQHNLGVMYNNGEGVTKDAKEAVKWFRKSAEQGEAKAQHNLGVMYNNGEGVTKDAKEAVKWFRKSAEQGEAEAQNNLGFMYDNGEGVTKDAKEAVKWLRKAAEQGHANAQAFLGQSYDVGYGVTKDAKEAVKWYRKSAEQGQAEAQNNLGVMYDKGQGVTKDAKEAVKWYRKAAEQGDARAQFNLGDKYDKGEGVTKDAKEAVKWYRKAAEQGLTEASTRLKRLRFNVVGHENEGK

SEQ ID NO: 53097 - DNA, 2931 bp, Magnetococcus sp. MC-1
  CDS (1)..(2931): transl_table=11
atggtaaaatgtagacacagcagggtaggtgtgagcagacgcgctgccctgtttttagcgctcatcgtggtgatgtcgtccggcctatctgctggcttggcagcgcccaatctggccgaggatgttctgttggctggcccgcagcgtaccgcgttgtggcctcatggggtcgcgcttccaacagaccgtgggagcctgttacaactggccaatcaaggctaccgtcgagcccagttttttatggggctttatctggattatggtatcggcggagaggctcaaccttttgaggcctttcaatggtatagccgcgcagcggggcagggcagtcgttgggcttggattaaattgggtgatctctatttccgtggccgtggcaccgcacgggatgccaaaaaagcgctgcaatggtacctgcatgccggggaaaatggcgagcctagtggctatctggctgccgcaatggtacagattcgtggtacgggcgatagcattgattggccaaccgttttacagcgtgtgcacaaggctgtgcaagcgggggtattggaggggcacacagcactctgtctcttaggggtgcgacatgtggtggcgacgcagctacccccagagcagacccgccaacagtgccaaatgagtgcggatggggggcagccctttgccgcgattttgatggcccaatggctggctgagcagcataacgagaacaatccccaactgcaaaaacaggtcgaacagtggtacgagcgggctgctgccatggaggtaggtaacttggccgttctgcccgaggcaccactggtgatggccgagcatttccccgttgtttggatagaggctctagaaccactggtcagtgccaaccgcgccagcgtgccgcgtgcggcctatcgtgctggggtggcgctgctcaagtcggggcagggttttgtggcgcgtagtcgcggcgtgcgctggttacagaagggcgcggagttgggcgatgccaatgctcaatttagactggggcttgcctatgcccagggtgaaggggtggtggttaatccagaacgcgccatttactggtatacccttgcgtcggagcagggtgaagtttcggcacagtttaatttggccttgctctactaccaagggcgtttggttgagcaggattttaccaaggcccgtttttggtttgagcatgcctcggaacagggtgacgtgcaggcgcgggatcatctgggggatatttatcgtcatggccggggcataccggtcaatatagccgaggccatgaagtggtaccgccacgctgccgagcagaaaaatgtctacgcgcttacctcaatgggggatatctaccaagcgggtgagggggttgccgaggatgccgcagaggccgcaaaatggtaccgcaaagcggcgctgctgggtcatgccccggcgcagggtaacttggccgacctttatcgacagggtaaaggggtagaaaaggatcttaatcaggccgcacagtggtatacaaaagctgctgaacagggggacatggtctctcaaaactggctgggcacgctctacctggatggggacggtgttgaaaaaaatccccagttggcgcagcaatggtacgaaaaatcagcggctcaagggtacgcttttgcccagaacaatttggcggttatgttgcgggatggcttggcgggcaaggctgattataagcgagccagacagctctttttgttagctgctcggcaaaacagtggtgatgcgcaaaatagtcttggcgtgctttatgaaaaggggttagggggcgaaaccgatcccattgaggctgctgcgtggtatcgtaaggccatccaatatggcaatgacagtgcccgttataaccttggcatgctctattatgccaaccgtcaatttggtagtatagaagaggccctgcggctgttgcaagatgcccaaagtgccggggtagcccaggctcaaaccgcactggctcggatctatcttagtaaagaaaacagccactataatcctgagttgggcgagcgctttttgcgtgaagccgcagaacagggtggggcggatgcacaggctttattaggggttttattaacctttaaaacccctcttaaacaggattatgagcaggctctaaggtggttaaaaaagggtgctgaaggggggagtccggaggcgcagtttcacttgggctatatgttacatttgggggtagggctggcccccaatgctcaccgtgcggtgcattggtaccgcaaagccgcagaacagggctttgctgaagcggccaacaatttggggaccctctatttccagggtaatggggttgatcgagacgtttttaaagcggtggaatggtacacgcgcggtgccaaacttggccatgtgcccgccttacataacttgggcaaccactaccgccatgggttgggggtggccgtcgatgcccgactggcaaggcactattttgaaaaagcgcaggccgccggctttatgccgtctaaattagccctcggtgagatgctggagaagggtgaaggcggggtggcctcccttaaacgggcagaagggctgtttggtgaggtggcccggtcgggcaatatggatggtaaataccggcttgcccgactctacttaacccatggcccagagggtaaacaagtttatgccatgcgtctgctccaacagacggctaaattggggcatcccgcagcgcagtatggtttagcggccctctacctaaaagaggccgatcttgaagccccgttgacggatcgggttaaacaggcttattcactgctgttggccagccgccacggcggtatgagcgaagccgaatccctgctagagcggctggaaaaacatttgcctgaaggcgtgcgtcaagaactacagcacgcttttgaaaaaacgaaggcaaagctgtag

SEQ ID NO: 53098 - protein, 976 aa, Magnetococcus sp. MC-1
MVKCRHSRVGVSRRAALFLALIVVMSSGLSAGLAAPNLAEDVLLAGPQRTALWPHGVALPTDRGSLLQLANQGYRRAQFFMGLYLDYGIGGEAQPFEAFQWYSRAAGQGSRWAWIKLGDLYFRGRGTARDAKKALQWYLHAGENGEPSGYLAAAMVQIRGTGDSIDWPTVLQRVHKAVQAGVLEGHTALCLLGVRHVVATQLPPEQTRQQCQMSADGGQPFAAILMAQWLAEQHNENNPQLQKQVEQWYERAAAMEVGNLAVLPEAPLVMAEHFPVVWIEALEPLVSANRASVPRAAYRAGVALLKSGQGFVARSRGVRWLQKGAELGDANAQFRLGLAYAQGEGVVVNPERAIYWYTLASEQGEVSAQFNLALLYYQGRLVEQDFTKARFWFEHASEQGDVQARDHLGDIYRHGRGIPVNIAEAMKWYRHAAEQKNVYALTSMGDIYQAGEGVAEDAAEAAKWYRKAALLGHAPAQGNLADLYRQGKGVEKDLNQAAQWYTKAAEQGDMVSQNWLGTLYLDGDGVEKNPQLAQQWYEKSAAQGYAFAQNNLAVMLRDGLAGKADYKRARQLFLLAARQNSGDAQNSLGVLYEKGLGGETDPIEAAAWYRKAIQYGNDSARYNLGMLYYANRQFGSIEEALRLLQDAQSAGVAQAQTALARIYLSKENSHYNPELGERFLREAAEQGGADAQALLGVLLTFKTPLKQDYEQALRWLKKGAEGGSPEAQFHLGYMLHLGVGLAPNAHRAVHWYRKAAEQGFAEAANNLGTLYFQGNGVDRDVFKAVEWYTRGAKLGHVPALHNLGNHYRHGLGVAVDARLARHYFEKAQAAGFMPSKLALGEMLEKGEGGVASLKRAEGLFGEVARSGNMDGKYRLARLYLTHGPEGKQVYAMRLLQQTAKLGHPAAQYGLAALYLKEADLEAPLTDRVKQAYSLLLASRHGGMSEAESLLERLEKHLPEGVRQELQHAFEKTKAKL

SEQ ID NO: 53099 - DNA, 912 bp, Thiomicrospira denitrificans ATCC 33889
  CDS (1)..(912): transl_table=11
atgaaaaaagcactaccttttttaacgctctttttttttgcattcacacaactatttgcagatataaactcaaccaagacatttgataaatacctaagagaagcaaaggatggaaactcttctgccatgtttaatgtaggtcttagctactttaacggagttggtgtcgaaaagaaccataataaggcttttgagtggtataacagagcttcagataaaggaaatttagaggcactaaacaaccttggtacaatgtatgacaatggagatgcaactcttcaaaacagctctttggcacaaaaatattatgagatggcagctaatgctggacttgctactgcacagctaaatttaggtctattttttgagaaaaacccaactagtgaaaatatgaaaaaagcagcctcttggtatgaaaaagcagcgctacaaggaaatagtatcgcacaaaacaatcttgctaaattatattactttggcaatggtatcggttacaacttggagagagctttttactggtttcaagaagcagcatggcaagatgacccaatagcacagtacaatctctccatgatgtactataaagcagaacacacgccttatgacgcttctaaaacactattttggcttgagcgatcagctaaaaatggaagccaacatgcacagacaaagctgggtgatttctatacagaggggttgattgtaaaaaaaaatttagaaattgcttttgagtggtacatgagagcagctcttaaaaattatcaaaaagcgctctatcaagttggggtattttacttttatggacatggagtaaataaaaattccataaaagcaaaagagtggctggaaaaagcctcagaatcaggctatgaagatgccactttatttatgcagaggaacaagcttagataa

SEQ ID NO: 53100 - protein, 303 aa, Thiomicrospira denitrificans ATCC 33889
MKKALPFLTLFFFAFTQLFADINSTKTFDKYLREAKDGNSSAMFNVGLSYFNGVGVEKNHNKAFEWYNRASDKGNLEALNNLGTMYDNGDATLQNSSLAQKYYEMAANAGLATAQLNLGLFFEKNPTSENMKKAASWYEKAALQGNSIAQNNLAKLYYFGNGIGYNLERAFYWFQEAAWQDDPIAQYNLSMMYYKAEHTPYDASKTLFWLERSAKNGSQHAQTKLGDFYTEGLIVKKNLEIAFEWYMRAALKNYQKALYQVGVFYFYGHGVNKNSIKAKEWLEKASESGYEDATLFMQRNKLR

SEQ ID NO: 53101 - DNA, 795 bp, Psychrobacter cryohalolentis K5
  CDS (1)..(795): transl_table=11
atgcttatctggtttgtagtcggagcgatagccttatctgtaatagcatttaaatattatggaagaaacagagaatctgatagttttaagcttatggagagattagctagccaaggggatgcgcgagctcaaataaatcttgccatgatgtattacggtggtacaggcgtacgtcaagatcttcctaaagctattcaatgggcagaaaaaccagctcggcaaggtaatgctgaggctctatttgttatgggtatgatgcatactcaaaagaatgatactaaggcttttgagttttacctacaatcagctaatcagggctatcctagtgctcagaacatggttggcctttcatacaaggaaggaagaggtgtacaacaagactataccaaggcatttgaatggatacaaaaagcagctaatcagggctatcctagtgctcaatacgagcttagtctaatgtatgagaaaggcataggcgtaaaacaggataacgctaaagcgtttgagtggtatctaaaatcagctaaccaaggtaatgcgcaagctcaaagcaatcttggtgctatgtatgatcaaggcataggcgtacaacaagactatgccaaggcatttgaatggtatacaagatcagctagccaaggtgatgcgcgagctcaatttaatcttggtaggatgtatcattttggcaaaggtgtacaacaagatgatgctaaggcacgtgattggctgggtaagtcttgcaaaaacgggtttcaagatgcttgcaccatttatcgattattacctaaaagatag

SEQ ID NO: 53102 - protein, 264 aa, Psychrobacter cryohalolentis K5
MLIWFVVGAIALSVIAFKYYGRNRESDSFKLMERLASQGDARAQINLAMMYYGGTGVRQDLPKAIQWAEKPARQGNAEALFVMGMMHTQKNDTKAFEFYLQSANQGYPSAQNMVGLSYKEGRGVQQDYTKAFEWIQKAANQGYPSAQYELSLMYEKGIGVKQDNAKAFEWYLKSANQGNAQAQSNLGAMYDQGIGVQQDYAKAFEWYTRSASQGDARAQFNLGRMYHFGKGVQQDDAKARDWLGKSCKNGFQDACTIYRLLPKR

SEQ ID NO: 53103 - DNA, 1512 bp, Prosthecochloris vibrioformis DSM 265
  CDS (1)..(1512): transl_table=11
atggcttatatgggtgacatggtgcgcccgatatgtcgggatggcgcaacgctggattatgtcgctgccgctaaggcgtacggatctcgttgtgatgcaatcggatccattccaagaggtggagtcctggtttttctggcagtcatgcttgtgttggctgttgcccccatgcggtcagcccgggggggtgagcagcccgtcaagatgcggctgatattcccgccttcagatgccgataagaaggacctggcgttgcttcagaaagaagctgacggagggaatccaaaagcgcaatttcttcttggaatgaggtacagcgaaggggttggcgtgtcgcagagcggcactgaggcgatgaaatggtaccggcgtgcggcggatcgggggtatgcccgggcgcagttcaatctgggggtgatgtgcgaccgaggacgaggtgttccggtagattatgccgaggccgccaaatggtaccggcttgccgccgggcaggaagtggctgcagcacagcataacatttcagtgctgtacgatgagggtaaaggtgtccgacgggacagcacggaggccctgaaatggcggaggcttgctgcggagcagggcatcgtcgaggcgcagtacctgcttgcccatgcatacaggtacggcgggggcgtactccgggacgacagggaggcggcgaaatggttcaagctggctgccgcgcaggggaatgcttatgcacagtttgagctggccgtgatgtatgactacggggagggagtgccgcaggacaagtttgaggcggtggagtggtacggtcgtgcggccgaacagggggtcccggaagcgcagaacagtcttgccgtgatgtacgatgagggcgaagggctcaccaggaataaggaggagtcgctctactggtgccggctcgccgccgagcagggggactccgttgcgcagaacaacctcgggtgggcataccgggaaggcgatggcgtggcaaaggattatgccgaggccgtgaaatggctgcgcctggccgccgggcagggcgtaacgattgcccagaacaatctcggcttgatgtacctcgagggccagggcgtgaagcgggatgagccagaggcgctcaggctgttccgccttgccgccgccgagggaaatggttatgcctgctgcaacatcggggagatgtatgtgaagggccaggttgtggagcagaattatgaagaggccatgaagtggttccgtctggctgccgagaaggatggcaatgatgccgcgtactggataggctggctctatgaagaggggaagggggtactggcggatcccgatgaagcagcaaaatggtatcgaatcgctgaagggcgtaaagatcccaatggcctgttatcaatcggggagatgtatgagaaaggactcggggttccgggcagcatatcgaacgccgaaaaatggtacaggaaggcttgccgtgcgggtgaaaaagatgcatgcgaaaggctgaaacgactggccgggaaatag

SEQ ID NO: 53104 - protein, 503 aa, Prosthecochloris vibrioformis DSM 265
MAYMGDMVRPICRDGATLDYVAAAKAYGSRCDAIGSIPRGGVLVFLAVMLVLAVAPMRSARGGEQPVKMRLIFPPSDADKKDLALLQKEADGGNPKAQFLLGMRYSEGVGVSQSGTEAMKWYRRAADRGYARAQFNLGVMCDRGRGVPVDYAEAAKWYRLAAGQEVAAAQHNISVLYDEGKGVRRDSTEALKWRRLAAEQGIVEAQYLLAHAYRYGGGVLRDDREAAKWFKLAAAQGNAYAQFELAVMYDYGEGVPQDKFEAVEWYGRAAEQGVPEAQNSLAVMYDEGEGLTRNKEESLYWCRLAAEQGDSVAQNNLGWAYREGDGVAKDYAEAVKWLRLAAGQGVTIAQNNLGLMYLEGQGVKRDEPEALRLFRLAAAEGNGYACCNIGEMYVKGQVVEQNYEEAMKWFRLAAEKDGNDAAYWIGWLYEEGKGVLADPDEAAKWYRIAEGRKDPNGLLSIGEMYEKGLGVPGSISNAEKWYRKACRAGEKDACERLKRLAGK

SEQ ID NO: 53105 - DNA, 2064 bp, Candida albicans
  CDS (1)..(2064): transl_table=12
atgccgccacaacaaccaccgggatccaatatgcaactacaatctatatcaccgcgtgatcaagcacaatttaatcaacagaatattcaactgcagagaccaatatctccaagaccaccaaatcaacgtctgaataatctgctgtcgtcacaaagactgtttcaacaaatccaacaacaacagcaacaacagcaccaaaatcaacaacaattctcgccatctataaaatatgcatctgacggttattcaaattctccatattcacctatgggctcaaacaatctttatcaacaagatcaattcaaggcttcaccaacattaaatgcaactccagtcaagtctccaccagttgatgctccatatccagtttatgatgctcctagtccacctccagtatttgcctctaaagaaagtattgtgatttctccaccatcagtgccgttatcagctacatcttcagtaaccaatttgaatttgaatcaagctgatatttatcattctcaatcggaaaacaatttggcggttcatactggtaataaatttggtcataatcgatcggtatcttcaacatcatcatttttctatgatcgtagtgataatgcttcaatgattgatttcaatcaaaatatgattcaactgtatttgggagcaaattccagtcatttattacctagaattaaaacattggaattgtatcggaaaaatgctaaaaaatctaccgatcctaacgttttatttcaatatgctcaatatatgttacaaacagcattattattagaatcagaattacaaaatatggtcaataatggcaatggtaatggcaacggaagtcaaaatggtaatatagcagggattaataatgctacatcttcttcacaatcttctggttcacaaaatggaactaattctccatttaccagatcaattgaaaattcaccaagaaaaggtccattggataatactactactactactactaatggaactaaagataaacataccaagagtaaatctatagatttcaataatattgaattggaaggtaatgaaaagaaattgaaaaaggcattattaaaagaagctgtcaaatatttgaaacgactttctgataaaggttatgttgaagcccaatatttattagctgatgcgtatagttcaggagctttagataaaattgacaataaggaagcatttatattatttcaatcagctgcgaaacatggacatgttgaaagtgcttttagaacttcattttgttatgaagaaggattaggaactggtagagattctagaaaagcggttgaatttttaaaaattgccgcatcaagaaatcatcctgctgccatgtataaattgggagtttattcattttatggtagaatgggtttacctgcaaatgatatgaatacgaaaaaaatgggtattaaatggttaactagggctgctaatgttgccactgaattaactgctgctgcaccttatgaattgggtaaattatattataatggatttgaagatattgtcttgattgataaaaaatatggattagaattatttgctcaagcagcagcattaggtcatttacaatcagccgccattttgggtcatcattatgaaattggagaaattgttcctcaagattctaatttatcaattcattattatactcaagcagcattaggaggtgatccaaattcaatgttggcaatgtgtgcttggtatttagttggtagtgaaccatatttacctaaagatgataatgaagcatttgaatgggctaaacgtgctgccaattgtaatttaccaaaagctcaatttgctttagcaaatttttatgaaaaagggattggatgtattaaaaatattaatgaagctcaatcatggtataaaaaagctgctgaaaatggtgatgaaaaatctttgaaacgattaactgataaagaattggttaaaaccattcaaaaacaatggaaaaagaaacctccagtaattcataatgaagatggaacttctacaactaattcaggatctcttgctcaagaaaaagattgtgttatcatgtaa

SEQ ID NO: 53106 - protein, 687 aa, Candida albicans
MPPQQPPGSNMQLQSISPRDQAQFNQQNIQSQRPISPRPPNQRSNNSSSSQRSFQQIQQQQQQQHQNQQQFSPSIKYASDGYSNSPYSPMGSNNLYQQDQFKASPTLNATPVKSPPVDAPYPVYDAPSPPPVFASKESIVISPPSVPLSATSSVTNLNLNQADIYHSQSENNLAVHTGNKFGHNRSVSSTSSFFYDRSDNASMIDFNQNMIQSYLGANSSHLLPRIKTLELYRKNAKKSTDPNVLFQYAQYMLQTALLLESELQNMVNNGNGNGNGSQNGNIAGINNATSSSQSSGSQNGTNSPFTRSIENSPRKGPLDNTTTTTTNGTKDKHTKSKSIDFNNIELEGNEKKLKKALLKEAVKYLKRLSDKGYVEAQYLLADAYSSGALDKIDNKEAFILFQSAAKHGHVESAFRTSFCYEEGLGTGRDSRKAVEFLKIAASRNHPAAMYKLGVYSFYGRMGLPANDMNTKKMGIKWLTRAANVATELTAAAPYELGKLYYNGFEDIVLIDKKYGLELFAQAAALGHLQSAAILGHHYEIGEIVPQDSNLSIHYYTQAALGGDPNSMLAMCAWYLVGSEPYLPKDDNEAFEWAKRAANCNLPKAQFALANFYEKGIGCIKNINEAQSWYKKAAENGDEKSLKRLTDKELVKTIQKQWKKKPPVIHNEDGTSTTNSGSLAQEKDCVIM

SEQ ID NO: 53107 - DNA, 2058 bp, Caenorhabditis elegans
  CDS (1)..(2058): n means a or g or c or t/u, s means g or c
atgattaaaacctatctgacactgttgctactagcaacctcggccacgtgtcaaaaaaagtcagcgactctggtatctgcggaaggagaagcgcctgcaataaaagtgataaaaaccacaggctcgttactcactgcaattgatgtgtcgaaagctgatttggactgggaacaggtcacatcacagcaagatgagaataagagcaatcgagaaattccaaaagtaataagcgaggagtacttggctgaaaaagtagaacaaccaccaagccctgaagctgaagctgagtttcaacgcggaatggcttatattgaaagaggaaaaggtcatggaagagaaggaagagttgcagctcatagagtatttgaaagagcagccgcacaaggtcatcaagaagccagaaaagctgtagcgttctcacagatgttcggagattattcccgttggtccattcaggaagccaagacagttttcgaagatctcgaaaaaaacggctcaccagatgctcaacttgcattaggattcatgcatggagccggaatcggagtggaaaaatcgaatcaagcaaaagctcttgtatattatatgttctccgctctcggaggaaatcctcttgcccaaatggctatgggcttccggtatagtcacggagttggagtgccacaaaactgcgaaactgcactttcatattatcaaaaagttgcaaaaactgtagtggataatgttaaattcacaactggacagacaattcaacgattgagactaaccgacgaaacagatccaacaatccatatgcaaccaggaagtgcaccactggagagtaatcttcttgagtattacaagatgcttgccgacaaaggagatacatccgctcaattgggactcggacagatttatttagctggtggacgagggctcaatcaaaatttcgaactcgccttccgctacttgttagctgctgctgagtcaggaagtgccgatgcattgacatatctcggaaaaatgtatttggatggaactccgtttacgccaaaagattatcaaaaatcattcgaatatttgatgaaatcagctgataaatctagtcctagtgcacaggctgtattgggagcaatgtatatgaaaggaaaaggagtcaagaagaattacgaaaaggctttgaagttgctgacattgtcggctgataagaagaacgccgatggacaaatgtatttagcagaattacattacaaaggtgttccaaccaacaaaggagtgcatcgagatttcaagaaatctgtgaaactttaccagcttgcttctcaaaatggacatattcttgcctactataatcttgctcaaatgcacgctgctggaacgggagttccacgttcatgttcccacgcggttgatcttttcaaatctgtagccgaacgaggaaaatggggagaacgattgatggaagcccatagcgcatataaagataatcgagttgatgaggccgcaatgaaatatttattcatggctgaacttggctatgaagttgctcaaactaatctagcctatattttggatcgtggagaagcgacgtcattgttctcgggaccgaaagataacaatatggaaagagcgttcctcaattggcaaagatctgcaaatcaagaatatgctgctgctcgcgtgaaacttggtgattactactattatggtctcggtacagaagttgaccacagtttggcgttctcaaactataaaatggcagtcgatagmcacggtgttgctcaagcaatgttcaatttgggatatatgcacgaagttggcgaaggaatcactcgggatctttacctggctaaacgtttctacgatcaagcaattgagcatagtcaggatgcatacatgccgtcgaaattagcattagcaaaactagcttttgtcttctatttggaagagctcaacaagctgccattaatcagttttatggagaaaaccgttggaccacgatgggatgctattttgatgaccgtttctgcattggttccattattcttgttctggaggcaccgacaaaatgataattga

SEQ ID NO: 53108 - protein, 685 aa, Caenorhabditis elegans
  Xaa in position 583 is unknown
MIKTYLTLLLLATSATCQKKSATLVSAEGEAPAIKVIKTTGSLLTAIDVSKADLDWEQVTSQQDENKSNREIPKVISEEYLAEKVEQPPSPEAEAEFQRGMAYIERGKGHGREGRVAAHRVFERAAAQGHQEARKAVAFSQMFGDYSRWSIQEAKTVFEDLEKNGSPDAQLALGFMHGAGIGVEKSNQAKALVYYMFSALGGNPLAQMAMGFRYSHGVGVPQNCETALSYYQKVAKTVVDNVKFTTGQTIQRLRLTDETDPTIHMQPGSAPLESNLLEYYKMLADKGDTSAQLGLGQIYLAGGRGLNQNFELAFRYLLAAAESGSADALTYLGKMYLDGTPFTPKDYQKSFEYLMKSADKSSPSAQAVLGAMYMKGKGVKKNYEKALKLLTLSADKKNADGQMYLAELHYKGVPTNKGVHRDFKKSVKLYQLASQNGHILAYYNLAQMHAAGTGVPRSCSHAVDLFKSVAERGKWGERLMEAHSAYKDNRVDEAAMKYLFMAELGYEVAQTNLAYILDRGEATSLFSGPKDNNMERAFLNWQRSANQEYAAARVKLGDYYYYGLGTEVDHSLAFSNYKMAVDXHGVAQAMFNLGYMHEVGEGITRDLYLAKRFYDQAIEHSQDAYMPSKLALAKLAFVFYLEELNKLPLISFMEKTVGPRWDAILMTVSALVPLFLFWRHRQNDN

SEQ ID NO: 53109 - DNA, 726 bp, Pseudoalteromonas haloplanktis TAC125
  CDS (1)..(726): transl_table=11
atgtcacagtttaatttaaaaaccttactcctagcgggcattttacttagtagccctttcgctcatgctgggttagaggaagggatcaaagccgctaatgaaggcgaatttgcacaagcactaaaagagtttaattacctagcagataaaggctttgcccctggtatttatgagctgggtaaattgtatgaaggtgggtatggtgtaacgcgtgactaccgtaaagctgctcaactttatcaacaaggggtagcaaaaaatcaccccgattctatgtttgctttagccgttttatacgatgaaggcaacggggtaaaactcgacaaacaaatggcaataaagttatttgaacaagcggcaaacaaaaacctacccgctgcacaatttaacctaggcgttatgtatgccaatggtgatggcgtaagcgtagattatgaacttgctaaaacgtggtatgaaaaagctgcagccaataattatactttggcgcaatttaatttagctttaatgtactttgaaggcttaggcatgcctaagaatttagaaaagtcatatatttggaacaccattgccgagtataacggcaatatgcaagcaagccatagtcgcaagctcgacgagcaaaaaatgctgcctaaagaagttgaagaagcaaaagaaaaagccgacgctatttataccagaattttagccggcacttacgctggtgaagggcggttgttttaa

SEQ ID NO: 53110 - protein, 241 aa, Pseudoalteromonas haloplanktis TAC125
MSQFNLKTLLLAGILLSSPFAHAGLEEGIKAANEGEFAQALKEFNYLADKGFAPGIYELGKLYEGGYGVTRDYRKAAQLYQQGVAKNHPDSMFALAVLYDEGNGVKLDKQMAIKLFEQAANKNLPAAQFNLGVMYANGDGVSVDYELAKTWYEKAAANNYTLAQFNLALMYFEGLGMPKNLEKSYIWNTIAEYNGNMQASHSRKLDEQKMLPKEVEEAKEKADAIYTRILAGTYAGEGRLF

SEQ ID NO: 53111 - DNA, 2916 bp, Rhodobacter sphaeroides 2
  CDS (1)..(2916): transl_table=11
atgcccggggcagagcagcgatggccggcgcgggcggctctcctgctcgtgctgatcgctgcggccgggctggcgcgggggcaggagacaccctccggcccgccgccgcgggtagcgatggtggtcggcaattccgcctatcagaacgtgccggccctgcccaatcccgcgggcgacgcggaactcgtggcggagaagctgtgggaatcgggcttcgaggtcatcgagacggtggacgccgaccgcgagaccatgctcgccgatctcgcgaccttccgcagccgcctgcgcgagggcagcgaggcgctcttcttctacgcgggccacggggtgcagatcggcgggcggaactacctgctgccggtctcggtcgccccttcctcggtcgaggacctgaaggcgcaggccatcgatgcgcagctctttctcgatgtgatggcgcagtcgggcgcgcggctgacgctcgtgctgctcgacgcctgccgcaacaatccgttcctcgacattccctccgacggcgccgaggccatcgccacccgcgccctctcgatcggcgcctcgcgtgcggcggtggagcgggggctccgcgatctggcggcggccagccggggcggtctggccgagatgtcggccggtcgcggcgaggcgctcatcagctttgccaccgcgcccggacaggtcgccttcgacgggcgcggacggcacagcccctataccagcgcgctcgccggcagcatcgacgagccggggctcgaactcgtcgacctcttccgccgggtgcggggcgcggtgcgcgaggcgaccggcgggcagcagatcgcctggacggcgagcacgctcgagagccgcttctatttcaagccgccagccgacgatctgcgctctgccaccaccggcatgagcaccgggtcggacacgctcggcgcgctgccgccacggcgggtggtggaccgcaccttctggcgcgcaatccgcgacacggaccggctcgacgccttcaccgcctatgtccgcaccatgccggacggcgccttcgtcgccgaggcgaaggagaagatccgcagcctcggcggcgatcccgaggcgatcccggtctcggacctgtcgctgccggagcggccgcgcggcttcgtgttggccgatcctgcggcgcaggccgatctcgcggcgacgctcgaccgggcgcccgcatcggtgcccatcggaacgggggcggcccgcatcggcgccgcagccggcagggcgggctgggttcatgtggccgcagccccgcgtctcggcgcggtctcggccggcggcacccgcctcgaggcgggctcggtgcgctggatggaggcggaccagccgctcgactacctccccggcatcggctcgaacggcgggctcgacagtctccgggccgaagccctgcgcgagggcggcacgaccgaaccccttgaggctgcggtcgaaacctatgtcgacgcctgcgacatgctcgcgggcaacccctacgacagccagcgcgtcactgccggcacgcgccagttcatcctcgaccgcaaccacgacgccgccatcgcggtctgcgagatcgccgtcgcgcgccatccggaggtggtccggttctgggccgaactcgcgcgcagctaccgcgccgcgggccgctacgaggaggcgctccactggcagcagaaggcggtcgacgcgggctatgcctcggcgatggtctatctcgggcagatgttcctcgacggccaggccgtgccgcaggacttcgaccgtgcgcgggagctgttcgaggcggccgatgcccgcggcgagacggcggcgctgacggcgctggcctggatccaccgggcgggggtgggtgtgccggaggatccggcccgggcgctcgacttctaccggcagggggcggcgcgcggcaacgactgggcgatgaccaacatcggcgagttctaccagaagggcctgagcgtcgcccgggatccggccgaagcggtgcgctggtatacggccgcggccaagagcggcgagctgaccgcccagacgcggctcgcgcggatgtatcagaccggcgacggcattgcggtggatgaggcgcaggcccgcttctggttcgagaccgccgcgggccggggcgtgccgaatgcgctgacccgtctcggcctcatgtatgagcagggtcagggggtggaccgggatctcgaggcagcggcgcgtctttacggccgggcggctgccgagggcgacgccgaggcctggctgcggctgggccggctcgaagcctcggacgcgccgctgttcgaccggcccgagcgcgccctgccgctgctggagaaggcgctcgcggcgcaggtgccgggcgccgcgcgcgagctcgggcgtctctacgagacggggcgcggcgtgacgaaggatctggcccgcgcccgcgcgctctatgtgcaggaggcgggcgcgaacccctgggccgcgcgcgacgccgggcgcgccttcgcctcggatgagggcgcgcccgccgatccggcgcaggcggcccgctggtatcgggccgcggccgagggcggggttccgtgggcggctctcgatctcgggcggctctacgagaccggccgcggtgtgccgcaggaccggaccgaggcgctggtcctctatgccgcggccgcgcgtcccggaggcgatgccagggcggccgacgccgcccgccgcgccgccgccggctattcggccgaggagacgatccgggcagcgcagctgctgcttggtcgcctcggcgccgaggtgggcgcgcccgacggccggatcggccccgcgacgcgggacgcgctcgcccgcgtctttgccgcgcaggggcgggccgcgcccggcacccgcatcgacttcgacctgctggccgagctttcggcgatggatgaggagagactgccatga

SEQ ID NO: 53112 - protein, 971 aa, Rhodobacter sphaeroides 2
MPGAEQRWPARAALLLVLIAAAGLARGQETPSGPPPRVAMVVGNSAYQNVPALPNPAGDAELVAEKLWESGFEVIETVDADRETMLADLATFRSRLREGSEALFFYAGHGVQIGGRNYLLPVSVAPSSVEDLKAQAIDAQLFLDVMAQSGARLTLVLLDACRNNPFLDIPSDGAEAIATRALSIGASRAAVERGLRDLAAASRGGLAEMSAGRGEALISFATAPGQVAFDGRGRHSPYTSALAGSIDEPGLELVDLFRRVRGAVREATGGQQIAWTASTLESRFYFKPPADDLRSATTGMSTGSDTLGALPPRRVVDRTFWRAIRDTDRLDAFTAYVRTMPDGAFVAEAKEKIRSLGGDPEAIPVSDLSLPERPRGFVLADPAAQADLAATLDRAPASVPIGTGAARIGAAAGRAGWVHVAAAPRLGAVSAGGTRLEAGSVRWMEADQPLDYLPGIGSNGGLDSLRAEALREGGTTEPLEAAVETYVDACDMLAGNPYDSQRVTAGTRQFILDRNHDAAIAVCEIAVARHPEVVRFWAELARSYRAAGRYEEALHWQQKAVDAGYASAMVYLGQMFLDGQAVPQDFDRARELFEAADARGETAALTALAWIHRAGVGVPEDPARALDFYRQGAARGNDWAMTNIGEFYQKGLSVARDPAEAVRWYTAAAKSGELTAQTRLARMYQTGDGIAVDEAQARFWFETAAGRGVPNALTRLGLMYEQGQGVDRDLEAAARLYGRAAAEGDAEAWLRLGRLEASDAPLFDRPERALPLLEKALAAQVPGAARELGRLYETGRGVTKDLARARALYVQEAGANPWAARDAGRAFASDEGAPADPAQAARWYRAAAEGGVPWAALDLGRLYETGRGVPQDRTEALVLYAAAARPGGDARAADAARRAAAGYSAEETIRAAQLLLGRLGAEVGAPDGRIGPATRDALARVFAAQGRAAPGTRIDFDLLAELSAMDEERLP

SEQ ID NO: 53113 - DNA, 726 bp, Nitrosococcus oceani ATCC 19707
  CDS (1)..(726): transl_table=11
atggataaaaaccctagaactcattatcgaaatgaaactggcgtatggtcattcctgggagcgatattgtttttgggcttcttacaagtcgcccaagcggatgttgatgctggaagggaagcctataagagccaagattatgagctcgcgcttaaggaatttatgccccttgctgaacaaggcgatgaaaatgcgcagttttatatgggtttgatgtacgccaatggatatggtttgcccaaggacccggaagaggctgacaaatggtttgagaagtttagtgagcatcttgatgtgagtgccaaattcaatctgggcatcatgtactatcaaggcaaatcggtaccaaaaaacgttgaaaaagctattgcttggtttaaaaaggcggcggcagagggagatgccgaagcccagtttaatttgggttttatctatgataacgggtatggcgttccccaggacagagaagaggcgctcaaatggtaccgggatgcagctaatcagggaattgtggaggcgcagaataatctgggcgtgatgtatagcgaaggtcagggaatagcaaaggattatgtacaagcctatttctggttcaatgtagcagcgaaacaaggagataaaaatgcagagaagatcagagatacccttgctaaggatatgaatacctcgcaaatggcagaggctataaagcttacccacgaatggcaattggcctcagggcactaa

SEQ ID NO: 53114 - protein, 241 aa, Nitrosococcus oceani ATCC 19707
MDKNPRTHYRNETGVWSFLGAILFLGFLQVAQADVDAGREAYKSQDYELALKEFMPLAEQGDENAQFYMGLMYANGYGLPKDPEEADKWFEKFSEHLDVSAKFNLGIMYYQGKSVPKNVEKAIAWFKKAAAEGDAEAQFNLGFIYDNGYGVPQDREEALKWYRDAANQGIVEAQNNLGVMYSEGQGIAKDYVQAYFWFNVAAKQGDKNAEKIRDTLAKDMNTSQMAEAIKLTHEWQLASGH

SEQ ID NO: 53115 - DNA, 2043 bp, Nitrobacter winogradskyi Nb
  CDS (1)..(2043): transl_table=11
atgctttcatccagatcgcttctccagtgggttcgtcgtccggttcttgggccttctcgcggtggcctcttcgagcatggaatgggcgcgtatgagcgcggcgagtatcttgaagcggtcaggtgctggaagctggcgctggaggcgggcgaggccgaggccgcctatcggatcggaaggctttatgtgaaaggcgaaggggtcgtcaggagcgtgccagatgccgcgatctggtatgagcgcgcggcccggctgggccatgtcgacgcgcagtttcaactcggcctgatctttctgcagggggagaagccgctgctgggcccgcatcgccacgaaacatggcgccagtcctcggccatacgtctcggcgacaaggcgtcgaacatacaccagcttgtgtttccgcatggaacgagcgttgagcggaatgttgacgctgcgtttcactggatatcggccgcggcggacaaaggcaaagccgaagcgcagacggtcctcggcaatatgtacagtgagggattaggctgcgagaagaatctccagatagcgcttgcatggtatggggttgcggccgagcagaactgtgctgccgcggaattcgctctcggcgatattcattttcagggcaaaggggttcccgtcgacttcgagcaggccgcggtctggtatcgcaaggcggccgagcaggatcacgtcagggcgcaggtcgcgctcgcgttcatgaacctgaagggaacgggaatgccggagaaccctgcggaagcggcacgcctgttccagggcgctgcgatgcatgacgatatcatcgcgctgtacaacatcggcttgttacgcctgaagggccatggcgtcgcgaaggatatcgacaaggctgaaaccgcgctgcgcaaggcggcgcgcaaggattactttcccgcgattcaggcgctggcggaattctattcgcacggcggaggatttgctccggatcttcgggaggccgcggtctggtatgagaaggccgccgagcgggacgacgtacaggcgcaattcttcatgggccgattctatgcgatgggcaccggcgtcggcccgaacattcgtcaggctgcaaaatggttcgagcgcgcggcccgcaacggtcacgcgactgccgcgttcaacatcgccattttttatctcaacggatccggcgtcgaacgcgatgtagaccgcgcgatcgaatggttcgagcgcgcgtccgaaggcggcatccgcgccgcgcagctgcagctcggaaaactttattcggcaggcaacggtgtgccgcgcgatcagaagctggcaagagaatggctcggcaaggccgccaacggcggagacccggacgcccagacggcctatgcgcttttcctgcttcgtcaggatggttcagcggaacagctcgagcaggcaaaggcgctgctggtcgaggcggccgaggccgatcacgcgccggctgcgttccagctcggcgtgctgcatatgggcaagttcgggggagaaacagacatcgcggccgccgttccatggttcgcacgcgccgccggcgcggggcatgtcgatgcacaatatacccttgcgctgcttcatctcgatccgggcagcggcatgagtgacgcgaaggctgccgcgtcatggatgacgaaggccgctcatgcgggccatgccggcgcgcagtttcagctcgccgtgctgtattgcaccggcgccggcctggctcaggatgtcgcgcaaggggtgaggtggtacgaggccgccgcgcaacagggacacaggatcgcgcagttcaacctcgcggtgatgcttggaaaaggacagggatgcgaggtcgacctcgggaaggcggtcgaatggttcgagaaggcggcccggcaggatgtggcggaagcgcagattgcgctcggcgacgcgttgatgtcgggaagcggcgtgacgaaggatcaggatgcggcggtgcagtggtatcgccgggcggccggtcacaaccatgaaggcgcccggcaccgtctgaatgcgatcggcgtaacgacggtcgatggctga

SEQ ID NO: 53116 - protein, 680 aa, Nitrobacter winogradskyi Nb
MLSSRSLLQWVRRPVLGPSRGGLFEHGMGAYERGEYLEAVRCWKLALEAGEAEAAYRIGRLYVKGEGVVRSVPDAAIWYERAARLGHVDAQFQLGLIFLQGEKPLLGPHRHETWRQSSAIRLGDKASNIHQLVFPHGTSVERNVDAAFHWISAAADKGKAEAQTVLGNMYSEGLGCEKNLQIALAWYGVAAEQNCAAAEFALGDIHFQGKGVPVDFEQAAVWYRKAAEQDHVRAQVALAFMNLKGTGMPENPAEAARLFQGAAMHDDIIALYNIGLLRLKGHGVAKDIDKAETALRKAARKDYFPAIQALAEFYSHGGGFAPDLREAAVWYEKAAERDDVQAQFFMGRFYAMGTGVGPNIRQAAKWFERAARNGHATAAFNIAIFYLNGSGVERDVDRAIEWFERASEGGIRAAQLQLGKLYSAGNGVPRDQKLAREWLGKAANGGDPDAQTAYALFLLRQDGSAEQLEQAKALLVEAAEADHAPAAFQLGVLHMGKFGGETDIAAAVPWFARAAGAGHVDAQYTLALLHLDPGSGMSDAKAAASWMTKAAHAGHAGAQFQLAVLYCTGAGLAQDVAQGVRWYEAAAQQGHRIAQFNLAVMLGKGQGCEVDLGKAVEWFEKAARQDVAEAQIALGDALMSGSGVTKDQDAAVQWYRRAAGHNHEGARHRLNAIGVTTVDG

SEQ ID NO: 53117 - DNA, 3180 bp, Nitrobacter winogradskyi Nb
  CDS (1)..(3180): transl_table=11
atgaattcgcggggatcgtcgagcgacgacggaatcgaaacatccgatcgcgagggagcggacgctgccgcgcggcgcgccggcacatcccgcgacgacggaccgggttccggttccggcggcaccccgccgggtccgacgcagccggcggcatctccccagaacagccccgagatgagggacattcatcaacggctagattccatcacccgccagatcgatcagttggcaagcccggccgagaacggcgaacccgcggtcgcccgtcagctcaacgacgccatttcgcggctcgatgcccggctcgcccgggtcacggcccagacacccgcagcgaacccgcagcaacggggcgcgagcggaagctacgaccgaccgacatcaccggacctcgtcacgctcgaatccgcgatcgcggagatcgccgcgcgccagcatgaactcgatgagacgccgcgcgcgccatcctcatacagctcagcccccgttgcgtccgcgatgagaacgtcgcgacaggcggatttctccagcctcgaacggcaactcttcaagatcacgagccagatcgaatccctgcaacgccccgacgggatcgagcagtcgatcgccgcattccgcatcgagcttgcggatatccgtcatgtgatcaccgaggccatgccgcgcagggcgatcgaatccctcgaaaacgagattcgctcgctttcgcagcgcatcgacgaagtccgccagaacggcagcgatggtcaggcgctggcgaatatcgaacgcgccctcaaggagatctacgacgctttgcgatcgctgaagccggcggaacagctctcaggattcgacgaggccatccgcaatctcggcaacaagatcgattcgatcgtgcggggcagcggcgacagcggcatgatgcagcagcttgagagcgcgatcggcgcgcttcgcggcatcgtctcgaacgtcgcctccaacgacgcgctggagcgcctcggcaacgatctcaacatgctgtcgtccaaggtcgagcagctcggccggcccgcgggcgacggggatttctacgccgcgctcgaacagcgcatggccgcattgacgcagaccctggaaaaccgcgaaagcccggcctcgggcagcagcttcgaacaacttgaagagacggtgcgagcgctgtccgagcgtctcgaccgcctgccggccggtcacgattcgtcctcggcgctggcgcacctcgaacagcgggtctcgatgctgctcgaacgcctggagaccgcaggcgaatattcaggatcccatctcgggcgcgtcgaggaaggtttgcaggacattctgcattgcctggaacggcagcaggccggactcgcggcgatgtccgaaagcggtccgcgaagcgctgtcccgaccatggatagcgaggtcgtggaagcgatcaagcgcgaactatccgagatgcgcttctgccagtcggaaaccgaccgccatacccaggactcgctcgaggccgttcacaacaccctggagcatgtggtcgaccggctggcgatgatcgaaagcgaccttcgcgcggtacacaccatgcccgcccgtgccgagccgtcccgcggcggaataatgccggaacggacggcaaatctgccgcccaaacccgaattgccgaatccggtactgtcgcaagcggccacgcagcccacgccggcccgcaccgccacggcggcgccgatcccgcgcgccatagccgacgccctgatccccaaagagaccttcgatccggatcgcgtcgtgccatccacgacagcgccctcgccgcgccccgcgatcgacccgaagctgccgcccgatcatccactcgagcccggcacccgtccggcgggacgcgcggcaacgccgtcggagcgcatcgcggcctccgagagcgagaccggcgacgtcgccgaaaccccgcgcgagcagtcgggctcgtccttcatcgccgccgcgcgccgcgcggcgaaggcggccgccgcctccacgccgtcgcccgacaaggcgggtcgaaccaaggtcgccatcgaaccggcgcgccccgccacgggcggatcggacatcacctccaagatccgttccctgctcgttgcggcgagcgtggtggtgatcgtcctcagcagtttcaagttcgcgatgaccctgctcgacagttctccgcgcgccaccctcagcgaaagcgaccacgcggctcccgtgaccaagccgccagccgaccccgagggcagcgccggcccagagataccgcagccgccctcgatgatcgcgccgacgccgatcgatcggcaatcgatgatcgcaccgcccgccggtgacagcgcggctccggccaaaaacccctcggatgccatgccggcgagccggccggacacgccgtccgccgacgtcaccggtgcgatcccgaacggactcacgccggaaccggctgcaactccacccgccgcatcgcttcccgacagcatcggcggcacgacgctgcgttccgccgcgctccagggcgaccccgcagcctcgttcgaggtcggtgttcgctacgccgaaggaaagggcgtgaccgtcaactacgacgaagccgcgaagtggtacgaacgggcggctcatgccggcatcgtgcccgccatgttcaggcttggcgccctgcatgaaaaggggctcggcacgagcaaggacgtcgataccgcgcggcgctattacctgcaggcggcggaccggggcaatgccaaggcgatgcacaacctcgccgtgctcgatgccgatggtggcggcaagggcgccgactatgtgagcgccgcgcaatggttcagcaaggcggccgagcgtggaatagccgacagccagtacaatctcggcattctttacgcccgcggcatcggcgtcgaacagaatctcgcgaaatcctacaagtggttcagcctcgccgccgcccagggtgacgtggactcagggcgcaagcgcgatgaagtcgccaagcggctcgatccgccgtcgcttgccgccgccaagctcgcggttcaaaccttcgtggtcacgccgcagcccagcgatgcggtcagcgttcccggccccgcgggcggatgggacagcgcggctgcaaagccccgcgccaaaccggcgccgggcaaatccgcgagggcgaaccacgcgatggcgcggcataccgcgcattaa

SEQ ID NO: 53118 - protein, 1059 aa, Nitrobacter winogradskyi Nb
MNSRGSSSDDGIETSDREGADAAARRAGTSRDDGPGSGSGGTPPGPTQPAASPQNSPEMRDIHQRLDSITRQIDQLASPAENGEPAVARQLNDAISRLDARLARVTAQTPAANPQQRGASGSYDRPTSPDLVTLESAIAEIAARQHELDETPRAPSSYSSAPVASAMRTSRQADFSSLERQLFKITSQIESLQRPDGIEQSIAAFRIELADIRHVITEAMPRRAIESLENEIRSLSQRIDEVRQNGSDGQALANIERALKEIYDALRSLKPAEQLSGFDEAIRNLGNKIDSIVRGSGDSGMMQQLESAIGALRGIVSNVASNDALERLGNDLNMLSSKVEQLGRPAGDGDFYAALEQRMAALTQTLENRESPASGSSFEQLEETVRALSERLDRLPAGHDSSSALAHLEQRVSMLLERLETAGEYSGSHLGRVEEGLQDILHCLERQQAGLAAMSESGPRSAVPTMDSEVVEAIKRELSEMRFCQSETDRHTQDSLEAVHNTLEHVVDRLAMIESDLRAVHTMPARAEPSRGGIMPERTANLPPKPELPNPVLSQAATQPTPARTATAAPIPRAIADALIPKETFDPDRVVPSTTAPSPRPAIDPKLPPDHPLEPGTRPAGRAATPSERIAASESETGDVAETPREQSGSSFIAAARRAAKAAAASTPSPDKAGRTKVAIEPARPATGGSDITSKIRSLLVAASVVVIVLSSFKFAMTLLDSSPRATLSESDHAAPVTKPPADPEGSAGPEIPQPPSMIAPTPIDRQSMIAPPAGDSAAPAKNPSDAMPASRPDTPSADVTGAIPNGLTPEPAATPPAASLPDSIGGTTLRSAALQGDPAASFEVGVRYAEGKGVTVNYDEAAKWYERAAHAGIVPAMFRLGALHEKGLGTSKDVDTARRYYLQAADRGNAKAMHNLAVLDADGGGKGADYVSAAQWFSKAAERGIADSQYNLGILYARGIGVEQNLAKSYKWFSLAAAQGDVDSGRKRDEVAKRLDPPSLAAAKLAVQTFVVTPQPSDAVSVPGPAGGWDSAAAKPRAKPAPGKSARANHAMARHTAH

SEQ ID NO: 53119 - DNA, 2220 bp, Mus musculus
  CDS (80)..(2146)
gacagacctgagaagaggaagcttgtgggccagccacctaattcagcccgtgttaaagtaaaaaggagctgcttaggagatgaatcccttggctttgttagtagagatattgatcattatcgaggtcacaaccaaaaatactgaagcagaaagatataacagaaaacaaaaagaagtgaatgtcaccacacaggtatcagtgagcaaagtcaagcaatttttattgtatctactggaacaaggaaacgcaaataaaataaccaataaaagagaaaatcccttagaaaaaaagaagcatcaacataagttaaaaataaaaggaattcaaaataagaatctcctgaagagaaatcaaaactacttcaaaaacccagccaagaaaagtatcacagatgaaggagatgagttatttaaaatgggcaacaagattctccaggagtctaaaagccaaaaacaaaaaacagaagcctacacactcttcaccagagcagccaacatgggaaatttgaaagctatggaaaaaatggctgatgcttggctatttggaagtttcggcatgcaaaacataacagcagctattcagttatatgagtccttggctaaagaaggatcatacaaagcccaaaatgcattaggatttttatcttcatatggaataggaatggaatatgaccaagccaaggcactgatatattatacctttggaagtgctggaggaagcatgatgtcccagatgattctggggtacagatacttgtcaggaattaacgttctgcaaaattgtgaagttgccctaaatcattacaagaaagtggcagattatattgctgataaattggaaaaaagtgaaggtattcccgtggaaaaagtgaggctaaccgagagacctgagaatctgagttccaacagtgagattttggattgggacatataccaatactataaatttttggcagaaagaggagatgttcagatacaagtatctcttggacaattacatctaattgggagaaagggactagatcaagattacagtaaggcgttatactactttctaaaggcagcaaaagccgggagtgcaaatgccatggcatttataggaaagatgtattttgaagggaatgctgctgcaccacaaaataacgccactgccttcaaatacttctccatggcggccagcaagggcaacgcaattggccttcatggacttggtctcctttacttccatggaaaaggtgttcctgtgaattatggtgaagcacttaaatacttccagaaagctgcggagaagggatggcctaatgcacagttccagctgggcttcatgtactactctggctctggagtatggaaggattataagcttgccttcaaatacttttacttggcatctcagagtgggcagcctcttgccatttattatctagccgagatgtacgcaactggcactggagtgctgagatcatgcagaacggccgtggagctttacaaaggtgtctgtgaactaggccactgggctgagaaattcctaacggcctatttcgcctataaggatggggacatagactcttctcttattcagtatgcattgcttgccgaaatgggatatgaagtagctcaaagcaattcagcattcattttggaatctaaaaaagctaaaattctggggaaagagaagttgtatccaatggcacttctgctatggaaccgagccgccattcaagggaacgcttttgctagagtaaaaattggagattaccattactatggctacgggactaagaaggactacgaaacagcagccacacactacagcatcgcagcagacaagcatcacagtgcacaagcaatgttcaacctggcatatatgtatgaacatggcttgggtattgcaaaggacattcacttggccagaagattgtacgacatggctgctcagacaagcccagatgctcacatacctgtgttctttgcccttatgaaactggaaaccatgcatctgctccatgatatcctgttttttaattttaccatgaaatggaaatggctgaaactggacagcactgttggaccatactgggatttattggtgattggcctaattgttgccatgctgatcttcctgcttagaaatcgccataggtaggctctagaccatcagataacctacttataggttcatgccaagctatcctcaccaaataaagaatttcctcatcc

SEQ ID NO: 53120 - protein, 688 aa, Mus musculus
MNPLALLVEILIIIEVTTKNTEAERYNRKQKEVNVTTQVSVSKVKQFLLYLLEQGNANKITNKRENPLEKKKHQHKLKIKGIQNKNLLKRNQNYFKNPAKKSITDEGDELFKMGNKILQESKSQKQKTEAYTLFTRAANMGNLKAMEKMADAWLFGSFGMQNITAAIQLYESLAKEGSYKAQNALGFLSSYGIGMEYDQAKALIYYTFGSAGGSMMSQMILGYRYLSGINVLQNCEVALNHYKKVADYIADKLEKSEGIPVEKVRLTERPENLSSNSEILDWDIYQYYKFLAERGDVQIQVSLGQLHLIGRKGLDQDYSKALYYFLKAAKAGSANAMAFIGKMYFEGNAAAPQNNATAFKYFSMAASKGNAIGLHGLGLLYFHGKGVPVNYGEALKYFQKAAEKGWPNAQFQLGFMYYSGSGVWKDYKLAFKYFYLASQSGQPLAIYYLAEMYATGTGVLRSCRTAVELYKGVCELGHWAEKFLTAYFAYKDGDIDSSLIQYALLAEMGYEVAQSNSAFILESKKAKILGKEKLYPMALLLWNRAAIQGNAFARVKIGDYHYYGYGTKKDYETAATHYSIAADKHHSAQAMFNLAYMYEHGLGIAKDIHLARRLYDMAAQTSPDAHIPVFFALMKLETMHLLHDILFFNFTMKWKWLKLDSTVGPYWDLLVIGLIVAMLIFLLRNRHR

SEQ ID NO: 53121 - DNA, 2469 bp, Xenopus laevis
  CDS (1)..(2469)
atggggggcaggactgtgcgctttctgctgttgctcgtctgctactgtggcttcctggaggtgttgtcagggatccaccgggtcgccgctgatgttcccaagggtagtgatgatccacagacatcagaagatcatgaatctgcataccccactggagacctaaaggaggagcgcaatatgctcccagaggcacaggacaaagatggagccatatttgataaaaatgaagttcaaaaggacaaacctgagcacccagacttgaattctgaaacaaatctaaaatcttttgaattacctactgtaaagctcattccaacagaggattttcagtctgaagatgaaaatgaaagaaatgagaaggaacaaactggcacacagacaagggagctgcaaaaaccagatccccaaatcctagtcttgggcggcactgctgagggagaagcatgtcgttttccattcttgtttctggataaagaatacacagagtgcacgacggatgggcgggaagatggcagactttggtgtgcaaccacttatgactacaagagtgacttgaagtggggattctgtgaaaagcagtccaataagagacatcagatgcaggaagcagaggacctttaccaactgggcatgaagatgctaaacgagagcagcaaaaggtcacagaagaaggaagccttccagtattttatgaaagcatctgacatggaccacatcaaggcaatggagatggtggcctatgcactgctctttggggatcctataaagcaaaatattacttctgctaaagagtttctagagaaactgtcagaacaagggtcacctcgtggtcagatggctcttggttttttatatgcatcgggtctgggtctaaattccagtcaagcaaaggctcttgtgtattacacatttggtgcactagggggtaacctcattgctcatatgattttgggctatcgatactgggctgggattggagtgctgcagagctgtgaatctgctctcacacattatcgtcttgtagcaaaccatgttgctagtgacatctcactgacaggtggcactgttgtacaaaggattcggctggcagatgaagtggaaaatccaggcatggccagtggaatgcttgaggaagatttgatccagtattaccagtttctggctgagaaaggagatgtccaggctcaggttggtctgggacagcttcatctgcatggagggcgtggtgtggaacaaaatcatcagagggcttttgagtattttaatcaagcagcaaatgcaggaaactcccatgcaatggcttttctaggaaagatgtattctgaaggaagtgattcggtgactcagagtaatgaaactgcacttcagtatttcaggaaagcagcagacatgggaaaccctgttggccagagtggacttggcatggcttatctatatggacgaggagttcctgttgactatgaactggctttgaaatacttccagaaggcagccgaacaagggtgggtggatggccagcttcagcttggatcaatgtattacaatggcattggtgtaaagaaagattacaaacaagccctgaaatattttaacctggcatcacaaggggggcacattttggctttctacaaccttgcccagatgcatgcgactggcacaggggtgatgagatcttgccacactgctgttgaattgtttaagaatgtatgtgagcgtgggcgttggtcagatagacttatgactgcctataacagctacaagaatggcaatgccaatatagccgcagtgcaatacctgcttctggccgaacaggggtatgaggtggcccagagcaatgcggctttcatcctagaccagaaagaagcagctatatttggagagaatgaaacctttcctagagctcttttacactggaatcgggcagcctcgcaaggttacaccctagccaggattaagctaggtgattatcatttctatggctacggaacagatattgactacgagactgcatttattcattatcgcctggcctctgaacagcagcacagcgcccaagccatgttcaacctgggatatatgcatgagaagggcctgggaatcaagcaggacatccatcttgctaaacgtttctatgacatggctgctgaagccagcccagatgctcaggtgccagtgtttctagcactgtgtaaacttggagtgctttattcactacagtttctgcgtgatgtgaatgttaaagaaatggccttccagttggatatggaccagttgctgggaccagagtgggacttgtaccttatgaccatcatcgctctgttgctcgggacagtcattgcatatagacaacggcagcctcaagttgttttaagacccccaacgccagctccaagagcagcacctcaggacccaccccctccacagccagagcaaccccaacaacaacaggaagtccagcaaccacagtga

SEQ ID NO: 53122 - protein, 822 aa, Xenopus laevis
MGGRTVRFLLLLVCYCGFLEVLSGIHRVAADVPKGSDDPQTSEDHESAYPTGDLKEERNMLPEAQDKDGAIFDKNEVQKDKPEHPDLNSETNLKSFELPTVKLIPTEDFQSEDENERNEKEQTGTQTRELQKPDPQILVLGGTAEGEACRFPFLFLDKEYTECTTDGREDGRLWCATTYDYKSDLKWGFCEKQSNKRHQMQEAEDLYQLGMKMLNESSKRSQKKEAFQYFMKASDMDHIKAMEMVAYALLFGDPIKQNITSAKEFLEKLSEQGSPRGQMALGFLYASGLGLNSSQAKALVYYTFGALGGNLIAHMILGYRYWAGIGVLQSCESALTHYRLVANHVASDISLTGGTVVQRIRLADEVENPGMASGMLEEDLIQYYQFLAEKGDVQAQVGLGQLHLHGGRGVEQNHQRAFEYFNQAANAGNSHAMAFLGKMYSEGSDSVTQSNETALQYFRKAADMGNPVGQSGLGMAYLYGRGVPVDYELALKYFQKAAEQGWVDGQLQLGSMYYNGIGVKKDYKQALKYFNLASQGGHILAFYNLAQMHATGTGVMRSCHTAVELFKNVCERGRWSDRLMTAYNSYKNGNANIAAVQYLLLAEQGYEVAQSNAAFILDQKEAAIFGENETFPRALLHWNRAASQGYTLARIKLGDYHFYGYGTDIDYETAFIHYRLASEQQHSAQAMFNLGYMHEKGLGIKQDIHLAKRFYDMAAEASPDAQVPVFLALCKLGVLYSLQFLRDVNVKEMAFQLDMDQLLGPEWDLYLMTIIALLLGTVIAYRQRQPQVVLRPPTPAPRAAPQDPPPPQPEQPQQQQEVQQPQ

SEQ ID NO: 53123 - DNA, 1164 bp, Homo sapiens
  CDS (1)..(1164)
atgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagaaaaggctaacattcttgaaaaagagaagatgtatccaatggcgcttctcctatggaatcgagctgccattcaaggcaatgcatttgctagagtaa

SEQ ID NO: 53124 - protein, 387 aa, Homo sapiens
MGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVEKRLTFLKKRRCIQWRFSYGIELPFKAMHLLE

SEQ ID NO: 53125 - DNA, 1785 bp, Homo sapiens
  CDS (1)..(1785)
atgcaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagctttataaaggtgtctgtgaactaggccactgggctgagaaattcctgacagcttactttgcctataaggatggtgatatagattcttctcttgttcagtatgcactgcttgcagaaatggggtatgaagtagctcaaagcaattcagcattcattttggaatctaaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtag

SEQ ID NO: 53126 - protein, 594 aa, Homo sapiens
MQKQAEKNFTDEGDQLFKMGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVELYKGVCELGHWAEKFLTAYFAYKDGDIDSSLVQYALLAEMGYEVAQSNSAFILESKKANILEKEKMYPMALLLWNRAAIQGNAFARVKIGDYHYYGYGTKKDYQTAATHYSIAANKYHNAQAMFNLAYMYEHGLGITKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 53127 - DNA, 978 bp, Helicobacter pylori
  CDS (1)..(978): transl_table=11
atgttaaggggtgtcaaaaaagcggtttttagggttttgtgtttgggggcgttgtgtttaggggggttaatggcagatcaagaccctaaagagcttatattttcaggtatcactatttacacggataaagatttcactagggctaaggaatactttgaaaaagcttgtaaattaaacgatgctgatggttgcacgatcttaaaagaggcttattctaaagtcatcctaaaaggaagtgcaagagagagcattgaaaaagccattgaacacacggctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgtaacacaaaattttaaaaaagctttcaaatattactctaaagcttgcgagttgaataatggtgaagggtgttctaaattaggaggggattattttcttggtgaaagcgtaacgcaagatcttaaaaaagcttttggatattactctaaagcttgcgaattaaacgaggctctaacatgcacgcttgtaggagagttttatcgtgatggtgaaggcgtaacaaaggatcttaaaaaagcttttgaatattctgctaaagcttgtgaattgaacgatgctaaagggtgttacgctctagcagcgttttataatgagggtaaaggcgtagcaaaggatgaaaagcaaacgacagaaaaccttgaaaagagttgcaagctaggattaaaagaagcatgcgatattctcaaagaacaaaaacaataa

SEQ ID NO: 53128 - protein, 325 aa, Helicobacter pylori
MLRGVKKAVFRVLCLGALCLGGLMADQDPKELIFSGITIYTDKDFTRAKEYFEKACKLNDADGCTILKEAYSKVILKGSARESIEKAIEHTATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGYYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53129 - DNA, 978 bp, Helicobacter pylori
  CDS (1)..(978): transl_table=11
atgttaaggggtgtcaaaaaagcggtttttagggttttgtgtttgggggcgttgtgtttatgggggttaatggcagagtcaaaccctaaagagcttatatttttaggtatcactatttacacggataaagatttcactagagctaaggaatactttgaaaaagcttgtagattaaacgatgctgatggttgcgcgatcttaagagaggcttattctaaagtcatcctaaaaggaagtgcaagagaaagcattgaaaaagctcttgaacgcaccgctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttaaaaaaagataaaaaagatctagaatattattctaaagcttgcgagttaaactatggcgatggctgtgcgattttaggggatatttatcataatggtgaaggcgtaacacaaaattttaaaaaagctttcaaatattactctaaagcttgcgagttgaataatggtgaagggtgttctaaattaggaggggattattttcttggtgaaagcgtaacgcaagatcttaaaaaagcttttggatattactctaaagcttgcgaattaaacgaggctctaacatgcacgcttgtaggagagctttatcgtgatggtgaaggcgtagcaaaggatcttaaaaaagcttttgaatattctgccaaagcttgtgaattgaacgatgctaaagggtgttacgctctagcagcgttttataatgagggtaaaggcgtaacaaaggatgaaaaacaaacgacagaaaaccttgaaaagagttgcaagctaggattaaaagaagcatgcgatattctcaaagaacaaaaacaataa

SEQ ID NO: 53130 - protein, 325 aa, Helicobacter pylori
MLRGVKKAVFRVLCLGALCLWGLMAESNPKELIFLGITIYTDKDFTRAKEYFEKACRLNDADGCAILREAYSKVILKGSARESIEKALERTATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGYYSKACELNEALTCTLVGELYRDGEGVAKDLKKAFEYSAKACELNDAKGCYALAAFYNEGKGVTKDEKQTTENLEKSCKLGLKEACDILKEQKQ

SEQ ID NO: 53131 - DNA, 978 bp, Helicobacter pylori
  CDS (1)..(978): transl_table=11
atgttaaggggtgtcaaaaaagcggtttttagggttttgtgtttgggggcgttgtgtttaggggggttaatggcagagcaaaactctaaagagcttatattttcaggtatcactatttacacggataaagatttcactagagctaaggaatactttgaaaaagcttgtagattaaacgatgctgatggttgtgcgatcttaagagaggcttattctaaagtcatcctaaaaggaagtgcaagagaaagcattgaaaaagctcttgaacacaccgctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgtaacacaaaattttaaaaaagctttcaaatattactctaaagcttgcgagttgaataatggtgaagggtgttctaaattaggaggggattattttcttggtgaaagcgtaacgcaagatcttaaaaaagcttttggatattactctaaagcttgcgaattaaacgaggctctaacatgcacgcttgtaggagagttttatcgtgatggtgaaggcgtaacaaaggatcttaaaaaagcttttgaatattctgccaaagcttgtgaattgaatgatgctaaagggtgttacgctctagcagcgttttataatgagggtaagggcgtagcaaaggatgaaaaacaaacgacagaaaaccttgaaaagagttgcaagctaggattaaaagaagcatgcgatattctcaaagaacaaaaacaataa

SEQ ID NO: 53132 - protein, 325 aa, Helicobacter pylori
MLRGVKKAVFRVLCLGALCLGGLMAEQNSKELIFSGITIYTDKDFTRAKEYFEKACRLNDADGCAILREAYSKVILKGSARESIEKALEHTATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGYYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53133 - DNA, 978 bp, Helicobacter pylori
  CDS (1)..(978): transl_table=11
atgttaaggggtgtcaaaaaagcggtttttagggttttgtgtttgggggcgttgtgtttaggggggttaatggcagagcaagactctaaagagcttatattttcaggtatcactatttacacggataaagatttcactagagctaaggaatactttgaaaaagcttgtagattaaacgatgctgatggttgcgcgatcttaagagaggcttattctaaagttatcctaaaaggaagtgcaagagaaagcattgaaaaagctcttgaacacaccgctactgctaaagcttgcaaatcaaacgatgctgaaaaatgcaaggacttagcagagttttattttaatgcaaacgatcttaaaaatgctttagaatattactctagatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgtaacacaaaattttaaaaaagctttcaaatattattctaaagcttgcgagttgaataatggtgaagggtgttctaaattaggaggggattattttcttggtgaaagcgtaacgcaagatcttaaaaaagcttttggatattactctaaagcttgcgaattaaacgaggctctaacatgcacgcttgtaggagagttttatcgtgatggtgaaggcgtaacaaaggatcttaaaaaagcttttgaatattctgccaaagcttgtgaattgaacgatgctaaagggtgttacgctctagcagcgttttataatgagggtaaaggcgtagcaaaggatgaaaaacaaacgacagaaaaccttgaaaagagttgcaagctaggattaaaagaagcatgcgatattctcaaagaacaaaaacaataa

SEQ ID NO: 53134 - protein, 325 aa, Helicobacter pylori
MLRGVKKAVFRVLCLGALCLGGLMAEQDSKELIFSGITIYTDKDFTRAKEYFEKACRLNDADGCAILREAYSKVILKGSARESIEKALEHTATAKACKSNDAEKCKDLAEFYFNANDLKNALEYYSRSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGYYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53135 - DNA, 978 bp, Helicobacter pylori
  CDS (1)..(978): transl_table=11
atgttaaggggtgtcaaaaaagcggtttttagggttttgtgtttgggggcgttgtgtttaggggggttaatggcagagtcaaaccctaaagagcttatattttcaggtatcactatttacacggataaagatttcactagggctaaggaatactttgaaaaagcttgtaaattaaacgatgctgatggttgcacgatcttaagagaggcttattctaaagtcatcctaaaaggaagtgcaagagaaagcattgaaaaagctcttgaacacacggctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgttacacaaaattttaaaaaagctttcaaatattactctaaagcttgcgagttgaataatggtgaagggtgttctaaattaggaggggattattttcttggtgaaagcgtaacacaagatcttaaaaaagcttttggatattactctaaagcttgcgaattaaacgaagctctaacatgcacgcttgtaggagagttttatcgtgatggtgaaggcgtaacaaaggatcttaaaaaagcttttgaatattctgccaaagcttgtgaattgaacgatgctaaagggtgttacgctctagcagcgttttataatgagggtaaaggcgtagcaaaggatgaaaagcaaacgacagaaaaccttgaaaagagttgcaagctaggattaaaagaagcatgcgatattctcaaagaacaaaaacaataa

SEQ ID NO: 53136 - protein, 325 aa, Helicobacter pylori
MLRGVKKAVFRVLCLGALCLGGLMAESNPKELIFSGITIYTDKDFTRAKEYFEKACKLNDADGCTILREAYSKVILKGSARESIEKALEHTATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGYYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53137 - DNA, 981 bp, Helicobacter pylori
  CDS (1)..(981): transl_table=11
atgttaaggggtgtcaaaaaagcggtttttagggttttgtgtttaggggcgttgtgtttacgcggggggttaatggcagagcaagattctaaagagcttatattttcaggtataactatttacacggataaagatttcactagggctaaggaatgctttgaaaaagcttgtaaattaaacgatgctgatggttgcgcgatcttaagagaggcttattctaaagtcatcctaaaaggaagtgcaagagagagcattgaaaaagctcttgaacacgcggctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgtaacgcaaaattttaaaaaagctttcaaatattactctaaagcttgcgagttgaataatggtgaagggtgttctaaattaggaggggattattttcttggtgaaagcgtaacgcaggatcttaaaaaagcttttggacattactctaaggcttgcgaattaaacgaagctctaacatgcacgcttgtaggagagttttatcgtgatggtgaaggcgtaacaaaggatcttaaaaaagcttttgaatattctgctaaagcttgtgagttgaatgatgctaaagggtgttacgctctagcagcgttttataatgagggtaagggcgtagcaaaggatgaaaaacaaacgacagaaaaccttgaaaagagttgcaagctaggattaaaagaagcatgcgatattctcaaagaacaaaaacaataa

SEQ ID NO: 53138 - protein, 326 aa, Helicobacter pylori
MLRGVKKAVFRVLCLGALCLRGGLMAEQDSKELIFSGITIYTDKDFTRAKECFEKACKLNDADGCAILREAYSKVILKGSARESIEKALEHAATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGHYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53139 - DNA, 978 bp, Helicobacter pylori
  CDS (1)..(978): transl_table=11
atgttaaggggtgtcaaaaaagcggtttttagggttttatgtttgggagcgttgtgtttaggggggttaatggcagagtcaaaccctaaagagcttatatttttaggtatcactatttacacggataaagatttcactagggctaaggaatactttgaaaaagcttgcgaattaaacgatgctgatggttgcataatcttaagagaggcttattctaaagccatagcgagcgaaaacgcaagagaaagcattgaaaaagctcttgaacacaccgctactgctaaagcttgcaaatcaaacgatgctgaaaaatgcaaggacttagcggagttttattttaatgcaaacgatcttaaaaatgctttcaaatattactctaaatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgtaacgcaaaattttaaaagagctttcaaatattactctaaagcttgcgagttgaataatggtgaagggtgttctaaattaggaggggattattttcttggtgaaagcgtaacgcaagatcttaaaaaagcttttggatattactctaaagcttgcgagttaaacgaggctctaacatgcacgcttgtaggagagttttatcgtgatggtgaaggcgtaacaaaggatcttaaaaaagcttttgaatattctgccaaagcttgtgaattgaatgatgctaaagggtgttacgctctagcagcgttttataatgagggtaaaggcgtagcaaaggatgaaaagcaaacgacagaaaaccttgaaaagagttgcaagctaggattaaaagaagcatgcgatattctcaaagaacaaaaacaataa

SEQ ID NO: 53140 - protein, 325 aa, Helicobacter pylori
MLRGVKKAVFRVLCLGALCLGGLMAESNPKELIFLGITIYTDKDFTRAKEYFEKACELNDADGCIILREAYSKAIASENARESIEKALEHTATAKACKSNDAEKCKDLAEFYFNANDLKNAFKYYSKSCKLNNVEGCMLSATFYNDMIKGLKKDKKDLEYYSKACELNYGDGCAILGDIYHNGEGVTQNFKRAFKYYSKACELNNGEGCSKLGGDYFLGESVTQDLKKAFGYYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53141 - DNA, 978 bp, Helicobacter pylori
  CDS (1)..(978): transl_table=11
atgttaaggggtgtcaaaaaagcggtttttagggttttgtgtttgggagcgttgtgtttaggggggttaatggcagagcaagactctaaagagcttatattttcaggtatcactatttacacggataaagatttcactagagctaaggaatactttgaaaaagcttgtaaattaaacgatgctgatggttgtgcaatcttaagagaggcttattctaaagccatagcgagcgaaaacgcaagagaaagtattgaaaaagccattgaacacacggctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgagttaaactatggcgatggctgtgcgattttaggggatatttatcataatggtgaaggcgtaacacaaaattttaaaaaagctttcaaatattactctaaagcttgcgagttgaataatggtgaagggtgttctaaattaggaggggattattttcttggtgaaagcgtaacgcaagatcttaaaaaagcttttggatattactctaaagcttgcgagttaaacgaagctctaacatgcacgcttgtaggagagttttatcgtgatggtgaaggcgtaacaaaggatcttaaaaaagcttttgaatattctgctaaagcttgtgaattgaacgatgctaaagggtgttacgctctagcagcgttttataatgagggtaaaggcgtagcaaaggatgaaaagcaaacgacagaaaaccttgaaaagagttgcaagctaggattaaaagaagcatgcgatattctcaaagaacaaaaacaataa

SEQ ID NO: 53142 - protein, 325 aa, Helicobacter pylori
MLRGVKKAVFRVLCLGALCLGGLMAEQDSKELIFSGITIYTDKDFTRAKEYFEKACKLNDADGCAILREAYSKAIASENARESIEKAIEHTATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFLGESVTQDLKKAFGYYSKACELNEALTCTLVGEFYRDGEGVTKDLKKAFEYSAKACELNDAKGCYALAAFYNEGKGVAKDEKQTTENLEKSCKLGLKEACDILKEQKQ

SEQ ID NO: 53143 - DNA, 612 bp, Mucor circinelloides
  CDS (1)..(612)
atgtactatcgattggctgctgaacaaggaaacgcatttgctcaaaactctctggggtactgctatgaggatggaattggtgttcctcaggacaagacggtcgctgctgactggtatcgccagtctgctgaacagggctatccatgggctcaatgcaacttgggttattgccatcaaaatggcattggcgcagaaaaggacactgtcaagggtgcttattggtatggacaagctgctcgccagggccatgctcgtgctcaacacaacttgggcttctgctaccacaatggcattggtgtcactagaaacttgcagatggcagtcgcttggtacaagaaatcagctaatcagggcaacatttttgcataccattctttgggctactgcttccaaaatggtcttggtgtggaagtcaacttgagagaaagctgttattggtactttcgtagtgctgaacacaaccatgcgcctgcccaactctctttggggctctgcttccgtaatggtatgggcgtccagaagaatgaagaagaggcttgtaaatggttccgtctctctgcgttgcaaggcaatcctttggctcaaaattcgcttggtttctgctatgaatag

SEQ ID NO: 53144 - protein, 203 aa, Mucor circinelloides
MYYRLAAEQGNAFAQNSLGYCYEDGIGVPQDKTVAADWYRQSAEQGYPWAQCNLGYCHQNGIGAEKDTVKGAYWYGQAARQGHARAQHNLGFCYHNGIGVTRNLQMAVAWYKKSANQGNIFAYHSLGYCFQNGLGVEVNLRESCYWYFRSAEHNHAPAQLSLGLCFRNGMGVQKNEEEACKWFRLSALQGNPLAQNSLGFCYE

SEQ ID NO: 53145 - DNA, 588 bp, Haemophilus influenzae biotype aegyptius
  CDS (1)..(588): transl_table=11
atgaaattgacaaaaacactgtttactagcgcattgttaggtgcctctattctttcttttcatccaactgtggcagctatggatttcggaacacaagtgggtatagatgcttataggaagaatgatttcgcacaggctgcagaacagtttaaagatgcaggtattgtgagaggagatcctacagcgcaattatttttggggagaatgtattataatggggaattttttaagcaagattatgttgaggcagctaaatggtatcgtaaagctgcagagcagggggaggagtttggtttacttttcttaggtgagacgtatgaagatggagaaggtgtagaaaaagattatgctgaagcagcaaaattgtatagaaaggctgcagagcaggggagtgcagaaggtcaaatggccttaggtaaaatgtacagatttggaaacggtgtagaaaaagattatgctgaggcaataaagttgtatagaaagtctgcagagcaaggaaatttcacggcactatttttcttaggtgagatgtatgataatggagtaggcgttaaacaaaataaagccgaaagccaaagaattatttaa

SEQ ID NO: 53146 - protein, 195 aa, Haemophilus influenzae biotype aegyptius
MKLTKTLFTSALLGASILSFHPTVAAMDFGTQVGIDAYRKNDFAQAAEQFKDAGIVRGDPTAQLFLGRMYYNGEFFKQDYVEAAKWYRKAAEQGEEFGLLFLGETYEDGEGVEKDYAEAAKLYRKAAEQGSAEGQMALGKMYRFGNGVEKDYAEAIKLYRKSAEQGNFTALFFLGEMYDNGVGVKQNKAESQRII

SEQ ID NO: 53147 - DNA, 984 bp, Helicobacter pylori
  CDS (1)..(984): transl_table=11
atgcgtcatgttaaggggtgtcaaaaaagcggttttagggttttgtgtttgggggcgttgtgtttaggggggttaatggcagagtcaaaccctaaagagcttatatttttaggtatcactatttacacggataaagatttcactagggctaaggaatactttgaaaaagcttgcgaattacacgatgctgatggttgcataatcttaagagagacttattctaaagtcatcctaaaaggaagtgcaaaagaaagcattgaaaaagccattgaacacatcgctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgaattgaactatggcgatggctgtgcgattttaggggatatttatcataatggtgaaggcgtaacacaaaattttaaaaaagctttcaaatattactctaaagcttgcgagttgaataatggtgaagggtgttctaaattaggaggggattatttttttggtgaaagcgtaacgcaagatcttaaaaaagcttttggatattactctaaagcttgcgaattaaacgaggctctgacatgcacgcttgtaggagagttttatcgtgatggtgaaggcgtaacaaaggatcttaaaaaagcttttgaatattctgctaaagcttgtgaattgaacgatgctaaagggtgttacgctctagcagcgttttataatgagggtaaaggcgtagcaagaggtgaaaaacaaatgacagaaaactttgaaaagagttgcaagctaggattaaaagaagcatgcgattttctcaaagaacaaaaaccataa

SEQ ID NO: 53148 - protein, 327 aa, Helicobacter pylori
MRHVKGCQKSGFRVLCLGALCLGGLMAESNPKELIFLGITIYTDKDFTRAKEYFEKACELHDADGCIILRETYSKVILKGSAKESIEKAIEHIATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFFGESVTQDLKKAFGYYSKACELNEALTCTLVGEFYRDGEGVTKDLKKAFEYSAKACELNDAKGCYALAAFYNEGKGVARGEKQMTENFEKSCKLGLKEACDFLKEQKP

SEQ ID NO: 53149 - DNA, 1011 bp, Helicobacter pylori
  CDS (1)..(1011): transl_table=11
atgcgtcatgttaaggggtgtcaaaaaagcggttttagggttttgtgtttggtggcgttgtgtttaggggggttaatggcagagtcaaaccctaaagagcttatatttttaggtatcactatttacacggataaagatttcactagggctaaggaatactttgaaaaagcttgcgaattacacgatgctgatggttgcataatcttaagagagacttattctaaagtcatcctaaaaggaagtgcaaaagaaagcattgaaaaagccattgaacacatcgctactgctaaagcttgcaaatcaaacgatgctgaaaaatgcaaggacttagcagagttttattttaatgcaaacgatcttaaaaatgctttagaatattactctaaatcttgtaagttaaataatgttgaagggtgtatgctgtcagcaactttttataacgatatgataaagggtttgaaaaaagataaaaaagatctagaatattattctaaagcttgcgaattgaactatggcgatggctgtgcgattttaggggatatttatcataatggtgaaggcgtaacacaaaattttaaaaaagctttcaaatattactctaaagcttgcgagttgaataatggtgaagggtgttctaaattaggaggggattatttttttggtgaaagcgtaacgcaagatcttaaaaaagcttttggatattactctaaagcttgcgaattaaacgaggctctgacatgcacgcttgtaggagagttttatcgtgatggtgaaggcgtaacaaaggatcttaaaaaagcttttgaatattctgctaaagcttgtgaattgaacgatgctaaagggtgttactctctagcagcgttttttaatgagggtaaaggcgtagcaagaggtgaaaaacaaatgacagaaaaccttgaaaagagttgcaagcttggattaaagaagcatgcgatattttcaaagaacaaaaacaataaaatttcgcccctaaccaagccccattaa

SEQ ID NO: 53150 - protein, 336 aa, Helicobacter pylori
MRHVKGCQKSGFRVLCLVALCLGGLMAESNPKELIFLGITIYTDKDFTRAKEYFEKACELHDADGCIILRETYSKVILKGSAKESIEKAIEHIATAKACKSNDAEKCKDLAEFYFNANDLKNALEYYSKSCKLNNVEGCMLSATFYNDMIKGLKKDKKDLEYYSKACELNYGDGCAILGDIYHNGEGVTQNFKKAFKYYSKACELNNGEGCSKLGGDYFFGESVTQDLKKAFGYYSKACELNEALTCTLVGEFYRDGEGVTKDLKKAFEYSAKACELNDAKGCYSLAAFFNEGKGVARGEKQMTENLEKSCKLGLKKHAIFSKNKNNKISPLTKPH

SEQ ID NO: 53151 - DNA, 651 bp, Helicobacter pylori
  CDS (1)..(651): transl_table=11
ttgggtgtaaagagtagtgaagcgaaagattacattcaagctaaaaaatattttgaaaaagcgtgtggtttgaataatggtggggggtgtggtgctttaggggatctgtatgatgatggaaaaggcgtagaaaaaaacttaataaaagccgcttatttttattctaaagcgtgtgatttaaaagaaggtatggggtgtaagagattagggtcattatattatcatggtcgagacgtagaaaaaaacttaacaaaagccgcttatttttattctaaagcatgcgatttgaataatggtggggggtgtggtaatttgggggtgttatatcaaaaaggggaaggagtagaaaaaaacttaataaaagccgctcaattttactctaaagcatgcgagttaaaagatggtttggggtgtaaggatttagggacgttatattataatggggaaggagtagaaaaagacttaataaaagccgcttatctttattctaaagcatgcgatttaaaagagggtttgggatgttttaatttaggggcgttatattataatgggaaaggagtagaaaaagacttaacaaaagccgcttacttttactctaaagcctgcaaattaggaagtcaagaggcatgcgaggcgctcaaagaaaaataa

SEQ ID NO: 53152 - protein, 216 aa, Helicobacter pylori
MGVKSSEAKDYIQAKKYFEKACGLNNGGGCGALGDLYDDGKGVEKNLIKAAYFYSKACDLKEGMGCKRLGSLYYHGRDVEKNLTKAAYFYSKACDLNNGGGCGNLGVLYQKGEGVEKNLIKAAQFYSKACELKDGLGCKDLGTLYYNGEGVEKDLIKAAYLYSKACDLKEGLGCFNLGALYYNGKGVEKDLTKAAYFYSKACKLGSQEACEALKEK

SEQ ID NO: 53153 - DNA, 2037 bp, Arabidopsis thaliana
  CDS (1)..(2037)
atgagaatattaagctacggaatcgttattctctctttactcgttttctctttcattgaatttggcgttcacgctcgtcccgtcgttctcgtcctctcaaatgacgatctcaatagcggcggcgatgataacggagtcggagagtcctctgacttcgatgagtttggagaatccgaacctaagtccgaagaggagcttgatcccggttcatggcgatcgatcttcgagccagatgactcaacagtccaagcagcctcgccgcagtactactccggcctcaaaaagattctatcggcggcgagtgagggaaatttcaggttgatggaagaagcagtggatgagatagaggctgcttcttcagctggagatccacacgcacagtcgataatggggttcgtttacgggataggaatgatgcgagagaagagcaaaagcaagtcgtttcttcaccataatttcgcagctgctggtgggaatatgcagtcgaagatggcacttgcgttcacgtatcttcgtcaagatatgcatgataaagctgttcaattatatgctgaattagcagagacagctgtcaatagttttctgatctcaaaggattctccggtggttgaaccaactagaattcatagcggaactgaagagaacaaaggtgctctaaggaaatctcgaggcgaggaggatgaagatttccagatattggaatatcaggcacagaaagggaatgctaatgcaatgtacaaaaatggactgttctactactttggcctgcgaggattaaggcgtgatcacaccaaggcattgcattggtttttgaaagcagtagataaaggagagccgaggtcaatggaacttctgggggagatatatgctagaggagctggtgttgaaagaaattataccaaggcacttgaatggcttacacttgctgcaaaagaaggtctctattcagcatttaatggaattggctacttgtatgtcaaaggctatggagtagataagaaaaactatactaaggcaagagaatattttgagaaggctgttgacaatgaagaccccagtgggcattataaccttggagttttgtatcttaaaggcatcggagtcaacagggatgtgaggcaggcaacaaaatacttctttgttgctgcaaatgctggtcaaccaaaggctttctatcaactcgccaagatgttccatactggtgttgggcttaagaagaatctggagatggcgacttcattttataagctagtagcagaaagggggccgtggagttctctctctagatgggctcttgaagcttacttaaaaggtgatgtgggtaaggctttgattttgtactcaaggatggcagagatgggttatgaagtggcacaaagtaatgctgcctggatcctcgataaatacggcgaaagaagcatgtgcatgggagtatctggattttgcacagacaaagagagacatgagcgggcacattctttgtggtggcgggcctctgaacaaggcaatgaacatgctgctctgcttattggagatgcatattactatggccggggaactgagagagattttgtgcgtgcggcagaagcatacatgcatgctaaatcacagtccaatgcgcaagcaatgttcaacctcggttacatgcatgaacatggacaaggacttccctttgatctccatttagcaaaacgttactatgatgaatcccttcagagcgatgcagccgcgagattgccagtcacacttgctctcgctagcttatggctccgtagaaactatgctgataccgtcctggtgagagttgtggattcattaccagaagtgtatccgaaggtagagacttggatagagaatgtggtgtttgaagaaggtaatgcaacaatacttacactctttgtctgtctcatcacaattctctatctccgggaaagacaacgtagacaagtcgtcgttgttgccgatccagtggctgctgacgtggcacaaccgctcgacgctgatgtggcgcaacacctcgctgcgttcccacggtaa

SEQ ID NO: 53154 - protein, 678 aa, Arabidopsis thaliana
MRILSYGIVILSLLVFSFIEFGVHARPVVLVLSNDDLNSGGDDNGVGESSDFDEFGESEPKSEEELDPGSWRSIFEPDDSTVQAASPQYYSGLKKILSAASEGNFRLMEEAVDEIEAASSAGDPHAQSIMGFVYGIGMMREKSKSKSFLHHNFAAAGGNMQSKMALAFTYLRQDMHDKAVQLYAELAETAVNSFLISKDSPVVEPTRIHSGTEENKGALRKSRGEEDEDFQILEYQAQKGNANAMYKNGLFYYFGLRGLRRDHTKALHWFLKAVDKGEPRSMELLGEIYARGAGVERNYTKALEWLTLAAKEGLYSAFNGIGYLYVKGYGVDKKNYTKAREYFEKAVDNEDPSGHYNLGVLYLKGIGVNRDVRQATKYFFVAANAGQPKAFYQLAKMFHTGVGLKKNLEMATSFYKLVAERGPWSSLSRWALEAYLKGDVGKALILYSRMAEMGYEVAQSNAAWILDKYGERSMCMGVSGFCTDKERHERAHSLWWRASEQGNEHAALLIGDAYYYGRGTERDFVRAAEAYMHAKSQSNAQAMFNLGYMHEHGQGLPFDLHLAKRYYDESLQSDAAARLPVTLALASLWLRRNYADTVLVRVVDSLPEVYPKVETWIENVVFEEGNATILTLFVCLITILYLRERQRRQVVVVADPVAADVAQPLDADVAQHLAAFPR

SEQ ID NO: 53155 - DNA, 807 bp, Pseudomonas indigofera
  CDS (1)..(807): transl_table=11
atgaaaaccctcgccccgttggcggcgctgatatccgccctgctgttacccgccgcgcacgccgccctcaccacgccccccgcccagagcgccgagcagatcgcagagcaggtcgccgccgaacagggcgatgccaatgcccagttccggctgggtgtccgctacgaaaagggctccggcgtgccacaggattttgccaaggcggcgacgtggtatcgccaggccgccacgcaagggatgcccgaggcgcaaaacaacctggccgtgctgtatctgaacggccaaggcgtaaatcagaacgatgccgaggccctcgcgtggttccgcaaggcagcaacacaggggcaggccgaggcgcaactaaaccttggcgcgatgctgatgaatggccaaggcactcccaaaaatgacgacgaggcggttgtctggacccgcaaggcggcggcacagggtcagctcatggccgactacaaccttgccataatgatgcgggaaggtcggggacttccgcaggatgacgccgcagccgtggccttgttccgcaaggttgccgagcagggagtggccatagcgcagagtaatcttggtctcatgtacaagctcgggcgaggggtagcgcaggattaccagcttgcgctgagctggttgcgcaaaggggtagcgcagaaatcggcgatggcacaagccaacctcggcgtgctgtacctggaaggcaagggtgtagcccaagacgataacgaagccgtggtctggttccgcctggctgcaggcgcgcggctaccggctggcgctggacgacgtcagtga

SEQ ID NO: 53156 - protein, 268 aa, Pseudomonas indigofera
MKTLAPLAALISALLLPAAHAALTTPPAQSAEQIAEQVAAEQGDANAQFRLGVRYEKGSGVPQDFAKAATWYRQAATQGMPEAQNNLAVLYLNGQGVNQNDAEALAWFRKAATQGQAEAQLNLGAMLMNGQGTPKNDDEAVVWTRKAAAQGQLMADYNLAIMMREGRGLPQDDAAAVALFRKVAEQGVAIAQSNLGLMYKLGRGVAQDYQLALSWLRKGVAQKSAMAQANLGVLYLEGKGVAQDDNEAVVWFRLAAGARLPAGAGRRQ

SEQ ID NO: 53157 - DNA, 3606 bp, Legionella pneumophila
  CDS (1)..(3606): transl_table=11
atgaaatcactagtaccttgggtgtgtgttttagtcgcgtcagctggccaacaggcttttgccaatgatgcgttcaatgcttatagattaggcaattataatgaagcagctgagcccctaatcattaaatcaggtcaggatgctgttgccgaatactatttagggcgactttatctctatggatatgggcagttaaaaaacaatcgtgttgcgatgcgctactttaccaaatcagcggaaaaaggctatttacctgctgtcttgctcatggccaaatacagtttgctccatgaaaaaaatccggaagaagctgctcgttggtttaagcaagcagctgcggtgggagatgtgagcgcacaaatgtatatggcggcagcttatttatatggtgttggcgtcaagaaaaatacagatatcgcaagacgttattatattgatgcagcaaaaaatggtaatcctattgctcaatacaccttagcagagtatttcttagagagtaagcatgcgggtaataaaaaattagggatcatttggctgaataaagcagcagaaaatggagatccaaaagctttaacagaattgggcagattttatgtcgccggacaaatggttgccaaggatactgccaagggcgttgaattattaaataaagcagcctcagaacaatatactccagccatgcttgagttgggtaaattggctttaatgcaaaatcaatacgatgaggctattcaatggcttaataaggccgaggaacagagtacagaagctactcttgagttagcccatatttatttacaagataaaagtccagtttatgatccaaaaacaggttttttattggtactaaaagcagctcagaacggttctgttcaagcccaaaaagaattagccaatttatatcaaaaagggattggcgtagcggctgatgaagaattgtctaaacaatggactcttaaagcagcagaaaacgagaagaaaaatgcagagcctcctgttcttgcccaagctgcattatggctaagtaatgacagaacggataaattggaagagacggcttaccagatgaatggtatatttagcccatggaataatccgtctgccctgagaaataatagctataatcaagcacctaagcttgaaaccatctctcgtcaggatattttcaaaccacaatttgagttgactcagcctaatagtattcctataagcaattactatgatgctttaatcagtaaacaagtggagtttcaatcaaatcaatgggcttatccaacttacagacttaacccatttgtagaagctctagagagagccaatagtcctgtcgtacaaaagctcaacttgccagttccttatgctgacgcgaattatgatgatgatagcgaagttggcagttttgatttgatggacatttggacaggggattggaaacggactgtcaattatatgtctgtggtcaattatttgtatttcagggcaatactcggaaatgctcaaactcaatttgaaattggtcaattgtttcaatatgggattggtttaatgcaagatgatgcttcggctattattttttatgagaatgccgcagaacaaaagcacttgggtgctgaatataatttaggaatactttatctgaaacgcggtaaagacgaaaatgattaccaacaagcattaaattggctgactgattccgcatttaaagggaataagagagcacaatacgtattggcaaggatattgcgtcaggggatcgttggtcctgatggaaaagagtatattaaagcaaatgatgagcaagctatggccatgctttatctttcagctgccaatgattatgggccggcagaatatgagttggcagaatatttggcaagagactacaacaatggtttaagtgtagatgtcagaaaacaaaaaattgccttaataagaaagttataccaaggtgctgtgaagaataaagtggcagaggcattgttgccattggcattttataatgcgatggatgataacaggcaaaagcaggaacaagcatttaaagtagccgaagagcaagctgaaacaggcaatgagaatgccgctcttttactcggaatgctctatgaccgtggtataggaataaccgctgatccagccaaagccatgtactggtatcaacaagccggacaaaatcccgtaagtcagtttatattgggcacttacatcacagaaggaaaaggggtggcacaggataaggaaaaaggattggatttgctgaagcaatcagcagactcccaattttcctatgccgactttaatctggcagtacttaaacaacaatccggggaagactttttacccaatttaattgagtcttataaattagggaatagtcatgcggggatagtattggcagattattatttatctcaaagcagtgttcctgaacaaatgaatcaagctaaggaaatttataagggcttagctgataaaggcgatcaatatgcacaattaaaattggcttatatgctacaaaaaggattgggtgctgcaccggatcttgctggcgcgcaacattggtatactgcttcggcagaacaaggcaatcctgaggcacaatacttattaggccaattttatcaactaggtgaaacaggagaacctgattataatttggccaaacactggtatcaaaaagcagcgaaacatttatctaaagctgatgtagcattaggttttatttatgaaacggtagatgataattatgctcaagcactaaaagcctatgaaaatgctgcagcaaaaggagatatgctaggcgcttataatttggctttaatgtatgagtatggcaagggcgtgcccgtcaattactccaaagcgttatctttgtttaaagaagcatcagagaaaggtgctcctgaagcgatgagtcaattggctggaatgtatttttatggtttggggcaaccaagaaacgaacaacaagctttggtctggtataagaaagctgcaagcttaggtaatgggaatgctttgtatgccctcggtttattatccgaaactggtgttggtgttaaattggattttccagatgctttacggtattaccaggatgcatctgataaaggtaatgaaaaagcaatgctggctttggcaagaatgtatcattatggtcttggtgtcgaaaaggatcataaaagatcagcgagtatttatcaaaaattggcacaaaagcaaaatgcttatgctcaatatcaattaggtacttattatattgagggaacggcaggcgaacgactacccgaaaaaggccgtgagctattacaacaagcgagtgaaaacggaagtttacaggcccgtagagtattgcaaagattagatgcacaaacccagggtaaagtaagttatgtcgagcccgtgttatttaataatgttcccaaatttgatggccaaagcgctgatatgatttattttgatgcattaaatgaatggaatcatggggaggaggttttgtccagaatgatcttgcaacgtctggtgacgcaatatcccaattttatccctgcaaagcgagcttatgagcagttgaatcaagccaaattaatgaataacttgggttaa

SEQ ID NO: 53158 - protein, 1201 aa, Legionella pneumophila
MKSLVPWVCVLVASAGQQAFANDAFNAYRLGNYNEAAEPLIIKSGQDAVAEYYLGRLYLYGYGQLKNNRVAMRYFTKSAEKGYLPAVLLMAKYSLLHEKNPEEAARWFKQAAAVGDVSAQMYMAAAYLYGVGVKKNTDIARRYYIDAAKNGNPIAQYTLAEYFLESKHAGNKKLGIIWLNKAAENGDPKALTELGRFYVAGQMVAKDTAKGVELLNKAASEQYTPAMLELGKLALMQNQYDEAIQWLNKAEEQSTEATLELAHIYLQDKSPVYDPKTGFLLVLKAAQNGSVQAQKELANLYQKGIGVAADEELSKQWTLKAAENEKKNAEPPVLAQAALWLSNDRTDKLEETAYQMNGIFSPWNNPSALRNNSYNQAPKLETISRQDIFKPQFELTQPNSIPISNYYDALISKQVEFQSNQWAYPTYRLNPFVEALERANSPVVQKLNLPVPYADANYDDDSEVGSFDLMDIWTGDWKRTVNYMSVVNYLYFRAILGNAQTQFEIGQLFQYGIGLMQDDASAIIFYENAAEQKHLGAEYNLGILYLKRGKDENDYQQALNWLTDSAFKGNKRAQYVLARILRQGIVGPDGKEYIKANDEQAMAMLYLSAANDYGPAEYELAEYLARDYNNGLSVDVRKQKIALIRKLYQGAVKNKVAEALLPLAFYNAMDDNRQKQEQAFKVAEEQAETGNENAALLLGMLYDRGIGITADPAKAMYWYQQAGQNPVSQFILGTYITEGKGVAQDKEKGLDLLKQSADSQFSYADFNLAVLKQQSGEDFLPNLIESYKLGNSHAGIVLADYYLSQSSVPEQMNQAKEIYKGLADKGDQYAQLKLAYMLQKGLGAAPDLAGAQHWYTASAEQGNPEAQYLLGQFYQLGETGEPDYNLAKHWYQKAAKHLSKADVALGFIYETVDDNYAQALKAYENAAAKGDMLGAYNLALMYEYGKGVPVNYSKALSLFKEASEKGAPEAMSQLAGMYFYGLGQPRNEQQALVWYKKAASLGNGNALYALGLLSETGVGVKLDFPDALRYYQDASDKGNEKAMLALARMYHYGLGVEKDHKRSASIYQKLAQKQNAYAQYQLGTYYIEGTAGERLPEKGRELLQQASENGSLQARRVLQRLDAQTQGKVSYVEPVLFNNVPKFDGQSADMIYFDALNEWNHGEEVLSRMILQRLVTQYPNFIPAKRAYEQLNQAKLMNNLG

SEQ ID NO: 53159 - DNA, 873 bp, Helicobacter pylori J99
  CDS (1)..(873): transl_table=11
atgttagaaaatgtcaaaaaatccctttttagggttttgtgcttgggcgcgttgtgtttaggggggctaatggcagagcaagaccctaaagagcttgtcggtttgggggcaaagagctacaaagagcaggatttcactcaggctaagaaatattttgaaaaagcttgcgatttgaaagaaaatagcgggtgttttaatttaggggtgctttattatcaagggcatggggtggaaaagaatttgaaaaaagccgcttcattttactctaaagcttgcgatttaaattacagcaatgggtgtcatttgctagggaatttatattatagcgggcaaggcgtgtcccaaaacaccaacaaagccttgcaatactactctaaagcgtgcgatttgaaatacgctgaagggtgtgcgagcttaggggggatctatcatgatggcaaagtggttactagggattttaaaaaagcggtggaatatttcactaaagcttgcgatttgaacgatggcgatggttgcacgatattagggagcttgtatgatgcaggcagaggcacgcctaaagatttgaaaaaagcgctcgcttcgtatgataaagcttgcgacttaaaagacagcccagggtgctttaacgcagggaacatgtatcatcatggcgaaggtgcggcgaagaattttaaagaggccctcgctcgttattctaaggcatgcgagttggaaaatggcggagggtgtttcaatttaggggctatgcaatacaatggcgaaggcgcaacaaggaatgaaaagcaagccatagaaaactttaaaaaaggctgtaaattaggcgctaaaggggcatgcgatattctcaagcagctcaaaatcaaagtttag

SEQ ID NO: 53160 - protein, 290 aa, Helicobacter pylori J99
MLENVKKSLFRVLCLGALCLGGLMAEQDPKELVGLGAKSYKEQDFTQAKKYFEKACDLKENSGCFNLGVLYYQGHGVEKNLKKAASFYSKACDLNYSNGCHLLGNLYYSGQGVSQNTNKALQYYSKACDLKYAEGCASLGGIYHDGKVVTRDFKKAVEYFTKACDLNDGDGCTILGSLYDAGRGTPKDLKKALASYDKACDLKDSPGCFNAGNMYHHGEGAAKNFKEALARYSKACELENGGGCFNLGAMQYNGEGATRNEKQAIENFKKGCKLGAKGACDILKQLKIKV

SEQ ID NO: 53161 - DNA, 873 bp, Helicobacter pylori
  CDS (1)..(873): transl_table=11
atgttagaaaatgtcaaaaagtccttttttagggttttgtgcttgggtgcgttgtgtttaggggggctaatggcagagcaagaccctaaagagcttgtgggtttgggggcaaagagctacaaagagaaagatttcactcaagcgaagaaatattttgagaaagcgtgcgatttgaaagaaaatagcgggtgttttaatttaggggtgctttattatcaagggcaaggggtggaaaagaacttgaaaaaagccgcctccttttacgctaaagcttgcgatttgaattacagcaatgggtgtcatttgctagggaatttatattacagcgggcaaggcgtgtcccaaaacaccaataaagccctacaatactactctaaagcgtgcgatttgaaatacgctgaagggtgcgcgagcttaggggggatttatcatgatggtaaagtggtaactagggattttaaaaaagcggtggaatatttcactaaagcgtgcgatttaaacgatggcgatggttgcacgatattagggagcttgtatgatgcaggcagaggtacgcctaaagatttgaaaaaggcgctcgcttcgtatgataaagcttgcgacttaaaagacagcccagggtgctttaacgcagggaatatgtatcatcatggcgaaggtgcaacgaagaattttaaagaggctctcgctcgttattctaaagcatgcgaattggaaaatggcggagggtgtttcaatttaggggctatgcaatacaatggcgaaggcgtaacaaggaatgaaaagcaagccatagaaaactttaaaaaaggctgtaaattgggcgctaaaggggcgtgcgatattctcaagcagcttaagatcaaagtttag

SEQ ID NO: 53162 - protein, 290 aa, Helicobacter pylori
MLENVKKSFFRVLCLGALCLGGLMAEQDPKELVGLGAKSYKEKDFTQAKKYFEKACDLKENSGCFNLGVLYYQGQGVEKNLKKAASFYAKACDLNYSNGCHLLGNLYYSGQGVSQNTNKALQYYSKACDLKYAEGCASLGGIYHDGKVVTRDFKKAVEYFTKACDLNDGDGCTILGSLYDAGRGTPKDLKKALASYDKACDLKDSPGCFNAGNMYHHGEGATKNFKEALARYSKACELENGGGCFNLGAMQYNGEGVTRNEKQAIENFKKGCKLGAKGACDILKQLKIKV

SEQ ID NO: 53163 - DNA, 918 bp, Helicobacter pylori J99
  CDS (1)..(918): transl_table=11
atgataaagagttggactaaaaagtggtttttgattttatttttaatggcaagctgttttggtcatttggtggctacaaccggtgagaaatattttaagatggctaatcaagcccttaagagaggggattaccatagagcggtggctttttataagaggagctgtaatttgaggatgggggttggttgcacgagtttaggctctatgtatgaatatggcgatggcgtggatcagaatatttcaaaagccgttttttattacagaagagggtgtaatttgaggaatcatctcgcttgcgcgagtttaggctctatgtatgaagatggcgatggcgtgcaaaaagactttccaaaggctatctattattataggagagggtgccacttaaaaggtggggtgagctgcggtagtttgggttttatgtatttcaatggtacgggcgttaaacaaaattacgccaaagccctttctttttctaaatacgcttgcagtttgaattatggcattagttgtaactttgtagggtatatgtataagagcgccaaaggcgtggagaaggatttgaaaaaagcccttgcgaattttaaaagagggtgccatttaaaagacggggcgagctgtgtgagcttgggatacttgtatgaagccggtatggatgtcaaacaaaatgaagagcaggctttgaatctttataaaaagggttgctctttaaaagaagggagcggttgtcataatgtggcggtgatgtattacacgggtaagggagctccaaaagatttggagaaagccacttcatattataagaaagggtgcgctttaggctttagtggtagttgtaaggtgttagaagtgattggcaaggagtctgataatttgcaagatgacgcgcaaaacgacacgcaagatagcgtgcaataa

SEQ ID NO: 53164 - protein, 305 aa, Helicobacter pylori J99
MIKSWTKKWFLILFLMASCFGHLVATTGEKYFKMANQALKRGDYHRAVAFYKRSCNLRMGVGCTSLGSMYEYGDGVDQNISKAVFYYRRGCNLRNHLACASLGSMYEDGDGVQKDFPKAIYYYRRGCHLKGGVSCGSLGFMYFNGTGVKQNYAKALSFSKYACSLNYGISCNFVGYMYKSAKGVEKDLKKALANFKRGCHLKDGASCVSLGYLYEAGMDVKQNEEQALNLYKKGCSLKEGSGCHNVAVMYYTGKGAPKDLEKATSYYKKGCALGFSGSCKVLEVIGKESDNLQDDAQNDTQDSVQ

SEQ ID NO: 53165 - DNA, 921 bp, Helicobacter pylori
  CDS (1)..(921): transl_table=11
atgataaagagttggactaaaaagtggtttttgattttatttttaatggcaagttgttccagttatttggtggctacaaccggtgagaaatattttaaaatggctactcaagcctttaagagaggggactaccataaagcggtggctttttataagaggagctgtaatttaagggtgggggttggttgcacgagtttaggctctatgtatgaagatggcgatggcgtggatcagaatattacaaaagccgttttttattacagaagagggtgtaatttaaggaatcatctcgcttgcgcgagtctaggctctatgtatgaagatggcgatggtgtgcaaaaaaaccttccaaaggctatctattattacaggagagggtgccacttaaagggtggggtgagctgtgggagtttaggttttatgtattttaatggcacgggcgttaagcaaaattatgccaaagccctttttctttctaaatacgcttgcagtttgaattacggcattagttgtaactttgtagggtatatgtataggaacgccaaaggcgtacagaaggatttgaaaaaagcccttgcgaattttaaaagagggtgccatttgaaagacggagcgagttgtgtgagcttgggatacatgtatgaagtcggtatggatgtcaaacaaaatggagagcaagccttgaatctttataaaaagggttgttatttaaaaagggggagcggttgtcataatgtggcggtgatgtattacaccggtaagggcgttccaaaggatttagataaagccatttcgtattataagaaaggttgcactctaggctttagtggtagctgtaaagtgttagaagaagtgattggcaagaagtctgatgatttgcaagatgacgcgcaaaacgacacgcaagatgatatgcaataa

SEQ ID NO: 53166 - protein, 306 aa, Helicobacter pylori
MIKSWTKKWFLILFLMASCSSYLVATTGEKYFKMATQAFKRGDYHKAVAFYKRSCNLRVGVGCTSLGSMYEDGDGVDQNITKAVFYYRRGCNLRNHLACASLGSMYEDGDGVQKNLPKAIYYYRRGCHLKGGVSCGSLGFMYFNGTGVKQNYAKALFLSKYACSLNYGISCNFVGYMYRNAKGVQKDLKKALANFKRGCHLKDGASCVSLGYMYEVGMDVKQNGEQALNLYKKGCYLKRGSGCHNVAVMYYTGKGVPKDLDKAISYYKKGCTLGFSGSCKVLEEVIGKKSDDLQDDAQNDTQDDMQ

SEQ ID NO: 53167 - DNA, 1068 bp, Helicobacter pylori J99
  CDS (1)..(1068): transl_table=11
atgaatatcaaaattttaaaaatattagttggagggttattttttttgagcttgaacgcccatttatgggggaaacaagacaatagctttttagggattggtgaaagagcctataaaagcgggaattattctaaagcggcgtcttattttaaaaaagcatgcaacgatggggtgagtgaaggctgcacgcaattaggaatcatttatgaaaacgggcaaggcactagaatagattataaaaaagccctagaatattataaaaccgcatgccaggctgatgatagggaagggtgttttggcttaggggggctttatgatgagggtttaggcacggctcaaaattatcaagaagccattgacgcttacgctaaggcatgcgttttaaaacaccctgagagttgctacaatttaggcatcatttatgatagaaaaatcaaaggcaatgccgctcaagcggttacttactatcaaaaaagctgtaattttgatatggctaaggggtgttatattttaggcactgcctatgaaaaaggctttttagaagtcaaacagagcaaccataaagccgttatctattatttgaaagcgtgccgattgaatgaggggcaggcttgccgagcgttagggagtttgtttgaaaatggcgatgcagggcttgatgaagattttgaagtggcgtttgattatttgcaaaaagcttgcgctttaaacaattctggtggttgcgcgagtttaggctctatgtatatgttgggcaggtatgttaaaaaagacccccaaaaggcttttaactatttcaagcaagcatgcgatatggggagcgcggtgagttgctctaggatgggctttatgtattcgcaaggggacactgtttcaaaagacttgaggaaagcccttgataattatgaaagaggttgcgatatgggcgatgaagtgggttgcttcgctctagcgggcatgtattacaacatgaaagataaagaaaacgccataatgatttatgacaagggctgtaaattgggcatgaaacaggcatgcgaaaatctcaccaaactcagggggtattag

SEQ ID NO: 53168 - protein, 355 aa, Helicobacter pylori J99
MNIKILKILVGGLFFLSLNAHLWGKQDNSFLGIGERAYKSGNYSKAASYFKKACNDGVSEGCTQLGIIYENGQGTRIDYKKALEYYKTACQADDREGCFGLGGLYDEGLGTAQNYQEAIDAYAKACVLKHPESCYNLGIIYDRKIKGNAAQAVTYYQKSCNFDMAKGCYILGTAYEKGFLEVKQSNHKAVIYYLKACRLNEGQACRALGSLFENGDAGLDEDFEVAFDYLQKACALNNSGGCASLGSMYMLGRYVKKDPQKAFNYFKQACDMGSAVSCSRMGFMYSQGDTVSKDLRKALDNYERGCDMGDEVGCFALAGMYYNMKDKENAIMIYDKGCKLGMKQACENLTKLRGY

SEQ ID NO: 53169 - DNA, 1068 bp, Helicobacter pylori
  CDS (1)..(1068): transl_table=11
atgggtgtcaaatttttaaaaatattagtttgtgggttatttttttggagcttgaacgcccatttatggggaaaacaagacaatagttttttgggggttgctgaaaaagcctataaaagcgggaattattctaaagccacatcttattttaaaaaagcatgcaacgatggggtgagtgaaggttgcacgcaattaggaatcatttatgaaaacgggcaaggcactagaatagattataaaaaagccctagaatattataaaaccgcatgccaggctgatgatagggaagggtgttttggtttaggggggctttatgatgaggggttaggcacgactcaaaattatcaagaagccattgacgcttatgctaaggcgtgcgttttaaaacaccctgagagttgctacaatttaggcattatttatgaccgaaaaatcaaaggcaatgccgatcaagcggttacctactaccaaaaaagctgtaattttgatatggctaaggggtgttatgttttgggcgtggcttatgaaaaaggctttttagaagtcaaacaaagcaaccataaagccgtcatctattatttgaaagcatgccgattggatgatgggcaggcttgtcgcgcgttagggagtttgtttgaaaatggcgatgcagggcttgatgaagattttgaagtggcgtttgattacttgcaaaaagcttgcgggttaaacaattctggtggttgcgcgagtttaggctctatgtatatgttaggcaggtatgtcaaaaaagatccccaaaaggcttttaattttttcaaacaagcatgcgatatggggagtgcggtgagttgctctaggatgggctttatgtattcccaaggggacgctgttccaaaagacttgaggaaagcccttgataattatgaaaggggttgcgatatgggcgatgaagtgggttgcttcgctctagcgggcatgtattacaacatgaaagacaaagaaaacgccataatgatttatgacaagggctgtaagctaggcatgaaacaagcatgcgaaaacctcactaaacttagggggtattga

SEQ ID NO: 53170 - protein, 355 aa, Helicobacter pylori
MGVKFLKILVCGLFFWSLNAHLWGKQDNSFLGVAEKAYKSGNYSKATSYFKKACNDGVSEGCTQLGIIYENGQGTRIDYKKALEYYKTACQADDREGCFGLGGLYDEGLGTTQNYQEAIDAYAKACVLKHPESCYNLGIIYDRKIKGNADQAVTYYQKSCNFDMAKGCYVLGVAYEKGFLEVKQSNHKAVIYYLKACRLDDGQACRALGSLFENGDAGLDEDFEVAFDYLQKACGLNNSGGCASLGSMYMLGRYVKKDPQKAFNFFKQACDMGSAVSCSRMGFMYSQGDAVPKDLRKALDNYERGCDMGDEVGCFALAGMYYNMKDKENAIMIYDKGCKLGMKQACENLTKLRGY

SEQ ID NO: 53171 - DNA, 2385 bp, Homo sapiens
  CDS (1)..(2385)
atgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaa

SEQ ID NO: 53172 - protein, 794 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 53173 - DNA, 2385 bp, Mesocricetus auratus
  CDS (1)..(2385)
atgcaggtccacgtcgggctgacgttgctgctctgcgcggtgctcctgagctcggcgaccgcgtcctccgatgacgaaagtaaccaggacgaatccatagattccaagagttctttgccagccgatgagtcggtgaaggaccactccaccacaggcagagtggttgctggccagatatttgttgattctgaggacccagaggtggagtcccctcttcaggaagaggaagagagctccaagactgaggaggaagtcagtgtcggtgaagaaatcagctttgtagaatctccaagtctaagcagcaagagctatgaagaagcaaagagagcccggaaaccagttttgaccgccattgagggtacggcgcacggagagccctgccacttccctttccttttcctggataaggagtatgacgagtgcacgtcagacgggaggcaagacggcaggctgtggtgtgccacaacctatgactacaagacagatgagaagtggggcttctgcgaaactgaagaagatgctgcaaaaagacggcagatgcaggaagcagaaatgatttaccaggctgggatgaagatactgaatgggagcaacagaaagagccaaaagagagaagcatatcggtatcttcaaaaggcagcaggcatgaatcacaccaaagccctggagagagtatcctacgctctcttatttggtgattacctcacacagaatatccaggcggctaaagagatgtttgagaaactgaccgaggaaggttctcccaaaggacaaactgctcttggctttctctacgtctctggactcggtgttaattcaagtcaggcaaaggctcttgtatattatacttttggagcccttggaggcaatctgatagcccatatggttttgggttaccggtactgggctggcatcggagtcctccagagttgtgagtcggtactgacccattatcgtcttgttgccaaccatgttgctagcgatatctccctgaccggaggctcagtagtccagagaatacggctgcctgatgaagtggaaaacccagggatgaacagtgggatgctggaagaggatttgattcagtattaccagttcctggctgagaagggtgacgtgcaagcacaggttggtctgggacaactgcatctgcatggagggcgtggagtagaacagaatcaccagagagcatttgactacttcaacttagcagcaaatgctggcaattcacatgcgatggccttcctgggaaagatgtattctgaaggaagcgacatcgtccctcagagtaatgagacagcacttcactacttcaagaaagccgcggacatgggcaaccccgtgggacagagcgggcttggaatggcctacctctatggaaggggaattcaagttaattatgacctggcactcaagtatttccagaaagctgctgagcaaggctgggtggatgggcagctgcagcttggctctatgtactacaatggcattggagtcaagagagattataagcaggccttgaagtattttaatttagcatctcaaggaggccatatcctggctttctataacctggcacagatgcacgccagcggcacaggggtgatgaggtcctgtcacactgcggtggagttgtttaagaacgtgtgtgagcgaggccgctggtcggagaggctcatgactgcctacaacagctataaagacggggactacaatgctgcagtggtccagtacctcctgctggccgaacagggctacgaagtggcacagagcaacgcagccttcatccttgaccagagagaagcaaccattgtaggtgagaatgagacttaccccagagctttgctgcattggaacagggccgcctctcaaggttataccgtggctagaattaaacttggagactaccatttctatgggtttggcactgatgtggattacgagactgcttttattcattaccgactggcttcggagcaacaacacagtgcccaagctatgtttaacctgggctacatgcatgagaagggcctaggcattaaacaggatattcaccttgcaaaacgcttttatgacatggcagccgaggctagcccagatgcacaagttcctgtcttccttgcactctgcaaattgggtgtcgtctatttcttacagtacatacgggaagcaaatatccgagacatattcacccaactggatatggaccagcttctgggacccgagtgggacctttacctcatgaccatcatcgcgctcctgttgggtacggtcatagcttacagacagagacagcaccaggatgtgccggtacccaggcccccagggccatggccagctcctccccagcaggaaggaccaccagagcagcagccaccacagtag

SEQ ID NO: 53174 - protein, 794 aa, Mesocricetus auratus
MQVHVGLTLLLCAVLLSSATASSDDESNQDESIDSKSSLPADESVKDHSTTGRVVAGQIFVDSEDPEVESPLQEEEESSKTEEEVSVGEEISFVESPSLSSKSYEEAKRARKPVLTAIEGTAHGEPCHFPFLFLDKEYDECTSDGRQDGRLWCATTYDYKTDEKWGFCETEEDAAKRRQMQEAEMIYQAGMKILNGSNRKSQKREAYRYLQKAAGMNHTKALERVSYALLFGDYLTQNIQAAKEMFEKLTEEGSPKGQTALGFLYVSGLGVNSSQAKALVYYTFGALGGNLIAHMVLGYRYWAGIGVLQSCESVLTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGIQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVVQYLLLAEQGYEVAQSNAAFILDQREATIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIREANIRDIFTQLDMDQLLGPEWDLYLMTIIALLLGTVIAYRQRQHQDVPVPRPPGPWPAPPQQEGPPEQQPPQ

SEQ ID NO: 53175 - DNA, 2373 bp, Mus musculus
  CDS (1)..(2373)
atgcaggtccgcgtcaggctgtcgttgctgctgctctgcgcggtgctcctgggctcggcagccgcgacctcggatgacaaaactaaccaggatgactccttagattccaagagttctttgcccacagatgagtcagtgaaggaccacaccaccacgggcaaagtagttgctggccagatatttgttgattctgaagaagcagaagtggaatcccttcttcaggacgaggaagatagctccaagacccaggaggaagagatcagctttttagaatctccgaatccaagcagcaagacctacgaagaactaaagagagtgcggaagccagtcttgactgccattgaaggtacggcgcacggggagccctgccacttccctttccttttcctggataaggagtatgatgagtgcacctcagacgggagggaagatggcagactgtggtgtgccacaacctatgactacaagacagatgagaagtggggcttctgcgaaactgaagaagatgctgccaaaagacgacagatgcaggaagcagagatgatctatcaggccgggatgaagatactgaatggaagcaataggaagagccaaaagagagaagcatatcggtaccttcagaaggcagcaggcatgaatcacaccaaagccctggagagagtgtcctatgctctcttgtttggtgattacctcacacagaatatccaggcagccaaagagatgtttgagaaactgactgaggaagggtctcccaaaggacagactggtcttggctttctctacgcttctgggcttggtgttaattcaagtcaggcaaaggctcttgtatattatactttcggagctcttggaggcaacctgatagcccatatgattttgggttaccgctactgggctggcatcggagtcctccagagttgtgagtcggcactgacccattatcgtcttgttgccaatcatgttgctagtgatatctccctaactggaggctctgtagtccagagaatacggctgcccgatgaagtggaaaacccggggatgaacagtgggatgctggaagaagacctgattcagtattaccagttcctagctgagaagggtgacgtccaagcacaggttggcctgggacagctgcatctgcatggagggcgtggagtagaacagaatcaccagagagcgtttgactacttcaacttagcagcaaatgctggcaattcacatgctatggccttcctgggaaagatgtattctgaaggaagtgacatcgtacctcagagtaatgagacggcacttcactactttaagaaagctgctgacatgggcaaccccgtgggacagagcgggcttggaatggcctacctctacggaagaggcgttcaagttaattatgacctggccctcaagtatttccagaaagctgctgagcaaggctgggtggacgggcagctgcagctcggctctatgtactacaatggcattggagtcaagagagattataagcaggccttgaagtattttaatctggcttctcaaggaggccatatcttggctttctataacctcgcacagatgcacgccagcggcacaggggtgatgcggtcctgtcacactgcagtggagttgtttaagaatgtgtgtgagcgaggtcgctggtcagagagactgatgactgcctacaacagctataaggatgaggactacaatgctgcagtggtccagtacctcctgctggctgagcagggctacgaggtggcgcagagcaacgcagccttcatcctcgaccagagagaagcaaccattgtaggtgagaatgaaacttaccccagagctttactgcattggaacagggccgcctcccaaggttacactgtggctagaattaagcttggagactaccacttctatggctttggcactgatgtggattatgagaccgcatttattcattaccgcctggcttctgagcagcagcacagcgcccaagctatgtttaacctgggctacatgcacgagaagggcctaggcattaaacaggacattcaccttgcaaaacgcttttatgacatggcagccgaagctagcccagatgcacaagtacctgtgttcctcgcactctgcaaattaggtgtcgtctatttcttacagtacatacgggaagcaaacattcgagatctattcacacaactggatatggaccagcttttgggacccgagtgggacctttacctcatgaccatcattgcactgctcttgggtacagtcatagcttacaggcagcgacagcaccaggacataccagttcccaggcccccagggccacggccggctcctccccagcaggaaggaccaccagagcagcagccaccacagtag

SEQ ID NO: 53176 - protein, 790 aa, Mus musculus
MQVRVRLSLLLLCAVLLGSAAATSDDKTNQDDSLDSKSSLPTDESVKDHTTTGKVVAGQIFVDSEEAEVESLLQDEEDSSKTQEEEISFLESPNPSSKTYEELKRVRKPVLTAIEGTAHGEPCHFPFLFLDKEYDECTSDGREDGRLWCATTYDYKTDEKWGFCETEEDAAKRRQMQEAEMIYQAGMKILNGSNRKSQKREAYRYLQKAAGMNHTKALERVSYALLFGDYLTQNIQAAKEMFEKLTEEGSPKGQTGLGFLYASGLGVNSSQAKALVYYTFGALGGNLIAHMILGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDEDYNAAVVQYLLLAEQGYEVAQSNAAFILDQREATIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIREANIRDLFTQLDMDQLLGPEWDLYLMTIIALLLGTVIAYRQRQHQDIPVPRPPGPRPAPPQQEGPPEQQPPQ

SEQ ID NO: 53177 - DNA, 1755 bp, Mimivirus
  CDS (1)..(1755)
atgaataaaaattgcgattattgtggtttaactatatattcagagacatatcataaatgtgtcgaatcatctgtgaaaatcaatgatgaaactaaaatagtcaattataaaattatcactattgatgaattgggtattttagctggtaaaaatgatcgtgaagcacaagatgaaattgtatatcgttatttgaatcaagatgctattaatttatctcaaaaaaatattaaaccaatcaattgggaaaatatcattgaacgagctattgatgaccaatattttacgtattttttattattttttgcttttgaccacgatgaatatcatgttatatttgatgtgttatttgatgtgttatttgaaaacgttaaattagctgcaaaaaccggagatagtatggcacaatataatcttggtcaaatgtattatagaggtattagtactaaaaaaaatatacaaaaagcaattaaatggataacaaagtcagcagatcaaaataataaatatggattgattaatttagctagattttatgaatatggtgatggtgtcttgttggatattgataaagcaacccaattactcgaacaagctagctgtcaaaatttttcaaaggcacaattttatttaggcagaatatacatgtataaagatccaccagattataaactagcattcaaatattatcaacaagctgcaaatcaaaaccatagtagtgcacaatattttatagccgtattttataaaactggtaaatgtgtggcgcaagattataaaaaggcagtacattggttgacattagccgctagtcaaggtttaaattcggccaaaattaaattagctgaaatgtatatgaaaggtattgatgtagaacaaaattatcataaagcttttgaattgttaaattcgtctatttatgatgatggaacaaataattattatgatgaagttgcaatgaccgagctagcgtgcatgtataaacgtggtctaggaatagaaaaaaatatatctaaagcaatttatttacatattaaatccagaaatacaaaaaatattttcaaaatatttgaaattaatactattacgtttattaatccaattaatgtcgattgcgaaaacaacaatctatctgatattgatcaattagaatctaaaattatttacaaattacaatttctaatgataaaattaaaatacgaatggagtaatatttatcacgatgatattagtaatagtttacaagaaattgaaaacagtttcacacgactgataaaattacgaatacaattaaataattccagtgcaatgattaactgtttatcgtttaagaaaaatacatcatacaaatttgacgtttttaatactaaaaatgcatatgttaattactacgtttatgatgacatatcatatataaacattggtcttaataatattaaactcgtaaacaatttccaaaaaaatcttgataaatttatgttttgtaatatatttttagatttagaactagcgttagaaaataaacacaaagaaaaaattgatgatttaataaatgctgttaaaaatgatgatcgttctcatcaattaaatattgttaaggatttggataatattaagtttgtcttatcacaaacaaaaaaaatttcatccaaattgattgggtacgtaaatattttaatgaatgacctaaaatctaatacacatattcgtaatcaacaatttcaactcgaatatgcaaatatatttggatatgattga

SEQ ID NO: 53178 - protein, 584 aa, Mimivirus
MNKNCDYCGLTIYSETYHKCVESSVKINDETKIVNYKIITIDELGILAGKNDREAQDEIVYRYLNQDAINLSQKNIKPINWENIIERAIDDQYFTYFLLFFAFDHDEYHVIFDVLFDVLFENVKLAAKTGDSMAQYNLGQMYYRGISTKKNIQKAIKWITKSADQNNKYGLINLARFYEYGDGVLLDIDKATQLLEQASCQNFSKAQFYLGRIYMYKDPPDYKLAFKYYQQAANQNHSSAQYFIAVFYKTGKCVAQDYKKAVHWLTLAASQGLNSAKIKLAEMYMKGIDVEQNYHKAFELLNSSIYDDGTNNYYDEVAMTELACMYKRGLGIEKNISKAIYLHIKSRNTKNIFKIFEINTITFINPINVDCENNNLSDIDQLESKIIYKLQFLMIKLKYEWSNIYHDDISNSLQEIENSFTRLIKLRIQLNNSSAMINCLSFKKNTSYKFDVFNTKNAYVNYYVYDDISYINIGLNNIKLVNNFQKNLDKFMFCNIFLDLELALENKHKEKIDDLINAVKNDDRSHQLNIVKDLDNIKFVLSQTKKISSKLIGYVNILMNDLKSNTHIRNQQFQLEYANIFGYD

SEQ ID NO: 53179 - DNA, 1602 bp, Mimivirus
  CDS (1)..(1602)
atggattacaagcacgttgatatccaaaaactaattgaactagccaaatatgataattatgcgcaggaagaaattgttgaacgtatgatcgtggggcaagtcaaacatgatttatggaaaaatattaatccatttgactgggaaaatttgttcgaaaaatgttatagtaatccaaaatatgtatttgtgttgttatgtgcatataaatcaatatttctttgcaaaattgatccaaaaattccaacatcaaatacaataatttatctcgaaaaaatacatcctattgtaaaacaacaagccaaaaattgtgatgttctttcccaaaataatcttggatttatgtacgaagaaggtattggaactgaaatcaaaataaataaagcaaaaatgtggtatacattatccgcaaatcaaggtttatcattcgcgcaatacaatttaggatattattactacaataaagctaagtacgaaaaaagtattaattacttccaaaaatctgcacaatcagggtattatctttcaaatttcatgttagcagaaacgtatttaaaattatctattcctaattttaatgaagctattaaaaactatttattggcagccaatcaaggatgtaacatatcccaatacagattaggtatgatttattttgaagggaaatatgttaatactgatatgaatcaagcatataaatggtttaagttatctgcaaaacaaggaaattatttttctcaatatggtttaggacgtgtttattactcgatggattctacaaaatataattgtcaaaaagccattaactgcttcattaaatcagcaaattgtggacacatatatgcacaaaaaaaattaattgaatattatgaaatcaataataatattgccgaaatgatttattggtgtgttaaatcttccgatgtagacaaaataaaaaaatacattaaaatcaatgaaaatattgagaatactagtgatattgtatattttgacttagtcagaaaaaatttagaagatgttggatcagatattctctataaatgccaattattgattatccagaataaatatttttggaaagataatgtttctctttgtcgagtaaaattatgcgaaaaattggaaaatattattttgaaatttattgattggactaataaattgcaaaataattctctactattattatcgtgtttgagttttattgatgacaatcacaatgtgtctatccgccatcaccaacatacaacaggattaataccttatgtaaaacaacatgaatttagaaacaaaaaatttatcacttttgataaagaaaatgttagttttgttaatgaaattattgatataaccaatggtactgatatgaatgaatggtttgaaagtctacaatttctgaaattaaattatcagaatttaatgaaaacatccatgaattcttctagaatttacaaagacttaatcttaatacaaaatttagagactgatatcgaaaaatattgcgaattaatgtttgatgaaattgaatatggtgtttatgatcgtaatcgtttattcatagaaaatagagaatacaatatggcgaaattgtttgataactaa

SEQ ID NO: 53180 - protein, 533 aa, Mimivirus
MDYKHVDIQKLIELAKYDNYAQEEIVERMIVGQVKHDLWKNINPFDWENLFEKCYSNPKYVFVLLCAYKSIFLCKIDPKIPTSNTIIYLEKIHPIVKQQAKNCDVLSQNNLGFMYEEGIGTEIKINKAKMWYTLSANQGLSFAQYNLGYYYYNKAKYEKSINYFQKSAQSGYYLSNFMLAETYLKLSIPNFNEAIKNYLLAANQGCNISQYRLGMIYFEGKYVNTDMNQAYKWFKLSAKQGNYFSQYGLGRVYYSMDSTKYNCQKAINCFIKSANCGHIYAQKKLIEYYEINNNIAEMIYWCVKSSDVDKIKKYIKINENIENTSDIVYFDLVRKNLEDVGSDILYKCQLLIIQNKYFWKDNVSLCRVKLCEKLENIILKFIDWTNKLQNNSLLLLSCLSFIDDNHNVSIRHHQHTTGLIPYVKQHEFRNKKFITFDKENVSFVNEIIDITNGTDMNEWFESLQFLKLNYQNLMKTSMNSSRIYKDLILIQNLETDIEKYCELMFDEIEYGVYDRNRLFIENREYNMAKLFDN

SEQ ID NO: 53181 - DNA, 1623 bp, Mimivirus
  CDS (1)..(1623)
atggaaaatttatgtgataaatgtagctctgtaatatattccaaagaatatcatcaatgtttagcaaactctactacgagaaattttatcgtgtgtaattcaacaacaatcaactatgatagtttaacaatgaaacaattatgcgaattggctaacggtggtaataaacaagttcaaaaaataattctcgataggatacaatttttttcttatggatcagttcctcataggtacattgaatttaaaaaatgggaatattttatggataaaattcctcacaaccaaaattatgttagattatatttatgttggatttattataattgtatggagattgatggttcgataatcgcacacataaaaaatttggcaaaaatgtgtaacattgatgcacaaacaaattatggtttagtaaatgaatacggtatcggtgttaaaaaaaatattaaaaaagcaataaaatggtataaattatcatgttataaagaaaatttatttggattattatttttgggttcattatatgagagaggatacggtgtttcttgtgacaaacacatggcatttaatctgtatgaaaaagcaactaaacataattatcctgcggtaaaaagacaattagcatttatgtacagaactggtagcggaacaacaaaaaatatcaataaatctcatgaattatatagagaggctgcaaatcaaggatatccattggcccaatacgcattggctttgcagtgtaaatatggacatggttgtattaaaaattataaggaagctgaaacatggttaattcggagttataataatggttgtttatatgcaacatatagtttagcaagattgtatattgaaacaaaatctccgttacgaaattactcaagagcctttgagttaatgcaagaagctgcttcagaaaattatttactggcaataaattatctggcaaaaatatataaaaatggaataggcgtcaataaaaatatatctagagcaatttattggtattacaaagccggtaattcaacaaaaattactgaattattagaaataaacaactctgtaattattaacacattagattgtaatatattcacatgtttggattcaatagagaatgaaatattgtttgacattcaattatatattttgaaatataaatacggtgataaatgtgactataatctccaattatatcaacaattagaaacgatagtttttgaatgcattaaattgagaaatgcactagataaatcttcggcattgacaacttgtttaaaaccaatcacaaaagaatatcgcgatgaattatctaagtttacgattgatacagatgtatttgtcaaacattattattttaataaacaaacatatatgacatttggaaaagcaaatgttaaattatccgatgacattatttttttcttgtcaaaaaaaccttacattaacattgttaataagttgatttgtcttaacaaaacaaatatcgatactgtcaaagatattaaatctattaattccaaactacaaaaatatgctaacttgtttgttcgatatattgaagagacagtaaatattcgcaatacaatgttccaaataaaattttcttttatttttaggtaa

SEQ ID NO: 53182 - protein, 540 aa, Mimivirus
MENLCDKCSSVIYSKEYHQCLANSTTRNFIVCNSTTINYDSLTMKQLCELANGGNKQVQKIILDRIQFFSYGSVPHRYIEFKKWEYFMDKIPHNQNYVRLYLCWIYYNCMEIDGSIIAHIKNLAKMCNIDAQTNYGLVNEYGIGVKKNIKKAIKWYKLSCYKENLFGLLFLGSLYERGYGVSCDKHMAFNLYEKATKHNYPAVKRQLAFMYRTGSGTTKNINKSHELYREAANQGYPLAQYALALQCKYGHGCIKNYKEAETWLIRSYNNGCLYATYSLARLYIETKSPLRNYSRAFELMQEAASENYLLAINYLAKIYKNGIGVNKNISRAIYWYYKAGNSTKITELLEINNSVIINTLDCNIFTCLDSIENEILFDIQLYILKYKYGDKCDYNLQLYQQLETIVFECIKLRNALDKSSALTTCLKPITKEYRDELSKFTIDTDVFVKHYYFNKQTYMTFGKANVKLSDDIIFFLSKKPYINIVNKLICLNKTNIDTVKDIKSINSKLQKYANLFVRYIEETVNIRNTMFQIKFSFIFR

SEQ ID NO: 53183 - DNA, 26 bp, Artificial sequence
  (1)..(26): primer
atgataatgattttcacgtcaagttg

SEQ ID NO: 53184 - DNA, 26 bp, Artificial sequence
  (1)..(26): primer
ttacagtaaatcttcagtctcacgaa

SEQ ID NO: 53185 - protein, 529 aa, Artificial sequence
  Variant (2)..(18): xaa in position 2 to 18 is any amino acid
  Variant (19)..(86): xaa in position 19 to 86 is any or no amino acid
  Variant (89)..(98): xaa in position 89 to 98 is any amino acid
  Variant (99)..(106): xaa in position 99 to 106 is any or no amino acid
  Variant (108)..(113): xaa in position 108 to 113 is any amino acid
  Variant (115)..(118): xaa in position 115 to 118 is any amino acid
  Variant (119)..(121): xaa in position 119 to 121 is any or no amino acid
  Variant (123)..(125): xaa in position 123 to 125 is any or no amino acid
  Variant (128)..(129): xaa in position 128 to 129 is any amino acid
  Variant (131)..(132): xaa in position 131 to 132 is any amino acid
  Variant (134)..(138): xaa in position 134 to 138 is any amino acid
  Variant (139)..(285): xaa in position 139 to 285 is any or no amino acid
  Variant (287)..(288): xaa in position 287 to 288 is any amino acid
  Variant (291)..(292): xaa in position 291 to 292 is any amino acid
  Variant (295)..(300): xaa in position 295 to 300 is any amino acid
  Variant (302)..(304): xaa in position 302 to 304 is any amino acid
  Variant (307)..(308): xaa in position 307 to 308 is any amino acid
  Variant (310)..(311): xaa in position 310 to 311 is any amino acid
  Variant (313)..(317): xaa in position 313 to 317 is any amino acid
  Variant (318)..(323): xaa in position 318 to 323 is any or no amino acid
  Variant (325)..(326): xaa in position 325 to 326 is any amino acid
  Variant (329)..(330): xaa in position 329 to 330 is any amino acid
  Variant (333)..(338): xaa in position 333 to 338 is any amino acid
  Variant (340)..(342): xaa in position 340 to 342 is any amino acid
  Variant (345)..(349): xaa in position 345 to 349 is any amino acid
  Variant (351)..(355): xaa in position 351 to 355 is any amino acid
  Variant (356)..(502): xaa in position 356 to 502 is any or no amino acid
  Variant (504)..(509): xaa in position 504 to 509 is any amino acid
  Variant (511)..(517): xaa in position 511 to 517 is any amino acid
  Variant (519)..(521): xaa in position 519 to 521 is any amino acid
  Variant (524)..(528): xaa in position 524 to 528 is any amino acid
AXXXXXXXXXXXXXXXXXXXXXXXXXXXXXXXXXXXXXXXXXXXXXXXXXXXXXXXXXXXXXXXXXXXXXXXXXXXXXXXXXXXXXLGXXXXXXXXXXXXXXXXXXAXXXXXXAXXXXXXXAXXXLGXXYXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXWYXXAAXXXXXXAXXXLGXXYXXGXXXXXXXXXXXAXXWYXXAAXXXXXXAXXXLGXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXAXXXXXXXAXXXLGXXXXXG

SEQ ID NO: 53186 - protein, 27 aa, Artificial sequence
  Variant (2)..(7): xaa in position 2 to 7 is any amino acid
  Variant (8)..(8): xaa in position 8 is Ala, Gly, Ser, Thr or Val
  Variant (9)..(9): xaa in position 9 is Ala, Cys, Gly, Ser, Thr or Val
  Variant (10)..(15): xaa in position 10 to 15 is any amino acid
  Variant (16)..(16): xaa in position 16 is Ala, Cys, Gly, Ser, Thr or Val
  Variant (17)..(20): xaa in position 17 to 20 is any amino acid
  Variant (22)..(26): xaa in position 22 to 26 is any amino acid
AXXXXXXXXXXXXXXXXXXXGXXXXXG

SEQ ID NO: 53187 - DNA, 1473 bp, Escherichia coli; identical to SEQ ID NO: 27148
  CDS (1)..(1473)

SEQ ID NO: 53188 - protein, 490 aa, Escherichia coli; identical to SEQ ID NO: 27149

SEQ ID NO: 53189 - DNA, 1620 bp, Saccharomyces cerevisiae; identical to SEQ ID NO: 27150
  CDS (1)..(1620)

SEQ ID NO: 53190 - protein, 539 aa, Saccharomyces cerevisiae; identical to SEQ ID NO: 27151

SEQ ID NO: 53191 - DNA, 1545 bp, Mesorhizobium loti MAFF303099; identical to SEQ ID NO: 27152
  CDS (1)..(1545): transl_table=11

SEQ ID NO: 53192 - protein, 514 aa, Mesorhizobium loti MAFF303099; identical to SEQ ID NO: 27153

SEQ ID NO: 53193 - DNA, 1656 bp, Mesorhizobium loti MAFF303099; identical to SEQ ID NO: 27154
  CDS (1)..(1656): transl_table=11

SEQ ID NO: 53194 - protein, 551 aa, Mesorhizobium loti MAFF303099; identical to SEQ ID NO: 27155

SEQ ID NO: 53195 - DNA, 1518 bp, Mesorhizobium loti MAFF303099; identical to SEQ ID NO: 27156
  CDS (1)..(1518): transl_table=11

SEQ ID NO: 53196 - protein, 505 aa, Mesorhizobium loti MAFF303099; identical to SEQ ID NO: 27157

SEQ ID NO: 53197 - DNA, 1563 bp, Thermotoga maritima MSB8; identical to SEQ ID NO: 27158
  CDS (1)..(1563): transl_table=11

SEQ ID NO: 53198 - protein, 520 aa, Thermotoga maritima MSB8; identical to SEQ ID NO: 27159

SEQ ID NO: 53199 - DNA, 1452 bp, Pasteurella multocida subsp. multocida str. Pm70; identical to SEQ ID NO: 27160
  CDS (1)..(1452): transl_table=11

SEQ ID NO: 53200 - protein, 483 aa, Pasteurella multocida subsp. multocida str. Pm70; identical to SEQ ID NO: 27161

SEQ ID NO: 53201 - DNA, 1518 bp, Pasteurella multocida subsp. multocida str. Pm70; identical to SEQ ID NO: 27162
  CDS (1)..(1518): transl_table=11

SEQ ID NO: 53202 - protein, 505 aa, Pasteurella multocida subsp. multocida str. Pm70; identical to SEQ ID NO: 27163

SEQ ID NO: 53203 - DNA, 2733 bp, Pasteurella multocida subsp. multocida str. Pm70; identical to SEQ ID NO: 27164
  CDS (1)..(2733): transl_table=11

SEQ ID NO: 53204 - protein, 910 aa, Pasteurella multocida subsp. multocida str. Pm70; identical to SEQ ID NO: 27165

SEQ ID NO: 53205 - DNA, 1566 bp, Pseudomonas aeruginosa PAO1; identical to SEQ ID NO: 27166
  CDS (1)..(1566): transl_table=11

SEQ ID NO: 53206 - protein, 521 aa, Pseudomonas aeruginosa PAO1; identical to SEQ ID NO: 27167

SEQ ID NO: 53207 - DNA, 2751 bp, Pseudomonas aeruginosa PAO1; identical to SEQ ID NO: 27168
  CDS (1)..(2751): transl_table=11

SEQ ID NO: 53208 - protein, 916 aa, Pseudomonas aeruginosa PAO1; identical to SEQ ID NO: 27169

SEQ ID NO: 53209 - DNA, 1698 bp, Lactococcus lactis subsp. lactis Il1403; identical to SEQ ID NO: 27170
  CDS (1)..(1698): transl_table=11

SEQ ID NO: 53210 - protein, 565 aa, Lactococcus lactis subsp. lactis Il1403; identical to SEQ ID NO: 27171

SEQ ID NO: 53211 - DNA, 1521 bp, Lactococcus lactis subsp. lactis Il1403; identical to SEQ ID NO: 27172
  CDS (1)..(1521): transl_table=11

SEQ ID NO: 53212 - protein, 506 aa, Lactococcus lactis subsp. lactis Il1403; identical to SEQ ID NO: 27173

SEQ ID NO: 53213 - DNA, 1590 bp, Escherichia coli O157:H7 EDL933; identical to SEQ ID NO: 27174
  CDS (1)..(1590): n means a or g or c or t/u, s means g or c

SEQ ID NO: 53214 - protein, 529 aa, Escherichia coli O157:H7 EDL933; identical to SEQ ID NO: 27175
  Xaa in position 383 is unknown

SEQ ID NO: 53215 - DNA, 1590 bp, Escherichia coli O157:H7; identical to SEQ ID NO: 27176
  CDS (1)..(1590): transl_table=11

SEQ ID NO: 53216 - protein, 529 aa, Escherichia coli O157:H7; identical to SEQ ID NO: 27177

SEQ ID NO: 53217 - DNA, 1512 bp, Escherichia coli O157:H7; identical to SEQ ID NO: 27178
  CDS (1)..(1512): transl_table=11

SEQ ID NO: 53218 - protein, 503 aa, Escherichia coli O157:H7; identical to SEQ ID NO: 27179

SEQ ID NO: 53219 - DNA, 2685 bp, Escherichia coli O157:H7; identical to SEQ ID NO: 27180
  CDS (1)..(2685): transl_table=11

SEQ ID NO: 53220 - protein, 894 aa, Escherichia coli O157:H7; identical to SEQ ID NO: 27181

SEQ ID NO: 53221 - DNA, 2793 bp, Agrobacterium tumefaciens str. C58; identical to SEQ ID NO: 27182
  CDS (1)..(2793): transl_table=11

SEQ ID NO: 53222 - protein, 930 aa, Agrobacterium tumefaciens str. C58; identical to SEQ ID NO: 27183

SEQ ID NO: 53223 - DNA, 1593 bp, Staphylococcus aureus subsp. aureus Mu50; identical to SEQ ID NO: 27184
  CDS (1)..(1593): transl_table=11

SEQ ID NO: 53224 - protein, 530 aa, Staphylococcus aureus subsp. aureus Mu50; identical to SEQ ID NO: 27185

SEQ ID NO: 53225 - DNA, 1704 bp, Sinorhizobium meliloti 1021; identical to SEQ ID NO: 27186
  CDS (1)..(1704): transl_table=11

SEQ ID NO: 53226 - protein, 567 aa, Sinorhizobium meliloti 1021; identical to SEQ ID NO: 27187

SEQ ID NO: 53227 - DNA, 1491 bp, Yersinia pestis CO92; identical to SEQ ID NO: 27188
  CDS (1)..(1491)

SEQ ID NO: 53228 - protein, 496 aa, Yersinia pestis CO92; identical to SEQ ID NO: 27189

SEQ ID NO: 53229 - DNA, 1593 bp, Yersinia pestis CO92; identical to SEQ ID NO: 27190
  CDS (1)..(1593)

SEQ ID NO: 53230 - protein, 530 aa, Yersinia pestis CO92; identical to SEQ ID NO: 27191

SEQ ID NO: 53231 - DNA, 1596 bp, Yersinia pestis CO92; identical to SEQ ID NO: 27192
  CDS (1)..(1596)

SEQ ID NO: 53232 - protein, 531 aa, Yersinia pestis CO92; identical to SEQ ID NO: 27193

SEQ ID NO: 53233 - DNA, 1515 bp, Yersinia pestis CO92; identical to SEQ ID NO: 27194
  CDS (1)..(1515)

SEQ ID NO: 53234 - protein, 504 aa, Yersinia pestis CO92; identical to SEQ ID NO: 27195

SEQ ID NO: 53235 - DNA, 1536 bp, Sinorhizobium meliloti 1021; identical to SEQ ID NO: 27196
  CDS (1)..(1536): transl_table=11

SEQ ID NO: 53236 - protein, 511 aa, Sinorhizobium meliloti 1021; identical to SEQ ID NO: 27197

SEQ ID NO: 53237 - DNA, 1647 bp, Sinorhizobium meliloti 1021; identical to SEQ ID NO: 27198
  CDS (1)..(1647): transl_table=11

SEQ ID NO: 53238 - protein, 548 aa, Sinorhizobium meliloti 1021; identical to SEQ ID NO: 27199

SEQ ID NO: 53239 - DNA, 1602 bp, Sinorhizobium meliloti 1021; identical to SEQ ID NO: 27200
  CDS (1)..(1602): transl_table=11

SEQ ID NO: 53240 - protein, 533 aa, Sinorhizobium meliloti 1021; identical to SEQ ID NO: 27201

SEQ ID NO: 53241 - DNA, 1476 bp, Salmonella typhimurium LT2; identical to SEQ ID NO: 27202
  CDS (1)..(1476): transl_table=11

SEQ ID NO: 53242 - protein, 491 aa, Salmonella typhimurium LT2; identical to SEQ ID NO: 27203

SEQ ID NO: 53243 - DNA, 1593 bp, Salmonella typhimurium LT2; identical to SEQ ID NO: 27204
  CDS (1)..(1593): transl_table=11

SEQ ID NO: 53244 - protein, 530 aa, Salmonella typhimurium LT2; identical to SEQ ID NO: 27205

SEQ ID NO: 53245 - DNA, 1872 bp, Salmonella typhimurium LT2; identical to SEQ ID NO: 27206
  CDS (1)..(1872): transl_table=11

SEQ ID NO: 53246 - protein, 623 aa, Salmonella typhimurium LT2; identical to SEQ ID NO: 27207

SEQ ID NO: 53247 - DNA, 1590 bp, Salmonella typhimurium LT2; identical to SEQ ID NO: 27208
  CDS (1)..(1590): transl_table=11

SEQ ID NO: 53248 - protein, 529 aa, Salmonella typhimurium LT2; identical to SEQ ID NO: 27209

SEQ ID NO: 53249 - DNA, 1536 bp, Salmonella typhimurium LT2; identical to SEQ ID NO: 27210
  CDS (1)..(1536): transl_table=11

SEQ ID NO: 53250 - protein, 511 aa, Salmonella typhimurium LT2; identical to SEQ ID NO: 27211

SEQ ID NO: 53251 - DNA, 1656 bp, Ralstonia solanacearum GMI1000; identical to SEQ ID NO: 27212
  CDS (1)..(1656): transl_table=11

SEQ ID NO: 53252 - protein, 551 aa, Ralstonia solanacearum GMI1000; identical to SEQ ID NO: 27213

SEQ ID NO: 53253 - DNA, 1524 bp, Agrobacterium tumefaciens str. C58; identical to SEQ ID NO: 27214
  CDS (1)..(1524): transl_table=11

SEQ ID NO: 53254 - protein, 507 aa, Agrobacterium tumefaciens str. C58; identical to SEQ ID NO: 27215

SEQ ID NO: 53255 - DNA, 1764 bp, Brucella melitensis 16M; identical to SEQ ID NO: 27216
  CDS (1)..(1764): transl_table=11

SEQ ID NO: 53256 - protein, 587 aa, Brucella melitensis 16M; identical to SEQ ID NO: 27217

SEQ ID NO: 53257 - DNA, 1464 bp, Schizosaccharomyces pombe 972h-; identical to SEQ ID NO: 27218
  CDS (1)..(1464)

SEQ ID NO: 53258 - protein, 487 aa, Schizosaccharomyces pombe 972h-; identical to SEQ ID NO: 27219

SEQ ID NO: 53259 - DNA, 1734 bp, Corynebacterium glutamicum ATCC 13032; identical to SEQ ID NO: 27220
  CDS (1)..(1734): transl_table=11

SEQ ID NO: 53260 - protein, 577 aa, Corynebacterium glutamicum ATCC 13032; identical to SEQ ID NO: 27221

SEQ ID NO: 53261 - DNA, 1644 bp, Corynebacterium glutamicum ATCC 13032; identical to SEQ ID NO: 27222
  CDS (1)..(1644): transl_table=11

SEQ ID NO: 53262 - protein, 547 aa, Corynebacterium glutamicum ATCC 13032; identical to SEQ ID NO: 27223

SEQ ID NO: 53263 - DNA, 1524 bp, Thermoanaerobacter tengcongensis MB4; identical to SEQ ID NO: 27224
  CDS (1)..(1524): transl_table=11

SEQ ID NO: 53264 - protein, 507 aa, Thermoanaerobacter tengcongensis MB4; identical to SEQ ID NO: 27225

SEQ ID NO: 53265 - DNA, 1593 bp, Staphylococcus aureus subsp. aureus MW2; identical to SEQ ID NO: 27226
  CDS (1)..(1593): transl_table=11

SEQ ID NO: 53266 - protein, 530 aa, Staphylococcus aureus subsp. aureus MW2; identical to SEQ ID NO: 27227

SEQ ID NO: 53267 - DNA, 1497 bp, Yersinia pestis KIM; identical to SEQ ID NO: 27228
  CDS (1)..(1497): transl_table=11

SEQ ID NO: 53268 - protein, 498 aa, Yersinia pestis KIM; identical to SEQ ID NO: 27229

SEQ ID NO: 53269 - DNA, 1515 bp, Yersinia pestis KIM; identical to SEQ ID NO: 27230
  CDS (1)..(1515): transl_table=11

SEQ ID NO: 53270 - protein, 504 aa, Yersinia pestis KIM; identical to SEQ ID NO: 27231

SEQ ID NO: 53271 - DNA, 1557 bp, Yersinia pestis KIM; identical to SEQ ID NO: 27232
  CDS (1)..(1557): transl_table=11

SEQ ID NO: 53272 - protein, 518 aa, Yersinia pestis KIM; identical to SEQ ID NO: 27233

SEQ ID NO: 53273 - DNA, 1542 bp, Bifidobacterium longum NCC2705; identical to SEQ ID NO: 27234
  CDS (1)..(1542): transl_table=11

SEQ ID NO: 53274 - protein, 513 aa, Bifidobacterium longum NCC2705; identical to SEQ ID NO: 27235

SEQ ID NO: 53275 - DNA, 2433 bp, Bifidobacterium longum NCC2705; identical to SEQ ID NO: 27236
  CDS (1)..(2433): transl_table=11

SEQ ID NO: 53276 - protein, 810 aa, Bifidobacterium longum NCC2705; identical to SEQ ID NO: 27237

SEQ ID NO: 53277 - DNA, 1593 bp, Shigella flexneri 2a str. 301; identical to SEQ ID NO: 27238
  CDS (1)..(1593): transl_table=11

SEQ ID NO: 53278 - protein, 530 aa, Shigella flexneri 2a str. 301; identical to SEQ ID NO: 27239

SEQ ID NO: 53279 - DNA, 1512 bp, Shigella flexneri 2a str. 301; identical to SEQ ID NO: 27240
  CDS (1)..(1512): transl_table=11

SEQ ID NO: 53280 - protein, 503 aa, Shigella flexneri 2a str. 301; identical to SEQ ID NO: 27241

SEQ ID NO: 53281 - DNA, 2736 bp, Shigella flexneri 2a str. 301; identical to SEQ ID NO: 27242
  CDS (1)..(2736): transl_table=11

SEQ ID NO: 53282 - protein, 911 aa, Shigella flexneri 2a str. 301; identical to SEQ ID NO: 27243

SEQ ID NO: 53283 - DNA, 1413 bp, Shewanella oneidensis MR-1; identical to SEQ ID NO: 27244
  CDS (1)..(1413): transl_table=11

SEQ ID NO: 53284 - protein, 470 aa, Shewanella oneidensis MR-1; identical to SEQ ID NO: 27245

SEQ ID NO: 53285 - DNA, 1380 bp, Streptococcus agalactiae NEM316; identical to SEQ ID NO: 27246
  CDS (1)..(1380): transl_table=11

SEQ ID NO: 53286 - protein, 459 aa, Streptococcus agalactiae NEM316; identical to SEQ ID NO: 27247

SEQ ID NO: 53287 - DNA, 1740 bp, Corynebacterium efficiens YS-314; identical to SEQ ID NO: 27248
  CDS (1)..(1740): transl_table=11

SEQ ID NO: 53288 - protein, 579 aa, Corynebacterium efficiens YS-314; identical to SEQ ID NO: 27249

SEQ ID NO: 53289 - DNA, 1476 bp, Corynebacterium efficiens YS-314; identical to SEQ ID NO: 27250
  CDS (1)..(1476): transl_table=11

SEQ ID NO: 53290 - protein, 491 aa, Corynebacterium efficiens YS-314; identical to SEQ ID NO: 27251

SEQ ID NO: 53291 - DNA, 2721 bp, Pseudomonas putida KT2440; identical to SEQ ID NO: 27252
  CDS (1)..(2721): transl_table=11

SEQ ID NO: 53292 - protein, 906 aa, Pseudomonas putida KT2440; identical to SEQ ID NO: 27253

SEQ ID NO: 53293 - DNA, 1485 bp, Escherichia coli CFT073; identical to SEQ ID NO: 27254
  CDS (1)..(1485): transl_table=11

SEQ ID NO: 53294 - protein, 494 aa, Escherichia coli CFT073; identical to SEQ ID NO: 27255

SEQ ID NO: 53295 - DNA, 1512 bp, Escherichia coli CFT073; identical to SEQ ID NO: 27256
  CDS (1)..(1512): transl_table=11

SEQ ID NO: 53296 - protein, 503 aa, Escherichia coli CFT073; identical to SEQ ID NO: 27257

SEQ ID NO: 53297 - DNA, 2736 bp, Escherichia coli CFT073; identical to SEQ ID NO: 27258
  CDS (1)..(2736): transl_table=11

SEQ ID NO: 53298 - protein, 911 aa, Escherichia coli CFT073; identical to SEQ ID NO: 27259

SEQ ID NO: 53299 - DNA, 1578 bp, Escherichia coli CFT073; identical to SEQ ID NO: 27260
  CDS (1)..(1578): transl_table=11

SEQ ID NO: 53300 - protein, 525 aa, Escherichia coli CFT073; identical to SEQ ID NO: 27261

SEQ ID NO: 53301 - DNA, 1542 bp, Vibrio vulnificus CMCP6; identical to SEQ ID NO: 27262
  CDS (1)..(1542): transl_table=11

SEQ ID NO: 53302 - protein, 513 aa, Vibrio vulnificus CMCP6; identical to SEQ ID NO: 27263

SEQ ID NO: 53303 - DNA, 1485 bp, Bradyrhizobium japonicum USDA 110; identical to SEQ ID NO: 27264
  CDS (1)..(1485)

SEQ ID NO: 53304 - protein, 494 aa, Bradyrhizobium japonicum USDA 110; identical to SEQ ID NO: 27265

SEQ ID NO: 53305 - DNA, 1518 bp, Clostridium tetani E88; identical to SEQ ID NO: 27266
  CDS (1)..(1518): transl_table=11

SEQ ID NO: 53306 - protein, 505 aa, Clostridium tetani E88; identical to SEQ ID NO: 27267

SEQ ID NO: 53307 - DNA, 1407 bp, Lactobacillus plantarum WCFS1; identical to SEQ ID NO: 27268
  CDS (1)..(1407): transl_table=11

SEQ ID NO: 53308 - protein, 468 aa, Lactobacillus plantarum WCFS1; identical to SEQ ID NO: 27269

SEQ ID NO: 53309 - DNA, 1629 bp, Tropheryma whipplei str. Twist; identical to SEQ ID NO: 27270
  CDS (1)..(1629): transl_table=11

SEQ ID NO: 53310 - protein, 542 aa, Tropheryma whipplei str. Twist; identical to SEQ ID NO: 27271

SEQ ID NO: 53311 - DNA, 1557 bp, Tropheryma whipplei str. Twist; identical to SEQ ID NO: 27272
  CDS (1)..(1557): transl_table=11

SEQ ID NO: 53312 - protein, 518 aa, Tropheryma whipplei str. Twist; identical to SEQ ID NO: 27273

SEQ ID NO: 53313 - DNA, 1629 bp, Tropheryma whipplei TW08/27; identical to SEQ ID NO: 27274
  CDS (1)..(1629): transl_table=11

SEQ ID NO: 53314 - protein, 542 aa, Tropheryma whipplei TW08/27; identical to SEQ ID NO: 27275

SEQ ID NO: 53315 - DNA, 1557 bp, Tropheryma whipplei TW08/27; identical to SEQ ID NO: 27276
  CDS (1)..(1557): transl_table=11

SEQ ID NO: 53316 - protein, 518 aa, Tropheryma whipplei TW08/27; identical to SEQ ID NO: 27277

SEQ ID NO: 53317 - DNA, 1584 bp, Pseudomonas syringae pv. tomato str. DC3000; identical to SEQ ID NO: 27278
  CDS (1)..(1584): transl_table=11

SEQ ID NO: 53318 - protein, 527 aa, Pseudomonas syringae pv. tomato str. DC3000; identical to SEQ ID NO: 27279

SEQ ID NO: 53319 - DNA, 1455 bp, Vibrio parahaemolyticus RIMD 2210633; identical to SEQ ID NO: 27280
  CDS (1)..(1455): transl_table=11

SEQ ID NO: 53320 - protein, 484 aa, Vibrio parahaemolyticus RIMD 2210633; identical to SEQ ID NO: 27281

SEQ ID NO: 53321 - DNA, 1632 bp, Vibrio parahaemolyticus RIMD 2210633; identical to SEQ ID NO: 27282
  CDS (1)..(1632): transl_table=11

SEQ ID NO: 53322 - protein, 543 aa, Vibrio parahaemolyticus RIMD 2210633; identical to SEQ ID NO: 27283

SEQ ID NO: 53323 - DNA, 1590 bp, Salmonella enterica subsp. enterica serovar Typhi Ty2; identical to SEQ ID NO: 27284
  CDS (1)..(1590): transl_table=11

SEQ ID NO: 53324 - protein, 529 aa, Salmonella enterica subsp. enterica serovar Typhi Ty2; identical to SEQ ID NO: 27285

SEQ ID NO: 53325 - DNA, 1596 bp, Salmonella enterica subsp. enterica serovar Typhi Ty2; identical to SEQ ID NO: 27286
  CDS (1)..(1596): transl_table=11

SEQ ID NO: 53326 - protein, 531 aa, Salmonella enterica subsp. enterica serovar Typhi Ty2; identical to SEQ ID NO: 27287

SEQ ID NO: 53327 - DNA, 1536 bp, Salmonella enterica subsp. enterica serovar Typhi Ty2; identical to SEQ ID NO: 27288
  CDS (1)..(1536): transl_table=11

SEQ ID NO: 53328 - protein, 511 aa, Salmonella enterica subsp. enterica serovar Typhi Ty2 [sequence omitted]

SEQ ID NO: 53329 - DNA, 2742 bp, Salmonella enterica subsp. enterica serovar Typhi Ty2; identical to SEQ ID NO: 27290
  CDS (1)..(2742): transl_table=11

SEQ ID NO: 53330 - protein, 913 aa, Salmonella enterica subsp. enterica serovar Typhi Ty2; identical to SEQ ID NO: 27291

SEQ ID NO: 53331 - DNA, 1470 bp, Bacteroides thetaiotaomicron VPI-5482; identical to SEQ ID NO: 27292
  CDS (1)..(1470): transl_table=11

SEQ ID NO: 53332 - protein, 489 aa, Bacteroides thetaiotaomicron VPI-5482; identical to SEQ ID NO: 27293

SEQ ID NO: 53333 - DNA, 1455 bp, Bacteroides thetaiotaomicron VPI-5482; identical to SEQ ID NO: 27294
  CDS (1)..(1455): transl_table=11

SEQ ID NO: 53334 - protein, 484 aa, Bacteroides thetaiotaomicron VPI-5482; identical to SEQ ID NO: 27295

SEQ ID NO: 53335 - DNA, 1425 bp, Enterococcus faecalis V583; identical to SEQ ID NO: 27296
  CDS (1)..(1425): transl_table=11

SEQ ID NO: 53336 - protein, 474 aa, Enterococcus faecalis V583; identical to SEQ ID NO: 27297

SEQ ID NO: 53337 - DNA, 1542 bp, Streptomyces avermitilis MA-4680; identical to SEQ ID NO: 27298
  CDS (1)..(1542)

SEQ ID NO: 53338 - protein, 513 aa, Streptomyces avermitilis MA-4680; identical to SEQ ID NO: 27299

SEQ ID NO: 53339 - DNA, 1533 bp, Bacillus cereus ATCC 14579; identical to SEQ ID NO: 27300
  CDS (1)..(1533): transl_table=11

SEQ ID NO: 53340 - protein, 510 aa, Bacillus cereus ATCC 14579; identical to SEQ ID NO: 27301

SEQ ID NO: 53341 - DNA, 2772 bp, Nitrosomonas europaea ATCC 19718; identical to SEQ ID NO: 27302
  CDS (1)..(2772): transl_table=11

SEQ ID NO: 53342 - protein, 923 aa, Nitrosomonas europaea ATCC 19718; identical to SEQ ID NO: 27303

SEQ ID NO: 53343 - DNA, 1533 bp, Bacillus anthracis str. Ames; identical to SEQ ID NO: 27304
  CDS (1)..(1533): transl_table=11

SEQ ID NO: 53344 - protein, 510 aa, Bacillus anthracis str. Ames; identical to SEQ ID NO: 27305

SEQ ID NO: 53345 - DNA, 1623 bp, Prochlorococcus marinus subsp. marinus str. CCMP1375; identical to SEQ ID NO: 27306
  CDS (1)..(1623): transl_table=11

SEQ ID NO: 53346 - protein, 540 aa, Prochlorococcus marinus subsp. marinus str. CCMP1375; identical to SEQ ID NO: 27307

SEQ ID NO: 53347 - DNA, 1635 bp, Bordetella pertussis Tohama I; identical to SEQ ID NO: 27308
  CDS (1)..(1635): transl_table=11

SEQ ID NO: 53348 - protein, 544 aa, Bordetella pertussis Tohama I; identical to SEQ ID NO: 27309

SEQ ID NO: 53349 - DNA, 1761 bp, Bordetella bronchiseptica RB50; identical to SEQ ID NO: 27310
  CDS (1)..(1761)

SEQ ID NO: 53350 - protein, 586 aa, Bordetella bronchiseptica RB50; identical to SEQ ID NO: 27311

SEQ ID NO: 53351 - DNA, 1476 bp, Photorhabdus luminescens subsp. laumondii TTO1; identical to SEQ ID NO: 27312
  CDS (1)..(1476): transl_table=11

SEQ ID NO: 53352 - protein, 491 aa, Photorhabdus luminescens subsp. laumondii TTO1; identical to SEQ ID NO: 27313

SEQ ID NO: 53353 - DNA, 1596 bp, Photorhabdus luminescens subsp. laumondii TTO1; identical to SEQ ID NO: 27314
  CDS (1)..(1596): transl_table=11

SEQ ID NO: 53354 - protein, 531 aa, Photorhabdus luminescens subsp. laumondii TTO1; identical to SEQ ID NO: 27315

SEQ ID NO: 53355 - DNA, 1536 bp, Photorhabdus luminescens subsp. laumondii TTO1; identical to SEQ ID NO: 27316
  CDS (1)..(1536): transl_table=11

SEQ ID NO: 53356 - protein, 511 aa, Photorhabdus luminescens subsp. laumondii TTO1; identical to SEQ ID NO: 27317

SEQ ID NO: 53357 - DNA, 1683 bp, Corynebacterium diphtheriae NCTC 13129; identical to SEQ ID NO: 27318
  CDS (1)..(1683): transl_table=11

SEQ ID NO: 53358 - protein, 560 aa, Corynebacterium diphtheriae NCTC 13129; identical to SEQ ID NO: 27319

SEQ ID NO: 53359 - DNA, 1443 bp, Corynebacterium diphtheriae NCTC 13129; identical to SEQ ID NO: 27320
  CDS (1)..(1443): transl_table=11

SEQ ID NO: 53360 - protein, 480 aa, Corynebacterium diphtheriae NCTC 13129; identical to SEQ ID NO: 27321

SEQ ID NO: 53361 - DNA, 2715 bp, Rhodopseudomonas palustris CGA009; identical to SEQ ID NO: 27322
  CDS (1)..(2715): transl_table=11

SEQ ID NO: 53362 - protein, 904 aa, Rhodopseudomonas palustris CGA009; identical to SEQ ID NO: 27323

SEQ ID NO: 53363 - DNA, 2796 bp, Rhodopseudomonas palustris CGA009; identical to SEQ ID NO: 27324
  CDS (1)..(2796): transl_table=11

SEQ ID NO: 53364 - protein, 931 aa, Rhodopseudomonas palustris CGA009; identical to SEQ ID NO: 27325

SEQ ID NO: 53365 - DNA, 2793 bp, Geobacter sulfurreducens PCA; identical to SEQ ID NO: 27326
  CDS (1)..(2793): transl_table=11

SEQ ID NO: 53366 - protein, 930 aa, Geobacter sulfurreducens PCA; identical to SEQ ID NO: 27327

SEQ ID NO: 53367 - DNA, 1347 bp, Lactobacillus johnsonii NCC 533; identical to SEQ ID NO: 27328
  CDS (1)..(1347): transl_table=11

SEQ ID NO: 53368 - protein, 448 aa, Lactobacillus johnsonii NCC 533; identical to SEQ ID NO: 27329

SEQ ID NO: 53369 - DNA, 1425 bp, Treponema denticola ATCC 35405; identical to SEQ ID NO: 27330
  CDS (1)..(1425): transl_table=11

SEQ ID NO: 53370 - protein, 474 aa, Treponema denticola ATCC 35405; identical to SEQ ID NO: 27331

SEQ ID NO: 53371 - DNA, 1509 bp, Treponema denticola ATCC 35405; identical to SEQ ID NO: 27332
  CDS (1)..(1509): transl_table=11

SEQ ID NO: 53372 - protein, 502 aa, Treponema denticola ATCC 35405; identical to SEQ ID NO: 27333

SEQ ID NO: 53373 - DNA, 1446 bp, Treponema denticola ATCC 35405; identical to SEQ ID NO: 27334
  CDS (1)..(1446): transl_table=11

SEQ ID NO: 53374 - protein, 481 aa, Treponema denticola ATCC 35405; identical to SEQ ID NO: 27335

SEQ ID NO: 53375 - DNA, 1509 bp, Treponema denticola ATCC 35405; identical to SEQ ID NO: 27336
  CDS (1)..(1509): transl_table=11

SEQ ID NO: 53376 - protein, 502 aa, Treponema denticola ATCC 35405; identical to SEQ ID NO: 27337

SEQ ID NO: 53377 - DNA, 1743 bp, Yersinia pestis biovar Medievalis str. 91001; identical to SEQ ID NO: 27338
  CDS (1)..(1743): transl_table=11

SEQ ID NO: 53378 - protein, 580 aa, Yersinia pestis biovar Medievalis str. 91001; identical to SEQ ID NO: 27339

SEQ ID NO: 53379 - DNA, 2085 bp, Neurospora crassa; identical to SEQ ID NO: 27340
  CDS (1)..(2085)

SEQ ID NO: 53380 - protein, 694 aa, Neurospora crassa; identical to SEQ ID NO: 27341

SEQ ID NO: 53381 - DNA, 2052 bp, Magnaporthe grisea 70-15; identical to SEQ ID NO: 27342
  CDS (1)..(2052)

SEQ ID NO: 53382 - protein, 683 aa, Magnaporthe grisea 70-15; identical to SEQ ID NO: 27343

SEQ ID NO: 53383 - DNA, 1965 bp, Gibberella zeae PH-1; identical to SEQ ID NO: 27344
  CDS (1)..(1965)

SEQ ID NO: 53384 - protein, 654 aa, Gibberella zeae PH-1; identical to SEQ ID NO: 27345

SEQ ID NO: 53385 - DNA, 2004 bp, Ustilago maydis 521; identical to SEQ ID NO: 27346
  CDS (1)..(2004)

SEQ ID NO: 53386 - protein, 667 aa, Ustilago maydis 521; identical to SEQ ID NO: 27347

SEQ ID NO: 53387 - DNA, 1635 bp, Candida glabrata CBS138; identical to SEQ ID NO: 27348
  CDS (1)..(1635)

SEQ ID NO: 53388 - protein, 544 aa, Candida glabrata CBS138; identical to SEQ ID NO: 27349

SEQ ID NO: 53389 - DNA, 1566 bp, Kluyveromyces lactis NRRL Y-1140; identical to SEQ ID NO: 27350
  CDS (1)..(1566)

SEQ ID NO: 53390 - protein, 521 aa, Kluyveromyces lactis NRRL Y-1140; identical to SEQ ID NO: 27351

SEQ ID NO: 53391 - DNA, 1641 bp, Debaryomyces hansenii CBS767; identical to SEQ ID NO: 27352
  CDS (1)..(1641)

SEQ ID NO: 53392 - protein, 546 aa, Debaryomyces hansenii CBS767; identical to SEQ ID NO: 27353

SEQ ID NO: 53393 - DNA, 1503 bp, Yarrowia lipolytica CLIB99; identical to SEQ ID NO: 27354
  CDS (1)..(1503)

SEQ ID NO: 53394 - protein, 500 aa, Yarrowia lipolytica CLIB99; identical to SEQ ID NO: 27355

SEQ ID NO: 53395 - DNA, 1632 bp, Cryptococcus neoformans var. neoformans JEC21; identical to SEQ ID NO: 27356
  CDS (1)..(1632)

SEQ ID NO: 53396 - protein, 543 aa, Cryptococcus neoformans var. neoformans JEC21; identical to SEQ ID NO: 27357

SEQ ID NO: 53397 - DNA, 1638 bp, Candida albicans SC5314; identical to SEQ ID NO: 27358
  CDS (1)..(1638): transl_table=12

SEQ ID NO: 53398 - protein, 545 aa, Candida albicans SC5314; identical to SEQ ID NO: 27359

SEQ ID NO: 53399 - DNA, 1899 bp, Desulfovibrio vulgaris subsp. vulgaris str. Hildenborough; identical to SEQ ID NO: 27360
  CDS (1)..(1899): transl_table=11

SEQ ID NO: 53400 - protein, 632 aa, Desulfovibrio vulgaris subsp. vulgaris str. Hildenborough; identical to SEQ ID NO: 27361

SEQ ID NO: 53401 - DNA, 1527 bp, Bacillus anthracis str. Sterne; identical to SEQ ID NO: 27362
  CDS (1)..(1527): transl_table=11

SEQ ID NO: 53402 - protein, 508 aa, Bacillus anthracis str. Sterne; identical to SEQ ID NO: 27363

SEQ ID NO: 53403 - DNA, 1593 bp, Staphylococcus aureus subsp. aureus MRSA252; identical to SEQ ID NO: 27364
  CDS (1)..(1593): transl_table=11

SEQ ID NO: 53404 - protein, 530 aa, Staphylococcus aureus subsp. aureus MRSA252; identical to SEQ ID NO: 27365

SEQ ID NO: 53405 - DNA, 1476 bp, Erwinia carotovora subsp. atroseptica SCRI1043; identical to SEQ ID NO: 27366
  CDS (1)..(1476)

SEQ ID NO: 53406 - protein, 491 aa, Erwinia carotovora subsp. atroseptica SCRI1043; identical to SEQ ID NO: 27367

SEQ ID NO: 53407 - DNA, 1617 bp, Erwinia carotovora subsp. atroseptica SCRI1043; identical to SEQ ID NO: 27368
  CDS (1)..(1617)

SEQ ID NO: 53408 - protein, 538 aa, Erwinia carotovora subsp. atroseptica SCRI1043; identical to SEQ ID NO: 27369

SEQ ID NO: 53409 - DNA, 1380 bp, Desulfotalea psychrophila LSv54; identical to SEQ ID NO: 27370
  CDS (1)..(1380): transl_table=11

SEQ ID NO: 53410 - protein, 459 aa, Desulfotalea psychrophila LSv54; identical to SEQ ID NO: 27371

SEQ ID NO: 53411 - DNA, 1491 bp, Yersinia pseudotuberculosis IP 32953; identical to SEQ ID NO: 27372
  CDS (1)..(1491): transl_table=11

SEQ ID NO: 53412 - protein, 496 aa, Yersinia pseudotuberculosis IP 32953; identical to SEQ ID NO: 27373

SEQ ID NO: 53413 - DNA, 1743 bp, Yersinia pseudotuberculosis IP 32953; identical to SEQ ID NO: 27374
  CDS (1)..(1743): transl_table=11

SEQ ID NO: 53414 - protein, 580 aa, Yersinia pseudotuberculosis IP 32953; identical to SEQ ID NO: 27375

SEQ ID NO: 53415 - DNA, 1593 bp, Yersinia pseudotuberculosis IP 32953; identical to SEQ ID NO: 27376
  CDS (1)..(1593): transl_table=11

SEQ ID NO: 53416 - protein, 530 aa, Yersinia pseudotuberculosis IP 32953; identical to SEQ ID NO: 27377

SEQ ID NO: 53417 - DNA, 1764 bp, Yersinia pseudotuberculosis IP 32953; identical to SEQ ID NO: 27378
  CDS (1)..(1764): transl_table=11

SEQ ID NO: 53418 - protein, 587 aa, Yersinia pseudotuberculosis IP 32953; identical to SEQ ID NO: 27379

SEQ ID NO: 53419 - DNA, 1689 bp, Symbiobacterium thermophilum IAM 14863; identical to SEQ ID NO: 27380
  CDS (1)..(1689): transl_table=11

SEQ ID NO: 53420 - protein, 562 aa, Symbiobacterium thermophilum IAM 14863; identical to SEQ ID NO: 27381

SEQ ID NO: 53421 - DNA, 1533 bp, Bacillus cereus E33L; identical to SEQ ID NO: 27382
  CDS (1)..(1533): transl_table=11

SEQ ID NO: 53422 - protein, 510 aa, Bacillus cereus E33L; identical to SEQ ID NO: 27383

SEQ ID NO: 53423 - DNA, 1470 bp, Mannheimia succiniciproducens MBEL55E; identical to SEQ ID NO: 27384
  CDS (1)..(1470): transl_table=11

SEQ ID NO: 53424 - protein, 489 aa, Mannheimia succiniciproducens MBEL55E; identical to SEQ ID NO: 27385

SEQ ID NO: 53425 - DNA, 2736 bp, Mannheimia succiniciproducens MBEL55E; identical to SEQ ID NO: 27386
  CDS (1)..(2736): transl_table=11

SEQ ID NO: 53426 - protein, 911 aa, Mannheimia succiniciproducens MBEL55E; identical to SEQ ID NO: 27387

SEQ ID NO: 53427 - DNA, 1461 bp, Bacteroides fragilis YCH46; identical to SEQ ID NO: 27388
  CDS (1)..(1461): transl_table=11

SEQ ID NO: 53428 - protein, 486 aa, Bacteroides fragilis YCH46; identical to SEQ ID NO: 27389

SEQ ID NO: 53429 - DNA, 1455 bp, Bacteroides fragilis YCH46; identical to SEQ ID NO: 27390
  CDS (1)..(1455): transl_table=11

SEQ ID NO: 53430 - protein, 484 aa, Bacteroides fragilis YCH46; identical to SEQ ID NO: 27391

SEQ ID NO: 53431 - DNA, 1650 bp, Burkholderia mallei ATCC 23344; identical to SEQ ID NO: 27392
  CDS (1)..(1650): transl_table=11

SEQ ID NO: 53432 - protein, 549 aa, Burkholderia mallei ATCC 23344; identical to SEQ ID NO: 27393

SEQ ID NO: 53433 - DNA, 3216 bp, Burkholderia mallei ATCC 23344; identical to SEQ ID NO: 27394
  CDS (1)..(3216): transl_table=11

SEQ ID NO: 53434 - protein, 1071 aa, Burkholderia mallei ATCC 23344; identical to SEQ ID NO: 27395

SEQ ID NO: 53435 - DNA, 3225 bp, Burkholderia pseudomallei K96243; identical to SEQ ID NO: 27396
  CDS (1)..(3225): transl_table=11

SEQ ID NO: 53436 - protein, 1074 aa, Burkholderia pseudomallei K96243; identical to SEQ ID NO: 27397

SEQ ID NO: 53437 - DNA, 1641 bp, Methylococcus capsulatus str. Bath; identical to SEQ ID NO: 27398
  CDS (1)..(1641): transl_table=11

SEQ ID NO: 53438 - protein, 546 aa, Methylococcus capsulatus str. Bath; identical to SEQ ID NO: 27399

SEQ ID NO: 53439 - DNA, 2724 bp, Methylococcus capsulatus str. Bath; identical to SEQ ID NO: 27400
  CDS (1)..(2724): transl_table=11

SEQ ID NO: 53440 - protein, 907 aa, Methylococcus capsulatus str. Bath; identical to SEQ ID NO: 27401

SEQ ID NO: 53441 - DNA, 1446 bp, Mycoplasma hyopneumoniae 232; identical to SEQ ID NO: 27402
  CDS (1)..(1446): transl_table=4

SEQ ID NO: 53442 - protein, 481 aa, Mycoplasma hyopneumoniae 232; identical to SEQ ID NO: 27403

SEQ ID NO: 53443 - DNA, 1686 bp, Nocardia farcinica IFM 10152; identical to SEQ ID NO: 27404
  CDS (1)..(1686): transl_table=11

SEQ ID NO: 53444 - protein, 561 aa, Nocardia farcinica IFM 10152; identical to SEQ ID NO: 27405

SEQ ID NO: 53445 - DNA, 783 bp, Streptococcus thermophilus LMG 18311; identical to SEQ ID NO: 27406
  CDS (1)..(783): transl_table=11

SEQ ID NO: 53446 - protein, 260 aa, Streptococcus thermophilus LMG 18311; identical to SEQ ID NO: 27407

SEQ ID NO: 53447 - DNA, 1707 bp, Streptococcus thermophilus CNRZ1066; identical to SEQ ID NO: 27408
  CDS (1)..(1707): transl_table=11

SEQ ID NO: 53448 - protein, 568 aa, Streptococcus thermophilus CNRZ1066; identical to SEQ ID NO: 27409

SEQ ID NO: 53449 - DNA, 1590 bp, Salmonella enterica subsp. enterica serovar Paratyphi A str. ATCC; identical to SEQ ID NO: 27410
  CDS (1)..(1590): transl_table=11

SEQ ID NO: 53450 - protein, 529 aa, Salmonella enterica subsp. enterica serovar Paratyphi A str. ATCC; identical to SEQ ID NO: 27411

SEQ ID NO: 53451 - DNA, 1572 bp, Salmonella enterica subsp. enterica serovar Paratyphi A str. ATCC; identical to SEQ ID NO: 27412
  CDS (1)..(1572): transl_table=11

SEQ ID NO: 53452 - protein, 523 aa, Salmonella enterica subsp. enterica serovar Paratyphi A str. ATCC; identical to SEQ ID NO: 27413

SEQ ID NO: 53453 - DNA, 1476 bp, Salmonella enterica subsp. enterica serovar Paratyphi A str. ATCC; identical to SEQ ID NO: 27414
  CDS (1)..(1476): transl_table=11

SEQ ID NO: 53454 - protein, 491 aa, Salmonella enterica subsp. enterica serovar Paratyphi A str. ATCC; identical to SEQ ID NO: 27415

SEQ ID NO: 53455 - DNA, 1536 bp, Salmonella enterica subsp. enterica serovar Paratyphi A str. ATCC; identical to SEQ ID NO: 27416
  CDS (1)..(1536): transl_table=11

SEQ ID NO: 53456 - protein, 511 aa, Salmonella enterica subsp. enterica serovar Paratyphi A str. ATCC; identical to SEQ ID NO: 27417

SEQ ID NO: 53457 - DNA, 1614 bp, Idiomarina loihiensis L2TR; identical to SEQ ID NO: 27418
  CDS (1)..(1614): transl_table=11

SEQ ID NO: 53458 - protein, 537 aa, Idiomarina loihiensis L2TR; identical to SEQ ID NO: 27419

SEQ ID NO: 53459 - DNA, 2919 bp, Azoarcus sp. EbN1; identical to SEQ ID NO: 27420
  CDS (1)..(2919): transl_table=11

SEQ ID NO: 53460 - protein, 972 aa, Azoarcus sp. EbN1; identical to SEQ ID NO: 27421

SEQ ID NO: 53461 - DNA, 2829 bp, Zymomonas mobilis subsp. mobilis ZM4; identical to SEQ ID NO: 27422
  CDS (1)..(2829): transl_table=11

SEQ ID NO: 53462 - protein, 942 aa, Zymomonas mobilis subsp. mobilis ZM4; identical to SEQ ID NO: 27423

SEQ ID NO: 53463 - DNA, 1593 bp, Zymomonas mobilis subsp. mobilis ZM4; identical to SEQ ID NO: 27424
  CDS (1)..(1593): transl_table=11

SEQ ID NO: 53464 - protein, 530 aa, Zymomonas mobilis subsp. mobilis ZM4; identical to SEQ ID NO: 27425

SEQ ID NO: 53465 - DNA, 1599 bp, Silicibacter pomeroyi DSS-3; identical to SEQ ID NO: 27426
  CDS (1)..(1599): transl_table=11

SEQ ID NO: 53466 - protein, 532 aa, Silicibacter pomeroyi DSS-3; identical to SEQ ID NO: 27427

SEQ ID NO: 53467 - DNA, 2727 bp, Silicibacter pomeroyi DSS-3; identical to SEQ ID NO: 27428
  CDS (1)..(2727): transl_table=11

SEQ ID NO: 53468 - protein, 908 aa, Silicibacter pomeroyi DSS-3; identical to SEQ ID NO: 27429

SEQ ID NO: 53469 - DNA, 1665 bp, Synechococcus elongatus PCC 6301; identical to SEQ ID NO: 27430
  CDS (1)..(1665): transl_table=11

SEQ ID NO: 53470 - protein, 554 aa, Synechococcus elongatus PCC 6301; identical to SEQ ID NO: 27431

SEQ ID NO: 53471 - DNA, 1593 bp, Staphylococcus aureus subsp. aureus COL; identical to SEQ ID NO: 27432
  CDS (1)..(1593): transl_table=11

SEQ ID NO: 53472 - protein, 530 aa, Staphylococcus aureus subsp. aureus COL; identical to SEQ ID NO: 27433

SEQ ID NO: 53473 - DNA, 1701 bp, Lactobacillus acidophilus NCFM; identical to SEQ ID NO: 27434
  CDS (1)..(1701): transl_table=11

SEQ ID NO: 53474 - protein, 566 aa, Lactobacillus acidophilus NCFM; identical to SEQ ID NO: 27435

SEQ ID NO: 53475 - DNA, 1560 bp, Salmonella enterica subsp. enterica serovar Choleraesuis str; identical to SEQ ID NO: 27436
  CDS (1)..(1560): transl_table=11

SEQ ID NO: 53476 - protein, 519 aa, Salmonella enterica subsp. enterica serovar Choleraesuis str; identical to SEQ ID NO: 27437

SEQ ID NO: 53477 - DNA, 1596 bp, Salmonella enterica subsp. enterica serovar Choleraesuis str; identical to SEQ ID NO: 27438
  CDS (1)..(1596): transl_table=11

SEQ ID NO: 53478 - protein, 531 aa, Salmonella enterica subsp. enterica serovar Choleraesuis str; identical to SEQ ID NO: 27439

SEQ ID NO: 53479 - DNA, 1590 bp, Salmonella enterica subsp. enterica serovar Choleraesuis str; identical to SEQ ID NO: 27440
  CDS (1)..(1590): transl_table=11

SEQ ID NO: 53480 - protein, 529 aa, Salmonella enterica subsp. enterica serovar Choleraesuis str; identical to SEQ ID NO: 27441

SEQ ID NO: 53481 - DNA, 2742 bp, Salmonella enterica subsp. enterica serovar Choleraesuis str; identical to SEQ ID NO: 27442
  CDS (1)..(2742): transl_table=11

SEQ ID NO: 53482 - protein, 913 aa, Salmonella enterica subsp. enterica serovar Choleraesuis str; identical to SEQ ID NO: 27443

SEQ ID NO: 53483 - DNA, 1584 bp, Pseudomonas syringae pv. syringae B728a; identical to SEQ ID NO: 27444
  CDS (1)..(1584)

SEQ ID NO: 53484 - protein, 527 aa, Pseudomonas syringae pv. syringae B728a; identical to SEQ ID NO: 27445

SEQ ID NO: 53485 - DNA, 1578 bp, Sulfolobus acidocaldarius DSM 639; identical to SEQ ID NO: 27446
  CDS (1)..(1578): transl_table=11

SEQ ID NO: 53486 - protein, 525 aa, Sulfolobus acidocaldarius DSM 639; identical to SEQ ID NO: 27447

SEQ ID NO: 53487 - DNA, 1374 bp, Leuconostoc mesenteroides subsp. mesenteroides ATCC 8293; identical to SEQ ID NO: 27448
  CDS (1)..(1374)

SEQ ID NO: 53488 - protein, 457 aa, Leuconostoc mesenteroides subsp. mesenteroides ATCC 8293; identical to SEQ ID NO: 27449

SEQ ID NO: 53489 - DNA, 1677 bp, Leuconostoc mesenteroides subsp. mesenteroides ATCC 8293; identical to SEQ ID NO: 27450
  CDS (1)..(1677)

SEQ ID NO: 53490 - protein, 558 aa, Leuconostoc mesenteroides subsp. mesenteroides ATCC 8293; identical to SEQ ID NO: 27451

SEQ ID NO: 53491 - DNA, 1674 bp, Bifidobacterium longum DJO10A; identical to SEQ ID NO: 27452
  CDS (1)..(1674)

SEQ ID NO: 53492 - protein, 557 aa, Bifidobacterium longum DJO10A; identical to SEQ ID NO: 27453

SEQ ID NO: 53493 - DNA, 1518 bp, Haemophilus somnus 129PT; identical to SEQ ID NO: 27454
  CDS (1)..(1518)

SEQ ID NO: 53494 - protein, 505 aa, Haemophilus somnus 129PT; identical to SEQ ID NO: 27455

SEQ ID NO: 53495 - DNA, 1566 bp, Pseudomonas syringae pv. syringae B728a; identical to SEQ ID NO: 27456
  CDS (1)..(1566)

SEQ ID NO: 53496 - protein, 521 aa, Pseudomonas syringae pv. syringae B728a; identical to SEQ ID NO: 27457

SEQ ID NO: 53497 - DNA, 1545 bp, Desulfovibrio desulfuricans G20; identical to SEQ ID NO: 27458
  CDS (1)..(1545)

SEQ ID NO: 53498 - protein, 514 aa, Desulfovibrio desulfuricans G20; identical to SEQ ID NO: 27459

SEQ ID NO: 53499 - DNA, 1473 bp, Actinobacillus pleuropneumoniae serovar 1 str. 4074; identical to SEQ ID NO: 27460
  CDS (1)..(1473)

SEQ ID NO: 53500 - protein, 490 aa, Actinobacillus pleuropneumoniae serovar 1 str. 4074; identical to SEQ ID NO: 27461

SEQ ID NO: 53501 - DNA, 2613 bp, Actinobacillus pleuropneumoniae serovar 1 str. 4074; identical to SEQ ID NO: 27462
  CDS (1)..(2613)

SEQ ID NO: 53502 - protein, 870 aa, Actinobacillus pleuropneumoniae serovar 1 str. 4074; identical to SEQ ID NO: 27463

SEQ ID NO: 53503 - DNA, 2763 bp, Dechloromonas aromatica RCB; identical to SEQ ID NO: 27464
  CDS (1)..(2763)

SEQ ID NO: 53504 - protein, 920 aa, Dechloromonas aromatica RCB; identical to SEQ ID NO: 27465

SEQ ID NO: 53505 - DNA, 1632 bp, Rhodobacter sphaeroides 2.4.1; identical to SEQ ID NO: 27466
  CDS (1)..(1632)

SEQ ID NO: 53506 - protein, 543 aa, Rhodobacter sphaeroides 2.4.1; identical to SEQ ID NO: 27467

SEQ ID NO: 53507 - DNA, 1557 bp, Burkholderia cepacia R18194; identical to SEQ ID NO: 27468
  CDS (1)..(1557)

SEQ ID NO: 53508 - protein, 518 aa, Burkholderia cepacia R18194; identical to SEQ ID NO: 27469

SEQ ID NO: 53509 - DNA, 1614 bp, Pseudomonas fluorescens PfO-1; identical to SEQ ID NO: 27470
  CDS (1)..(1614)

SEQ ID NO: 53510 - protein, 537 aa, Pseudomonas fluorescens PfO-1; identical to SEQ ID NO: 27471

SEQ ID NO: 53511 - DNA, 2721 bp, Pseudomonas fluorescens PfO-1; identical to SEQ ID NO: 27472
  CDS (1)..(2721)

SEQ ID NO: 53512 - protein, 906 aa, Pseudomonas fluorescens PfO-1; identical to SEQ ID NO: 27473

SEQ ID NO: 53513 - DNA, 1911 bp, Pseudomonas fluorescens PfO-1; identical to SEQ ID NO: 27474
  CDS (1)..(1911)

SEQ ID NO: 53514 - protein, 636 aa, Pseudomonas fluorescens PfO-1; identical to SEQ ID NO: 27475

SEQ ID NO: 53515 - DNA, 1563 bp, Pseudomonas fluorescens PfO-1; identical to SEQ ID NO: 27476
  CDS (1)..(1563)

SEQ ID NO: 53516 - protein, 520 aa, Pseudomonas fluorescens PfO-1; identical to SEQ ID NO: 27477

SEQ ID NO: 53517 - DNA, 1662 bp, Rhodospirillum rubrum; identical to SEQ ID NO: 27478
  CDS (1)..(1662)

SEQ ID NO: 53518 - protein, 553 aa, Rhodospirillum rubrum; identical to SEQ ID NO: 27479

SEQ ID NO: 53519 - DNA, 1569 bp, Burkholderia fungorum LB400; identical to SEQ ID NO: 27480
  CDS (1)..(1569)

SEQ ID NO: 53520 - protein, 522 aa, Burkholderia fungorum LB400; identical to SEQ ID NO: 27481

SEQ ID NO: 53521 - DNA, 786 bp, Thermobifida fusca; identical to SEQ ID NO: 27482
  CDS (1)..(786)

SEQ ID NO: 53522 - protein, 261 aa, Thermobifida fusca; identical to SEQ ID NO: 27483

SEQ ID NO: 53523 - DNA, 1506 bp, Cytophaga hutchinsonii; identical to SEQ ID NO: 27484
  CDS (1)..(1506)

SEQ ID NO: 53524 - protein, 501 aa, Cytophaga hutchinsonii; identical to SEQ ID NO: 27485

SEQ ID NO: 53525 - DNA, 1377 bp, Oenococcus oeni PSU-1; identical to SEQ ID NO: 27486
  CDS (1)..(1377)

SEQ ID NO: 53526 - protein, 458 aa, Oenococcus oeni PSU-1; identical to SEQ ID NO: 27487

SEQ ID NO: 53527 - DNA, 1689 bp, Oenococcus oeni PSU-1; identical to SEQ ID NO: 27488
  CDS (1)..(1689)

SEQ ID NO: 53528 - protein, 562 aa, Oenococcus oeni PSU-1; identical to SEQ ID NO: 27489

SEQ ID NO: 53529 - DNA, 1587 bp, Oenococcus oeni PSU-1; identical to SEQ ID NO: 27490
  CDS (1)..(1587)

SEQ ID NO: 53530 - protein, 528 aa, Oenococcus oeni PSU-1; identical to SEQ ID NO: 27491

SEQ ID NO: 53531 - DNA, 1653 bp, Streptococcus suis 89/1591; identical to SEQ ID NO: 27492
  CDS (1)..(1653)

SEQ ID NO: 53532 - protein, 550 aa, Streptococcus suis 89/1591; identical to SEQ ID NO: 27493

SEQ ID NO: 53533 - DNA, 2751 bp, Pseudomonas aeruginosa UCBPP-PA14; identical to SEQ ID NO: 27494
  CDS (1)..(2751)

SEQ ID NO: 53534 - protein, 916 aa, Pseudomonas aeruginosa UCBPP-PA14; identical to SEQ ID NO: 27495

SEQ ID NO: 53535 - DNA, 1671 bp, Ralstonia eutropha JMP134; identical to SEQ ID NO: 27496
  CDS (1)..(1671)

SEQ ID NO: 53536 - protein, 556 aa, Ralstonia eutropha JMP134; identical to SEQ ID NO: 27497

SEQ ID NO: 53537 - DNA, 1524 bp, Chloroflexus aurantiacus; identical to SEQ ID NO: 27498
  CDS (1)..(1524)

SEQ ID NO: 53538 - protein, 507 aa, Chloroflexus aurantiacus; identical to SEQ ID NO: 27499

SEQ ID NO: 53539 - DNA, 1845 bp, Chloroflexus aurantiacus; identical to SEQ ID NO: 27500
  CDS (1)..(1845)

SEQ ID NO: 53540 - protein, 614 aa, Chloroflexus aurantiacus; identical to SEQ ID NO: 27501

SEQ ID NO: 53541 - DNA, 1356 bp, Lactobacillus delbrueckii subsp. bulgaricus ATCC BAA-365; identical to SEQ ID NO: 27502
  CDS (1)..(1356)

SEQ ID NO: 53542 - protein, 451 aa, Lactobacillus delbrueckii subsp. bulgaricus ATCC BAA-365; identical to SEQ ID NO: 27503

SEQ ID NO: 53543 - DNA, 1677 bp, Streptococcus thermophilus LMD-9; identical to SEQ ID NO: 27504
  CDS (1)..(1677)

SEQ ID NO: 53544 - protein, 558 aa, Streptococcus thermophilus LMD-9; identical to SEQ ID NO: 27505

SEQ ID NO: 53545 - DNA, 1452 bp, Deinococcus geothermalis DSM 11300 [sequence omitted]

SEQ ID NO: 53546 - protein, 483 aa, Deinococcus geothermalis DSM 11300; identical to SEQ ID NO: 27507

SEQ ID NO: 53547 - DNA, 1437 bp, Anaeromyxobacter dehalogenans 2CP-C; identical to SEQ ID NO: 27508
  CDS (1)..(1437): transl_table=11

SEQ ID NO: 53548 - protein, 478 aa, Anaeromyxobacter dehalogenans 2CP-C; identical to SEQ ID NO: 27509

SEQ ID NO: 53549 - DNA, 2736 bp, Azotobacter vinelandii AvOP; identical to SEQ ID NO: 27510
  CDS (1)..(2736): transl_table=11

SEQ ID NO: 53550 - protein, 911 aa, Azotobacter vinelandii AvOP; identical to SEQ ID NO: 27511

SEQ ID NO: 53551 - DNA, 1590 bp, Azotobacter vinelandii AvOP; identical to SEQ ID NO: 27512
  CDS (1)..(1590): transl_table=11

SEQ ID NO: 53552 - protein, 529 aa, Azotobacter vinelandii AvOP; identical to SEQ ID NO: 27513

SEQ ID NO: 53553 - DNA, 1638 bp, Azotobacter vinelandii AvOP; identical to SEQ ID NO: 27514
  CDS (1)..(1638): transl_table=11

SEQ ID NO: 53554 - protein, 545 aa, Azotobacter vinelandii AvOP; identical to SEQ ID NO: 27515

SEQ ID NO: 53555 - DNA, 1623 bp, Burkholderia vietnamiensis G4; identical to SEQ ID NO: 27516
  CDS (1)..(1623): transl_table=11

SEQ ID NO: 53556 - protein, 540 aa, Burkholderia vietnamiensis G4; identical to SEQ ID NO: 27517

SEQ ID NO: 53557 - DNA, 2832 bp, Burkholderia vietnamiensis G4; identical to SEQ ID NO: 27518
  CDS (1)..(2832): transl_table=11

SEQ ID NO: 53558 - protein, 943 aa, Burkholderia vietnamiensis G4; identical to SEQ ID NO: 27519

SEQ ID NO: 53559 - DNA, 2829 bp, Burkholderia vietnamiensis G4; identical to SEQ ID NO: 27520
  CDS (1)..(2829): transl_table=11

SEQ ID NO: 53560 - protein, 942 aa, Burkholderia vietnamiensis G4; identical to SEQ ID NO: 27521

SEQ ID NO: 53561 - DNA, 3240 bp, Burkholderia mallei NCTC 10247; identical to SEQ ID NO: 27522
  CDS (1)..(3240)

SEQ ID NO: 53562 - protein, 1079 aa, Burkholderia mallei NCTC 10247; identical to SEQ ID NO: 27523

SEQ ID NO: 53563 - DNA, 1635 bp, Burkholderia cenocepacia AU 1054; identical to SEQ ID NO: 27524
  CDS (1)..(1635): transl_table=11

SEQ ID NO: 53564 - protein, 544 aa, Burkholderia cenocepacia AU 1054; identical to SEQ ID NO: 27525

SEQ ID NO: 53565 - DNA, 1632 bp, Burkholderia pseudomallei 1655; identical to SEQ ID NO: 27526
  CDS (1)..(1632)

SEQ ID NO: 53566 - protein, 543 aa, Burkholderia pseudomallei 1655; identical to SEQ ID NO: 27527

SEQ ID NO: 53567 - DNA, 2727 bp, Chromohalobacter salexigens DSM 3043; identical to SEQ ID NO: 27528
  CDS (1)..(2727): transl_table=11

SEQ ID NO: 53568 - protein, 908 aa, Chromohalobacter salexigens DSM 3043; identical to SEQ ID NO: 27529

SEQ ID NO: 53569 - DNA, 1680 bp, Chromohalobacter salexigens DSM 3043; identical to SEQ ID NO: 27530
  CDS (1)..(1680): transl_table=11

SEQ ID NO: 53570 - protein, 559 aa, Chromohalobacter salexigens DSM 3043; identical to SEQ ID NO: 27531

SEQ ID NO: 53571 - DNA, 1650 bp, Burkholderia pseudomallei 1710a; identical to SEQ ID NO: 27532
  CDS (1)..(1650)

SEQ ID NO: 53572 - protein, 549 aa, Burkholderia pseudomallei 1710a; identical to SEQ ID NO: 27533

SEQ ID NO: 53573 - DNA, 1650 bp, Burkholderia pseudomallei 668; identical to SEQ ID NO: 27534
  CDS (1)..(1650)

SEQ ID NO: 53574 - protein, 549 aa, Burkholderia pseudomallei 668; identical to SEQ ID NO: 27535

SEQ ID NO: 53575 - DNA, 3261 bp, Burkholderia pseudomallei Pasteur; identical to SEQ ID NO: 27536
  CDS (1)..(3261): n means a or g or c or t/u, s means g or c

SEQ ID NO: 53576 - protein, 1086 aa, Burkholderia pseudomallei Pasteur; identical to SEQ ID NO: 27537
  Xaa in positions 459 and 489 is unknown

SEQ ID NO: 53577 - DNA, 1692 bp, Polaromonas sp. JS666; identical to SEQ ID NO: 27538
  CDS (1)..(1692): transl_table=11

SEQ ID NO: 53578 - protein, 563 aa, Polaromonas sp. JS666; identical to SEQ ID NO: 27539

SEQ ID NO: 53579 - DNA, 1668 bp, Polaromonas sp. JS666; identical to SEQ ID NO: 27540
  CDS (1)..(1668): transl_table=11

SEQ ID NO: 53580 - protein, 555 aa, Polaromonas sp. JS666; identical to SEQ ID NO: 27541

SEQ ID NO: 53581 - DNA, 1560 bp, Exiguobacterium sp. 255-15; identical to SEQ ID NO: 27542
  CDS (1)..(1560): transl_table=11

SEQ ID NO: 53582 - protein, 519 aa, Exiguobacterium sp. 255-15; identical to SEQ ID NO: 27543

SEQ ID NO: 53583 - DNA, 1506 bp, Methanosarcina barkeri str. fusaro; identical to SEQ ID NO: 27544
  CDS (1)..(1506): transl_table=11

SEQ ID NO: 53584 - protein, 501 aa, Methanosarcina barkeri str. fusaro; identical to SEQ ID NO: 27545

SEQ ID NO: 53585 - DNA, 1449 bp, Desulfuromonas acetoxidans DSM 684; identical to SEQ ID NO: 27546
  CDS (1)..(1449): transl_table=11

SEQ ID NO: 53586 - protein, 482 aa, Desulfuromonas acetoxidans DSM 684; identical to SEQ ID NO: 27547

SEQ ID NO: 53587 - DNA, 1584 bp, Jannaschia sp. CCS1; identical to SEQ ID NO: 27548
  CDS (1)..(1584): transl_table=11

SEQ ID NO: 53588 - protein, 527 aa, Jannaschia sp. CCS1; identical to SEQ ID NO: 27549

SEQ ID NO: 53589 - DNA, 1503 bp, Desulfitobacterium hafniense DCB-2; identical to SEQ ID NO: 27550
  CDS (1)..(1503): transl_table=11

SEQ ID NO: 53590 - protein, 500 aa, Desulfitobacterium hafniense DCB-2; identical to SEQ ID NO: 27551

SEQ ID NO: 53591 - DNA, 2766 bp, Methylobacillus flagellatus KT; identical to SEQ ID NO: 27552
  CDS (1)..(2766): transl_table=11

SEQ ID NO: 53592 - protein, 921 aa, Methylobacillus flagellatus KT; identical to SEQ ID NO: 27553

SEQ ID NO: 53593 - DNA, 1602 bp, Methylobacillus flagellatus KT; identical to SEQ ID NO: 27554
  CDS (1)..(1602): transl_table=11

SEQ ID NO: 53594 - protein, 533 aa, Methylobacillus flagellatus KT; identical to SEQ ID NO: 27555

SEQ ID NO: 53595 - DNA, 1518 bp, Frankia sp. EAN1pec; identical to SEQ ID NO: 27556
  CDS (1)..(1518): transl_table=11

SEQ ID NO: 53596 - protein, 505 aa, Frankia sp. EAN1pec; identical to SEQ ID NO: 27557

SEQ ID NO: 53597 - DNA, 1497 bp, Shewanella baltica OS155; identical to SEQ ID NO: 27558
  CDS (1)..(1497): transl_table=11

SEQ ID NO: 53598 - protein, 498 aa, Shewanella baltica OS155; identical to SEQ ID NO: 27559

SEQ ID NO: 53599 - DNA, 1596 bp, Shewanella amazonensis SB2B; identical to SEQ ID NO: 27560
  CDS (1)..(1596): transl_table=11

SEQ ID NO: 53600 - protein, 531 aa, Shewanella amazonensis SB2B; identical to SEQ ID NO: 27561

SEQ ID NO: 53601 - DNA, 2760 bp, Ralstonia metallidurans CH34; identical to SEQ ID NO: 27562
  CDS (1)..(2760): transl_table=11

SEQ ID NO: 53602 - protein, 919 aa, Ralstonia metallidurans CH34; identical to SEQ ID NO: 27563

SEQ ID NO: 53603 - DNA, 1635 bp, Mesorhizobium sp. BNC1; identical to SEQ ID NO: 27564
  CDS (1)..(1635): transl_table=11

SEQ ID NO: 53604 - protein, 544 aa, Mesorhizobium sp. BNC1; identical to SEQ ID NO: 27565

SEQ ID NO: 53605 - DNA, 1629 bp, Mesorhizobium sp. BNC1; identical to SEQ ID NO: 27566
  CDS (1)..(1629): transl_table=11

SEQ ID NO: 53606 - protein, 542 aa, Mesorhizobium sp. BNC1; identical to SEQ ID NO: 27567

SEQ ID NO: 53607 - DNA, 1656 bp, Kineococcus radiotolerans SRS30216; identical to SEQ ID NO: 27568
  CDS (1)..(1656): transl_table=11

SEQ ID NO: 53608 - protein, 551 aa, Kineococcus radiotolerans SRS30216; identical to SEQ ID NO: 27569

SEQ ID NO: 53609 - DNA, 1593 bp, Silicibacter sp. TM1040; identical to SEQ ID NO: 27570
  CDS (1)..(1593): transl_table=11

SEQ ID NO: 53610 - protein, 530 aa, Silicibacter sp. TM1040; identical to SEQ ID NO: 27571

SEQ ID NO: 53611 - DNA, 1614 bp, Paracoccus denitrificans PD1222; identical to SEQ ID NO: 27572
  CDS (1)..(1614): transl_table=11

SEQ ID NO: 53612 - protein, 537 aa, Paracoccus denitrificans PD1222; identical to SEQ ID NO: 27573

SEQ ID NO: 53613 - DNA, 2517 bp, Paracoccus denitrificans PD1222; identical to SEQ ID NO: 27574
  CDS (1)..(2517): transl_table=11

SEQ ID NO: 53614 - protein, 838 aa, Paracoccus denitrificans PD1222; identical to SEQ ID NO: 27575

SEQ ID NO: 53615 - DNA, 1383 bp, Paracoccus denitrificans PD1222; identical to SEQ ID NO: 27576
  CDS (1)..(1383): transl_table=11

SEQ ID NO: 53616 - protein, 460 aa, Paracoccus denitrificans PD1222; identical to SEQ ID NO: 27577

SEQ ID NO: 53617 - DNA, 1470 bp, Shewanella frigidimarina NCIMB 400; identical to SEQ ID NO: 27578
  CDS (1)..(1470): transl_table=11

SEQ ID NO: 53618 - protein, 489 aa, Shewanella frigidimarina NCIMB 400; identical to SEQ ID NO: 27579

SEQ ID NO: 53619 - DNA, 2757 bp, Shewanella frigidimarina NCIMB 400; identical to SEQ ID NO: 27580
  CDS (1)..(2757): transl_table=11

SEQ ID NO: 53620 - protein, 918 aa, Shewanella frigidimarina NCIMB 400; identical to SEQ ID NO: 27581

SEQ ID NO: 53621 - DNA, 1611 bp, Burkholderia mallei JHU; identical to SEQ ID NO: 27582
  CDS (1)..(1611)

SEQ ID NO: 53622 - protein, 536 aa, Burkholderia mallei JHU; identical to SEQ ID NO: 27583

SEQ ID NO: 53623 - DNA, 1587 bp, Pseudomonas fluorescens; identical to SEQ ID NO: 27584
  CDS (1)..(1587): transl_table=11

SEQ ID NO: 53624 - protein, 528 aa, Pseudomonas fluorescens; identical to SEQ ID NO: 27585

SEQ ID NO: 53625 - DNA, 1632 bp, Cryptococcus neoformans var; identical to SEQ ID NO: 27586
  CDS (1)..(1632)

SEQ ID NO: 53626 - protein, 543 aa, Cryptococcus neoformans var; identical to SEQ ID NO: 27587

SEQ ID NO: 53627 - DNA, 1518 bp, Thermoanaerobacter ethanolicus; identical to SEQ ID NO: 27588
  CDS (1)..(1518): transl_table=11

SEQ ID NO: 53628 - protein, 505 aa, Thermoanaerobacter ethanolicus; identical to SEQ ID NO: 27589

SEQ ID NO: 53629 - DNA, 1515 bp, Bifidobacterium longum bv; identical to SEQ ID NO: 27590
  CDS (1)..(1515): transl_table=11

SEQ ID NO: 53630 - protein, 504 aa, Bifidobacterium longum bv; identical to SEQ ID NO: 27591

SEQ ID NO: 53631 - DNA, 2691 bp, Salmonella typhimurium; identical to SEQ ID NO: 27592
  CDS (1)..(2691): transl_table=11

SEQ ID NO: 53632 - protein, 896 aa, Salmonella typhimurium; identical to SEQ ID NO: 27593

SEQ ID NO: 53633 - DNA, 1476 bp, Treponema denticola; identical to SEQ ID NO: 27594
  CDS (1)..(1476): transl_table=11

SEQ ID NO: 53634 - protein, 491 aa, Treponema denticola; identical to SEQ ID NO: 27595

SEQ ID NO: 53635 - DNA, 1473 bp, Bacillus subtilis; identical to SEQ ID NO: 27596
  CDS (1)..(1473): transl_table=11

SEQ ID NO: 53636 - protein, 490 aa, Bacillus subtilis; identical to SEQ ID NO: 27597

SEQ ID NO: 53637 - DNA, 1707 bp, Enterococcus faecalis; identical to SEQ ID NO: 27598
  CDS (1)..(1707): transl_table=11

SEQ ID NO: 53638 - protein, 568 aa, Enterococcus faecalis; identical to SEQ ID NO: 27599

SEQ ID NO: 53639 - DNA, 1722 bp, Lactobacillus johnsonii; identical to SEQ ID NO: 27600
  CDS (1)..(1722): transl_table=11

SEQ ID NO: 53640 - protein, 573 aa, Lactobacillus johnsonii; identical to SEQ ID NO: 27601

SEQ ID NO: 53641 - DNA, 1584 bp, Oceanobacillus iheyensis; identical to SEQ ID NO: 27602
  CDS (1)..(1584): transl_table=11

SEQ ID NO: 53642 - protein, 527 aa, Oceanobacillus iheyensis; identical to SEQ ID NO: 27603

SEQ ID NO: 53643 - DNA, 1677 bp, Streptococcus agalactiae serotype III; identical to SEQ ID NO: 27604
  CDS (1)..(1677): transl_table=11

SEQ ID NO: 53644 - protein, 558 aa, Streptococcus agalactiae serotype III; identical to SEQ ID NO: 27605

SEQ ID NO: 53645 - DNA, 1677 bp, Streptococcus agalactiae serotype V; identical to SEQ ID NO: 27606
  CDS (1)..(1677): transl_table=11

SEQ ID NO: 53646 - protein, 558 aa, Streptococcus agalactiae serotype V; identical to SEQ ID NO: 27607

SEQ ID NO: 53647 - DNA, 1677 bp, Streptococcus mutans; identical to SEQ ID NO: 27608
  CDS (1)..(1677): transl_table=11

SEQ ID NO: 53648 - protein, 558 aa, Streptococcus mutans; identical to SEQ ID NO: 27609

SEQ ID NO: 53649 - DNA, 1683 bp, Streptococcus pneumoniae; identical to SEQ ID NO: 27610
  CDS (1)..(1683)

SEQ ID NO: 53650 - protein, 560 aa, Streptococcus pneumoniae; identical to SEQ ID NO: 27611

SEQ ID NO: 53651 - DNA, 1683 bp, Streptococcus pneumoniae; identical to SEQ ID NO: 27612
  CDS (1)..(1683): transl_table=11

SEQ ID NO: 53652 - protein, 560 aa, Streptococcus pneumoniae; identical to SEQ ID NO: 27613

SEQ ID NO: 53653 - DNA, 1707 bp, Clostridium perfringens; identical to SEQ ID NO: 27614
  CDS (1)..(1707): transl_table=11

SEQ ID NO: 53654 - protein, 568 aa, Clostridium perfringens; identical to SEQ ID NO: 27615

SEQ ID NO: 53655 - DNA, 1701 bp, Lactobacillus plantarum; identical to SEQ ID NO: 27616
  CDS (1)..(1701): transl_table=11

SEQ ID NO: 53656 - protein, 566 aa, Lactobacillus plantarum; identical to SEQ ID NO: 27617

SEQ ID NO: 53657 - DNA, 1587 bp, Methanosarcina acetivorans; identical to SEQ ID NO: 27618
  CDS (1)..(1587): transl_table=11

SEQ ID NO: 53658 - protein, 528 aa, Methanosarcina acetivorans; identical to SEQ ID NO: 27619

SEQ ID NO: 53659 - DNA, 2343 bp, Bifidobacterium longum; identical to SEQ ID NO: 27620
  CDS (1)..(2343)

SEQ ID NO: 53660 - protein, 780 aa, Bifidobacterium longum; identical to SEQ ID NO: 27621

SEQ ID NO: 53661 - DNA, 1695 bp, Photobacterium profundum; identical to SEQ ID NO: 27622
  CDS (1)..(1695): transl_table=11

SEQ ID NO: 53662 - protein, 564 aa, Photobacterium profundum; identical to SEQ ID NO: 27623

SEQ ID NO: 53663 - DNA, 1740 bp, Vibrio parahaemolyticus; identical to SEQ ID NO: 27624
  CDS (1)..(1740): transl_table=11

SEQ ID NO: 53664 - protein, 579 aa, Vibrio parahaemolyticus; identical to SEQ ID NO: 27625

SEQ ID NO: 53665 - DNA, 1725 bp, Vibrio vulnificus; identical to SEQ ID NO: 27626
  CDS (1)..(1725): transl_table=11

SEQ ID NO: 53666 - protein, 574 aa, Vibrio vulnificus; identical to SEQ ID NO: 27627

SEQ ID NO: 53667 - DNA, 1593 bp, Escherichia coli O157; identical to SEQ ID NO: 27628
  CDS (1)..(1593): transl_table=11

SEQ ID NO: 53668 - protein, 530 aa, Escherichia coli O157; identical to SEQ ID NO: 27629

SEQ ID NO: 53669 - DNA, 1590 bp, Escherichia coli; identical to SEQ ID NO: 27630
  CDS (1)..(1590): transl_table=11

SEQ ID NO: 53670 - protein, 529 aa, Escherichia coli; identical to SEQ ID NO: 27631

SEQ ID NO: 53671 - DNA, 1512 bp, Escherichia coli; identical to SEQ ID NO: 27632
  CDS (1)..(1512): transl_table=11

SEQ ID NO: 53672 - protein, 503 aa, Escherichia coli; identical to SEQ ID NO: 27633

SEQ ID NO: 53673 - DNA, 25 bp, Artificial sequence
  (1)..(25): primer
atgtcatcgttgcaaattttgcaag

SEQ ID NO: 53674 - DNA, 28 bp, Artificial sequence
  (1)..(28): primer
ttaatatatttttgtcagcacatagcga

SEQ ID NO: 53675 - protein, 762 aa, Artificial sequence; identical to SEQ ID NO: 27636
  Variant (2)..(4): xaa in position 2 to 4 is any amino acid
  Variant (6)..(7): xaa in position 6 to 7 is any amino acid
  Variant (9)..(12): xaa in position 9 to 12 is any amino acid
  Variant (16)..(17): xaa in position 16 to 17 is any amino acid
  Variant (18)..(21): xaa in position 18 to 21 is any or no amino acid
  Variant (23)..(23): xaa in position 23 is any amino acid
  Variant (27)..(31): xaa in position 27 to 31 is any amino acid
  Variant (33)..(73): xaa in position 33 to 73 is any amino acid
  Variant (74)..(118): xaa in position 74 to 118 is any or no amino acid
  Variant (120)..(133): xaa in position 120 to 133 is any amino acid
  Variant (134)..(185): xaa in position 134 to 185 is any or no amino acid
  Variant (187)..(192): xaa in position 187 to 192 is any amino acid
  Variant (193)..(203): xaa in position 193 to 203 is any or no amino acid
  Variant (206)..(206): xaa in position 206 is any amino acid
  Variant (208)..(210): xaa in position 208 to 210 is any amino acid
  Variant (212)..(213): xaa in position 212 to 213 is any amino acid
  Variant (215)..(217): xaa in position 215 to 217 is any amino acid
  Variant (219)..(223): xaa in position 219 to 223 is any amino acid
  Variant (227)..(227): xaa in position 227 is any amino acid
  Variant (231)..(233): xaa in position 231 to 233 is any amino acid
  Variant (236)..(245): xaa in position 236 to 245 is any amino acid
  Variant (247)..(248): xaa in position 247 to 248 is any amino acid
  Variant (250)..(253): xaa in position 250 to 253 is any amino acid
  Variant (254)..(264): xaa in position 254 to 264 is any or no amino acid
  Variant (266)..(280): xaa in position 266 to 280 is any amino acid
  Variant (282)..(283): xaa in position 282 to 283 is any amino acid
  Variant (285)..(314): xaa in position 285 to 314 is any amino acid
  Variant (315)..(412): xaa in position 315 to 412 is any or no amino acid
  Variant (414)..(417): xaa in position 414 to 417 is any amino acid
  Variant (419)..(428): xaa in position 419 to 428 is any amino acid
  Variant (429)..(444): xaa in position 429 to 444 is any or no amino acid
  Variant (446)..(447): xaa in position 446 to 447 is any amino acid
  Variant (448)..(448): xaa in position 448 is any or no amino acid
  Variant (450)..(451): xaa in position 450 to 451 is any amino acid
  Variant (453)..(456): xaa in position 453 to 456 is any amino acid
  Variant (458)..(458): xaa in position 458 is any amino acid
  Variant (460)..(461): xaa in position 460 to 461 is any amino acid
  Variant (463)..(463): xaa in position 463 is any amino acid
  Variant (468)..(471): xaa in position 468 to 471 is any amino acid
  Variant (473)..(478): xaa in position 473 to 478 is any amino acid
  Variant (479)..(482): xaa in position 479 to 482 is any or no amino acid
  Variant (484)..(485): xaa in position 484 to 485 is any amino acid
  Variant (486)..(518): xaa in position 486 to 518 is any or no amino acid
  Variant (520)..(521): xaa in position 520 to 521 is any amino acid
  Variant (523)..(531): xaa in position 523 to 531 is any amino acid
  Variant (532)..(561): xaa in position 532 to 561 is any or no amino acid
  Variant (563)..(577): xaa in position 563 to 577 is any amino acid
  Variant (578)..(596): xaa in position 578 to 596 is any or no amino acid
  Variant (598)..(601): xaa in position 598 to 601 is any amino acid
  Variant (603)..(609): xaa in position 603 to 609 is any amino acid
  Variant (610)..(640): xaa in position 610 to 640 is any or no amino acid
  Variant (643)..(643): xaa in position 643 is any amino acid
  Variant (645)..(647): xaa in position 645 to 647 is any amino acid
  Variant (650)..(650): xaa in position 650 is any amino acid
  Variant (653)..(654): xaa in position 653 to 654 is any amino acid
  Variant (656)..(658): xaa in position 656 to 658 is any amino acid
  Variant (660)..(660): xaa in position 660 is any amino acid
  Variant (668)..(669): xaa in position 668 to 669 is any amino acid
  Variant (673)..(682): xaa in position 673 to 682 is any amino acid
  Variant (684)..(690): xaa in position 684 to 690 is any amino acid
  Variant (691)..(742): xaa in position 691 to 742 is any or no amino acid
  Variant (744)..(744): xaa in position 744 is any amino acid
  Variant (747)..(761): xaa in position 747 to 761 is any amino acid

SEQ ID NO: 53676 - protein, 9 aa, Artificial sequence
  Variant (2)..(2): xaa in position 2 is any amino acid
  Variant (3)..(3): xaa in position 3 is Asp, Asn or Ser
  Variant (5)..(5): xaa in position 5 is any amino acid
  Variant (8)..(8): xaa in position 8 is Ser or Thr
  Variant (9)..(9): xaa in position 9 is Ala, Ser, Thr or Val
GXXGXGKXX

SEQ ID NO: 53677 - protein, 29 aa, Artificial sequence
  Variant (2)..(4): xaa in position 2 to 4 is any amino acid
  Variant (5)..(5): xaa in position 5 is Lys or Arg
  Variant (6)..(19): xaa in position 6 to 19 is any amino acid
  Variant (20)..(20): xaa in position 20 is Phe, Ile, Leu or Val
  Variant (21)..(21): xaa in position 21 is any amino acid
  Variant (23)..(23): xaa in position 23 is Asp, Glu, Asn or Gln
  Variant (25)..(27): xaa in position 25 to 27 is any amino acid
  Variant (28)..(28): xaa in position 28 is Ile, Leu or Val
  Variant (29)..(29): xaa in position 29 is Asp or Thr
GXXXXXXXXXXXXXXXXXXXXDXPXXXXX

SEQ ID NO: 53678 - protein, 16 aa, Artificial sequence
  Variant (2)..(5): xaa in position 2 to 5 is any amino acid
  Variant (6)..(6): xaa in position 6 is Phe, Ile, Leu or Val
  Variant (7)..(7): xaa in position 7 is any amino acid
  Variant (9)..(9): xaa in position 9 is any amino acid
  Variant (10)..(10): xaa in position 10 is Asn or Ser
  Variant (12)..(12): xaa in position 12 is any amino acid
  Variant (15)..(15): xaa in position 15 is any or no amino acid
GXXXXXXGXXGXGKXT

SEQ ID NO: 53679 - protein, 29 aa, Artificial sequence
  Variant (2)..(5): xaa in position 2 to 5 is any amino acid
  Variant (6)..(6): xaa in position 6 is Ile, Leu, Met or Val
  Variant (7)..(7): xaa in position 7 is any amino acid
  Variant (8)..(8): xaa in position 8 is Phe, Ile, Leu or Val
  Variant (9)..(17): xaa in position 9 to 17 is any amino acid
  Variant (18)..(18): xaa in position 18 is Phe, Ile, Leu, Met or Val
  Variant (19)..(19): xaa in position 19 is any amino acid
  Variant (20)..(20): xaa in position 20 is Phe, Ile, Leu or Val
  Variant (21)..(21): xaa in position 21 is any amino acid
  Variant (24)..(28): xaa in position 24 to 28 is any amino acid
GXXXXXXXXXXXXXXXXXXXXDEXXXXXD

SEQ ID NO: 53680 - protein, 7 aa, Artificial sequence
  Variant (2)..(2): xaa in position 2 is any amino acid
  Variant (3)..(6): xaa in position 3 to 6 is any or no amino acid
IXXXXXH

SEQ ID NO: 53681 - DNA, 1482 bp, Escherichia coli; identical to SEQ ID NO: 14192
  CDS (1)..(1482)

SEQ ID NO: 53682 - protein, 493 aa, Escherichia coli; identical to SEQ ID NO: 14193

SEQ ID NO: 53683 - DNA, 1401 bp, Mesorhizobium loti MAFF303099; identical to SEQ ID NO: 14194
  CDS (1)..(1401): transl_table=11

SEQ ID NO: 53684 - protein, 466 aa, Mesorhizobium loti MAFF303099; identical to SEQ ID NO: 14195

SEQ ID NO: 53685 - DNA, 1401 bp, Mesorhizobium loti MAFF303099; identical to SEQ ID NO: 14196
  CDS (1)..(1401): transl_table=11

SEQ ID NO: 53686 - protein, 466 aa, Mesorhizobium loti MAFF303099; identical to SEQ ID NO: 14197

SEQ ID NO: 53687 - DNA, 1197 bp, Bacillus halodurans C-125; identical to SEQ ID NO: 14198
  CDS (1)..(1197): transl_table=11

SEQ ID NO: 53688 - protein, 398 aa, Bacillus halodurans C-125; identical to SEQ ID NO: 14199

SEQ ID NO: 53689 - DNA, 1545 bp, Pasteurella multocida subsp. multocida str. Pm70; identical to SEQ ID NO: 14200
  CDS (1)..(1545): transl_table=11

SEQ ID NO: 53690 - protein, 514 aa, Pasteurella multocida subsp. multocida str. Pm70; identical to SEQ ID NO: 14201

SEQ ID NO: 53691 - DNA, 1206 bp, Pseudomonas aeruginosa PAO1; identical to SEQ ID NO: 14202
  CDS (1)..(1206): transl_table=11

SEQ ID NO: 53692 - protein, 401 aa, Pseudomonas aeruginosa PAO1; identical to SEQ ID NO: 14203

SEQ ID NO: 53693 - DNA, 1080 bp, Pseudomonas aeruginosa PAO1; identical to SEQ ID NO: 14204
  CDS (1)..(1080): transl_table=11

SEQ ID NO: 53694 - protein, 359 aa, Pseudomonas aeruginosa PAO1; identical to SEQ ID NO: 14205

SEQ ID NO: 53695 - DNA, 1590 bp, Pseudomonas aeruginosa PAO1; identical to SEQ ID NO: 14206
  CDS (1)..(1590): transl_table=11

SEQ ID NO: 53696 - protein, 529 aa, Pseudomonas aeruginosa PAO1; identical to SEQ ID NO: 14207

SEQ ID NO: 53697 - DNA, 1446 bp, Lactococcus lactis subsp. lactis Il1403; identical to SEQ ID NO: 14208
  CDS (1)..(1446): transl_table=11

SEQ ID NO: 53698 - protein, 481 aa, Lactococcus lactis subsp. lactis Il1403; identical to SEQ ID NO: 14209

SEQ ID NO: 53699 - DNA, 1464 bp, Lactococcus lactis subsp. lactis Il1403; identical to SEQ ID NO: 14210
  CDS (1)..(1464): transl_table=11

SEQ ID NO: 53700 - protein, 487 aa, Lactococcus lactis subsp. lactis Il1403; identical to SEQ ID NO: 14211

SEQ ID NO: 53701 - DNA, 1527 bp, Neisseria meningitidis MC58; identical to SEQ ID NO: 14212
  CDS (1)..(1527): transl_table=11

SEQ ID NO: 53702 - protein, 508 aa, Neisseria meningitidis MC58; identical to SEQ ID NO: 14213

SEQ ID NO: 53703 - DNA, 1959 bp, Xylella fastidiosa 9a5c; identical to SEQ ID NO: 14214
  CDS (1)..(1959): transl_table=11

SEQ ID NO: 53704 - protein, 652 aa, Xylella fastidiosa 9a5c; identical to SEQ ID NO: 14215

SEQ ID NO: 53705 - DNA, 1404 bp, Xylella fastidiosa 9a5c; identical to SEQ ID NO: 14216
  CDS (1)..(1404): transl_table=11

SEQ ID NO: 53706 - protein, 467 aa, Xylella fastidiosa 9a5c; identical to SEQ ID NO: 14217

SEQ ID NO: 53707 - DNA, 1506 bp, Mycoplasma pulmonis UAB CTIP; identical to SEQ ID NO: 14218
  CDS (1)..(1506): transl_table=4

SEQ ID NO: 53708 - protein, 501 aa, Mycoplasma pulmonis UAB CTIP; identical to SEQ ID NO: 14219

SEQ ID NO: 53709 - DNA, 1533 bp, Clostridium acetobutylicum ATCC 824; identical to SEQ ID NO: 14220
  CDS (1)..(1533): transl_table=11

SEQ ID NO: 53710 - protein, 510 aa, Clostridium acetobutylicum ATCC 824; identical to SEQ ID NO: 14221

SEQ ID NO: 53711 - DNA, 1518 bp, Staphylococcus aureus subsp. aureus Mu50; identical to SEQ ID NO: 14222
  CDS (1)..(1518): transl_table=11

SEQ ID NO: 53712 - protein, 505 aa, Staphylococcus aureus subsp. aureus Mu50; identical to SEQ ID NO: 14223

SEQ ID NO: 53713 - DNA, 1566 bp, Sinorhizobium meliloti 1021; identical to SEQ ID NO: 14224
  CDS (1)..(1566): transl_table=11

SEQ ID NO: 53714 - protein, 521 aa, Sinorhizobium meliloti 1021; identical to SEQ ID NO: 14225

SEQ ID NO: 53715 - DNA, 1464 bp, Sinorhizobium meliloti 1021; identical to SEQ ID NO: 14226
  CDS (1)..(1464): transl_table=11

SEQ ID NO: 53716 - protein, 487 aa, Sinorhizobium meliloti 1021; identical to SEQ ID NO: 14227

SEQ ID NO: 53717 - DNA, 1488 bp, Salmonella typhimurium LT2; identical to SEQ ID NO: 14228
  CDS (1)..(1488): transl_table=11

SEQ ID NO: 53718 - protein, 495 aa, Salmonella typhimurium LT2; identical to SEQ ID NO: 14229

SEQ ID NO: 53719 - DNA, 1515 bp, Listeria monocytogenes EGD-e; identical to SEQ ID NO: 14230
  CDS (1)..(1515): transl_table=11

SEQ ID NO: 53720 - protein, 504 aa, Listeria monocytogenes EGD-e; identical to SEQ ID NO: 14231

SEQ ID NO: 53721 - DNA, 1515 bp, Listeria innocua Clip11262; identical to SEQ ID NO: 14232
  CDS (1)..(1515): transl_table=11

SEQ ID NO: 53722 - protein, 504 aa, Listeria innocua Clip11262; identical to SEQ ID NO: 14233

SEQ ID NO: 53723 - DNA, 1443 bp, Nostoc sp. PCC 7120; identical to SEQ ID NO: 14234
  CDS (1)..(1443): transl_table=11

SEQ ID NO: 53724 - protein, 480 aa, Nostoc sp. PCC 7120; identical to SEQ ID NO: 14235

SEQ ID NO: 53725 - DNA, 1269 bp, Ralstonia solanacearum GMI1000; identical to SEQ ID NO: 14236
  CDS (1)..(1269): transl_table=11

SEQ ID NO: 53726 - protein, 422 aa, Ralstonia solanacearum GMI1000; identical to SEQ ID NO: 14237

SEQ ID NO: 53727 - DNA, 1557 bp, Agrobacterium tumefaciens str. C58; identical to SEQ ID NO: 14238
  CDS (1)..(1557): transl_table=11

SEQ ID NO: 53728 - protein, 518 aa, Agrobacterium tumefaciens str. C58; identical to SEQ ID NO: 14239

SEQ ID NO: 53729 - DNA, 1479 bp, Agrobacterium tumefaciens str. C58; identical to SEQ ID NO: 14240
  CDS (1)..(1479): transl_table=11

SEQ ID NO: 53730 - protein, 492 aa, Agrobacterium tumefaciens str. C58; identical to SEQ ID NO: 14241

SEQ ID NO: 53731 - DNA, 1479 bp, Brucella melitensis 16M; identical to SEQ ID NO: 14242
  CDS (1)..(1479): transl_table=11

SEQ ID NO: 53732 - protein, 492 aa, Brucella melitensis 16M; identical to SEQ ID NO: 14243

SEQ ID NO: 53733 - DNA, 1443 bp, Clostridium perfringens str. 13; identical to SEQ ID NO: 14244
  CDS (1)..(1443): transl_table=11

SEQ ID NO: 53734 - protein, 480 aa, Clostridium perfringens str. 13; identical to SEQ ID NO: 14245

SEQ ID NO: 53735 - DNA, 1536 bp, Clostridium perfringens str. 13; identical to SEQ ID NO: 14246
  CDS (1)..(1536): transl_table=11

SEQ ID NO: 53736 - protein, 511 aa, Clostridium perfringens str. 13; identical to SEQ ID NO: 14247

SEQ ID NO: 53737 - DNA, 1458 bp, Clostridium perfringens str. 13; identical to SEQ ID NO: 14248
  CDS (1)..(1458): transl_table=11

SEQ ID NO: 53738 - protein, 485 aa, Clostridium perfringens str. 13; identical to SEQ ID NO: 14249

SEQ ID NO: 53739 - DNA, 1503 bp, Corynebacterium glutamicum ATCC 13032; identical to SEQ ID NO: 14250
  CDS (1)..(1503): transl_table=11

SEQ ID NO: 53740 - protein, 500 aa, Corynebacterium glutamicum ATCC 13032; identical to SEQ ID NO: 14251

SEQ ID NO: 53741 - DNA, 1440 bp, Fusobacterium nucleatum subsp. nucleatum ATCC 25586; identical to SEQ ID NO: 14252
  CDS (1)..(1440): transl_table=11

SEQ ID NO: 53742 - protein, 479 aa, Fusobacterium nucleatum subsp. nucleatum ATCC 25586; identical to SEQ ID NO: 14253

SEQ ID NO: 53743 - DNA, 1188 bp, Streptomyces coelicolor A3(2); identical to SEQ ID NO: 14254
  CDS (1)..(1188)

SEQ ID NO: 53744 - protein, 395 aa, Streptomyces coelicolor A3(2); identical to SEQ ID NO: 14255

SEQ ID NO: 53745 - DNA, 1461 bp, Xanthomonas campestris pv. campestris str. ATCC 33913; identical to SEQ ID NO: 14256
  CDS (1)..(1461): transl_table=11

SEQ ID NO: 53746 - protein, 486 aa, Xanthomonas campestris pv. campestris str. ATCC 33913; identical to SEQ ID NO: 14257

SEQ ID NO: 53747 - DNA, 1983 bp, Xanthomonas campestris pv. campestris str. ATCC 33913; identical to SEQ ID NO: 14258
  CDS (1)..(1983): transl_table=11

SEQ ID NO: 53748 - protein, 660 aa, Xanthomonas campestris pv. campestris str. ATCC 33913; identical to SEQ ID NO: 14259

SEQ ID NO: 53749 - DNA, 1020 bp, Xanthomonas campestris pv. campestris str. ATCC 33913; identical to SEQ ID NO: 14260
  CDS (1)..(1020): transl_table=11

SEQ ID NO: 53750 - protein, 339 aa, Xanthomonas campestris pv. campestris str. ATCC 33913; identical to SEQ ID NO: 14261

SEQ ID NO: 53751 - DNA, 1563 bp, Xanthomonas campestris pv. campestris str. ATCC 33913; identical to SEQ ID NO: 14262
  CDS (1)..(1563): transl_table=11

SEQ ID NO: 53752 - protein, 520 aa, Xanthomonas campestris pv. campestris str. ATCC 33913; identical to SEQ ID NO: 14263

SEQ ID NO: 53753 - DNA, 1425 bp, Xanthomonas campestris pv. campestris str. ATCC 33913; identical to SEQ ID NO: 14264
  CDS (1)..(1425): transl_table=11

SEQ ID NO: 53754 - protein, 474 aa, Xanthomonas campestris pv. campestris str. ATCC 33913; identical to SEQ ID NO: 14265

SEQ ID NO: 53755 - DNA, 1461 bp, Xanthomonas axonopodis pv. citri str. 306; identical to SEQ ID NO: 14266
  CDS (1)..(1461): transl_table=11

SEQ ID NO: 53756 - protein, 486 aa, Xanthomonas axonopodis pv. citri str. 306; identical to SEQ ID NO: 14267

SEQ ID NO: 53757 - DNA, 2019 bp, Xanthomonas axonopodis pv. citri str. 306; identical to SEQ ID NO: 14268
  CDS (1)..(2019): transl_table=11

SEQ ID NO: 53758 - protein, 672 aa, Xanthomonas axonopodis pv. citri str. 306; identical to SEQ ID NO: 14269

SEQ ID NO: 53759 - DNA, 1563 bp, Xanthomonas axonopodis pv. citri str. 306; identical to SEQ ID NO: 14270
  CDS (1)..(1563): transl_table=11

SEQ ID NO: 53760 - protein, 520 aa, Xanthomonas axonopodis pv. citri str. 306; identical to SEQ ID NO: 14271

SEQ ID NO: 53761 - DNA, 1416 bp, Xanthomonas axonopodis pv. citri str. 306; identical to SEQ ID NO: 14272
  CDS (1)..(1416): transl_table=11

SEQ ID NO: 53762 - protein, 471 aa, Xanthomonas axonopodis pv. citri str. 306; identical to SEQ ID NO: 14273

SEQ ID NO: 53763 - DNA, 1224 bp, Xanthomonas axonopodis pv. citri str. 306; identical to SEQ ID NO: 14274
  CDS (1)..(1224): transl_table=11

SEQ ID NO: 53764 - protein, 407 aa, Xanthomonas axonopodis pv. citri str. 306; identical to SEQ ID NO: 14275

SEQ ID NO: 53765 - DNA, 1518 bp, Staphylococcus aureus subsp. aureus MW2; identical to SEQ ID NO: 14276
  CDS (1)..(1518): transl_table=11

SEQ ID NO: 53766 - protein, 505 aa, Staphylococcus aureus subsp. aureus MW2; identical to SEQ ID NO: 14277

SEQ ID NO: 53767 - DNA, 1482 bp, Yersinia pestis KIM; identical to SEQ ID NO: 14278
  CDS (1)..(1482): transl_table=11

SEQ ID NO: 53768 - protein, 493 aa, Yersinia pestis KIM; identical to SEQ ID NO: 14279

SEQ ID NO: 53769 - DNA, 1461 bp, Brucella suis 1330; identical to SEQ ID NO: 14280
  CDS (1)..(1461): transl_table=11

SEQ ID NO: 53770 - protein, 486 aa, Brucella suis 1330; identical to SEQ ID NO: 14281

SEQ ID NO: 53771 - DNA, 1503 bp, Corynebacterium efficiens YS-314; identical to SEQ ID NO: 14282
  CDS (1)..(1503): transl_table=11

SEQ ID NO: 53772 - protein, 500 aa, Corynebacterium efficiens YS-314; identical to SEQ ID NO: 14283

SEQ ID NO: 53773 - DNA, 1158 bp, Pseudomonas putida KT2440; identical to SEQ ID NO: 14284
  CDS (1)..(1158): transl_table=11

SEQ ID NO: 53774 - protein, 385 aa, Pseudomonas putida KT2440; identical to SEQ ID NO: 14285

SEQ ID NO: 53775 - DNA, 1554 bp, Pseudomonas putida KT2440; identical to SEQ ID NO: 14286
  CDS (1)..(1554): transl_table=11

SEQ ID NO: 53776 - protein, 517 aa, Pseudomonas putida KT2440; identical to SEQ ID NO: 14287

SEQ ID NO: 53777 - DNA, 1575 bp, Vibrio vulnificus CMCP6; identical to SEQ ID NO: 14288
  CDS (1)..(1575): transl_table=11

SEQ ID NO: 53778 - protein, 524 aa, Vibrio vulnificus CMCP6; identical to SEQ ID NO: 14289

SEQ ID NO: 53779 - DNA, 1485 bp, Staphylococcus epidermidis ATCC 12228; identical to SEQ ID NO: 14290
  CDS (1)..(1485): transl_table=11

SEQ ID NO: 53780 - protein, 494 aa, Staphylococcus epidermidis ATCC 12228; identical to SEQ ID NO: 14291

SEQ ID NO: 53781 - DNA, 1959 bp, Xylella fastidiosa Temecula1; identical to SEQ ID NO: 14292
  CDS (1)..(1959): transl_table=11

SEQ ID NO: 53782 - protein, 652 aa, Xylella fastidiosa Temecula1; identical to SEQ ID NO: 14293

SEQ ID NO: 53783 - DNA, 1404 bp, Xylella fastidiosa Temecula1; identical to SEQ ID NO: 14294
  CDS (1)..(1404): transl_table=11

SEQ ID NO: 53784 - protein, 467 aa, Xylella fastidiosa Temecula1; identical to SEQ ID NO: 14295

SEQ ID NO: 53785 - DNA, 1437 bp, Clostridium tetani E88; identical to SEQ ID NO: 14296
  CDS (1)..(1437): transl_table=11

SEQ ID NO: 53786 - protein, 478 aa, Clostridium tetani E88; identical to SEQ ID NO: 14297

SEQ ID NO: 53787 - DNA, 1458 bp, Lactobacillus plantarum WCFS1; identical to SEQ ID NO: 14298
  CDS (1)..(1458): transl_table=11

SEQ ID NO: 53788 - protein, 485 aa, Lactobacillus plantarum WCFS1; identical to SEQ ID NO: 14299

SEQ ID NO: 53789 - DNA, 1497 bp, Tropheryma whipplei str. Twist; identical to SEQ ID NO: 14300
  CDS (1)..(1497): transl_table=11

SEQ ID NO: 53790 - protein, 498 aa, Tropheryma whipplei str. Twist; identical to SEQ ID NO: 14301

SEQ ID NO: 53791 - DNA, 1497 bp, Tropheryma whipplei TW08/27; identical to SEQ ID NO: 14302
  CDS (1)..(1497): transl_table=11

SEQ ID NO: 53792 - protein, 498 aa, Tropheryma whipplei TW08/27; identical to SEQ ID NO: 14303

SEQ ID NO: 53793 - DNA, 1629 bp, Pseudomonas syringae pv. tomato str. DC3000; identical to SEQ ID NO: 14304
  CDS (1)..(1629): transl_table=11

SEQ ID NO: 53794 - protein, 542 aa, Pseudomonas syringae pv. tomato str. DC3000; identical to SEQ ID NO: 14305

SEQ ID NO: 53795 - DNA, 1251 bp, Pseudomonas syringae pv. tomato str. DC3000; identical to SEQ ID NO: 14306
  CDS (1)..(1251): transl_table=11

SEQ ID NO: 53796 - protein, 416 aa, Pseudomonas syringae pv. tomato str. DC3000; identical to SEQ ID NO: 14307

SEQ ID NO: 53797 - DNA, 1158 bp, Pseudomonas syringae pv. tomato str. DC3000; identical to SEQ ID NO: 14308
  CDS (1)..(1158): transl_table=11

SEQ ID NO: 53798 - protein, 385 aa, Pseudomonas syringae pv. tomato str. DC3000; identical to SEQ ID NO: 14309

SEQ ID NO: 53799 - DNA, 1197 bp, Bacteroides thetaiotaomicron VPI-5482; identical to SEQ ID NO: 14310
  CDS (1)..(1197): transl_table=11

SEQ ID NO: 53800 - protein, 398 aa, Bacteroides thetaiotaomicron VPI-5482; identical to SEQ ID NO: 14311

SEQ ID NO: 53801 - DNA, 1425 bp, Bacteroides thetaiotaomicron VPI-5482; identical to SEQ ID NO: 14312
  CDS (1)..(1425): transl_table=11

SEQ ID NO: 53802 - protein, 474 aa, Bacteroides thetaiotaomicron VPI-5482; identical to SEQ ID NO: 14313

SEQ ID NO: 53803 - DNA, 1440 bp, Bacteroides thetaiotaomicron VPI-5482; identical to SEQ ID NO: 14314
  CDS (1)..(1440): transl_table=11

SEQ ID NO: 53804 - protein, 479 aa, Bacteroides thetaiotaomicron VPI-5482; identical to SEQ ID NO: 14315

SEQ ID NO: 53805 - DNA, 1446 bp, Enterococcus faecalis V583; identical to SEQ ID NO: 14316
  CDS (1)..(1446): transl_table=11

SEQ ID NO: 53806 - protein, 481 aa, Enterococcus faecalis V583; identical to SEQ ID NO: 14317

SEQ ID NO: 53807 - DNA, 1461 bp, Enterococcus faecalis V583; identical to SEQ ID NO: 14318
  CDS (1)..(1461): transl_table=11

SEQ ID NO: 53808 - protein, 486 aa, Enterococcus faecalis V583; identical to SEQ ID NO: 14319

SEQ ID NO: 53809 - DNA, 1176 bp, Coxiella burnetii RSA 493; identical to SEQ ID NO: 14320
  CDS (1)..(1176): transl_table=11

SEQ ID NO: 53810 - protein, 391 aa, Coxiella burnetii RSA 493; identical to SEQ ID NO: 14321

SEQ ID NO: 53811 - DNA, 1215 bp, Streptomyces avermitilis MA-4680; identical to SEQ ID NO: 14322
  CDS (1)..(1215)

SEQ ID NO: 53812 - protein, 404 aa, Streptomyces avermitilis MA-4680; identical to SEQ ID NO: 14323

SEQ ID NO: 53813 - DNA, 1098 bp, Bacillus cereus ATCC 14579; identical to SEQ ID NO: 14324
  CDS (1)..(1098): transl_table=11

SEQ ID NO: 53814 - protein, 365 aa, Bacillus cereus ATCC 14579; identical to SEQ ID NO: 14325

SEQ ID NO: 53815 - DNA, 1194 bp, Bacillus cereus ATCC 14579; identical to SEQ ID NO: 14326
  CDS (1)..(1194): transl_table=11

SEQ ID NO: 53816 - protein, 397 aa, Bacillus cereus ATCC 14579; identical to SEQ ID NO: 14327

SEQ ID NO: 53817 - DNA, 1242 bp, Shigella flexneri 2a str. 2457T; identical to SEQ ID NO: 14328
  CDS (1)..(1242): transl_table=11

SEQ ID NO: 53818 - protein, 413 aa, Shigella flexneri 2a str. 2457T; identical to SEQ ID NO: 14329

SEQ ID NO: 53819 - DNA, 1158 bp, Nitrosomonas europaea ATCC 19718; identical to SEQ ID NO: 14330
  CDS (1)..(1158): transl_table=11

SEQ ID NO: 53820 - protein, 385 aa, Nitrosomonas europaea ATCC 19718; identical to SEQ ID NO: 14331

SEQ ID NO: 53821 - DNA, 1218 bp, Bacillus anthracis str. Ames; identical to SEQ ID NO: 14332
  CDS (1)..(1218): transl_table=11

SEQ ID NO: 53822 - protein, 405 aa, Bacillus anthracis str. Ames; identical to SEQ ID NO: 14333

SEQ ID NO: 53823 - DNA, 1104 bp, Bacillus anthracis str. Ames; identical to SEQ ID NO: 14334
  CDS (1)..(1104): transl_table=11

SEQ ID NO: 53824 - protein, 367 aa, Bacillus anthracis str. Ames; identical to SEQ ID NO: 14335

SEQ ID NO: 53825 - DNA, 1194 bp, Bacillus anthracis str. Ames; identical to SEQ ID NO: 14336
  CDS (1)..(1194): transl_table=11

SEQ ID NO: 53826 - protein, 397 aa, Bacillus anthracis str. Ames; identical to SEQ ID NO: 14337

SEQ ID NO: 53827 - DNA, 1563 bp, Helicobacter hepaticus ATCC 51449; identical to SEQ ID NO: 14338
  CDS (1)..(1563): transl_table=11

SEQ ID NO: 53828 - protein, 520 aa, Helicobacter hepaticus ATCC 51449; identical to SEQ ID NO: 14339

SEQ ID NO: 53829 - DNA, 1476 bp, Rhodopirellula baltica SH 1; identical to SEQ ID NO: 14340
  CDS (1)..(1476): transl_table=11

SEQ ID NO: 53830 - protein, 491 aa, Rhodopirellula baltica SH 1; identical to SEQ ID NO: 14341

SEQ ID NO: 53831 - DNA, 1476 bp, Candidatus Blochmannia floridanus; identical to SEQ ID NO: 14342
  CDS (1)..(1476): transl_table=11

SEQ ID NO: 53832 - protein, 491 aa, Candidatus Blochmannia floridanus; identical to SEQ ID NO: 14343

SEQ ID NO: 53833 - DNA, 1206 bp, Bordetella pertussis Tohama I; identical to SEQ ID NO: 14344
  CDS (1)..(1206): transl_table=11

SEQ ID NO: 53834 - protein, 401 aa, Bordetella pertussis Tohama I; identical to SEQ ID NO: 14345

SEQ ID NO: 53835 - DNA, 1458 bp, Bordetella pertussis Tohama I; identical to SEQ ID NO: 14346
  CDS (1)..(1458): transl_table=11

SEQ ID NO: 53836 - protein, 485 aa, Bordetella pertussis Tohama I; identical to SEQ ID NO: 14347

SEQ ID NO: 53837 - DNA, 1575 bp, Bordetella pertussis Tohama I; identical to SEQ ID NO: 14348
  CDS (1)..(1575): transl_table=11

SEQ ID NO: 53838 - protein, 524 aa, Bordetella pertussis Tohama I; identical to SEQ ID NO: 14349

SEQ ID NO: 53839 - DNA, 1263 bp, Bordetella parapertussis 12822; identical to SEQ ID NO: 14350
  CDS (1)..(1263)

SEQ ID NO: 53840 - protein, 420 aa, Bordetella parapertussis 12822; identical to SEQ ID NO: 14351

SEQ ID NO: 53841 - DNA, 1431 bp, Bordetella parapertussis 12822; identical to SEQ ID NO: 14352
  CDS (1)..(1431)

SEQ ID NO: 53842 - protein, 476 aa, Bordetella parapertussis 12822; identical to SEQ ID NO: 14353

SEQ ID NO: 53843 - DNA, 1479 bp, Bordetella bronchiseptica RB50; identical to SEQ ID NO: 14354
  CDS (1)..(1479)

SEQ ID NO: 53844 - protein, 492 aa, Bordetella bronchiseptica RB50; identical to SEQ ID NO: 14355

SEQ ID NO: 53845 - DNA, 1545 bp, Bordetella bronchiseptica RB50; identical to SEQ ID NO: 14356
  CDS (1)..(1545)

SEQ ID NO: 53846 - protein, 514 aa, Bordetella bronchiseptica RB50; identical to SEQ ID NO: 14357

SEQ ID NO: 53847 - DNA, 1518 bp, Chromobacterium violaceum ATCC 12472; identical to SEQ ID NO: 14358
  CDS (1)..(1518): transl_table=11

SEQ ID NO: 53848 - protein, 505 aa, Chromobacterium violaceum ATCC 12472; identical to SEQ ID NO: 14359

SEQ ID NO: 53849 - DNA, 1422 bp, Porphyromonas gingivalis W83; identical to SEQ ID NO: 14360
  CDS (1)..(1422): transl_table=11

SEQ ID NO: 53850 - protein, 473 aa, Porphyromonas gingivalis W83; identical to SEQ ID NO: 14361

SEQ ID NO: 53851 - DNA, 1443 bp, Gloeobacter violaceus PCC 7421; identical to SEQ ID NO: 14362
  CDS (1)..(1443): transl_table=11

SEQ ID NO: 53852 - protein, 480 aa, Gloeobacter violaceus PCC 7421; identical to SEQ ID NO: 14363

SEQ ID NO: 53853 - DNA, 1470 bp, Photorhabdus luminescens subsp. laumondii TTO1; identical to SEQ ID NO: 14364
  CDS (1)..(1470): transl_table=11

SEQ ID NO: 53854 - protein, 489 aa, Photorhabdus luminescens subsp. laumondii TTO1; identical to SEQ ID NO: 14365

SEQ ID NO: 53855 - DNA, 1455 bp, Vibrio vulnificus YJ016; identical to SEQ ID NO: 14366
  CDS (1)..(1455): transl_table=11

SEQ ID NO: 53856 - protein, 484 aa, Vibrio vulnificus YJ016; identical to SEQ ID NO: 14367

SEQ ID NO: 53857 - DNA, 1191 bp, Geobacter sulfurreducens PCA; identical to SEQ ID NO: 14368
  CDS (1)..(1191): transl_table=11

SEQ ID NO: 53858 - protein, 396 aa, Geobacter sulfurreducens PCA; identical to SEQ ID NO: 14369

SEQ ID NO: 53859 - DNA, 1443 bp, Geobacter sulfurreducens PCA; identical to SEQ ID NO: 14370
  CDS (1)..(1443): transl_table=11

SEQ ID NO: 53860 - protein, 480 aa, Geobacter sulfurreducens PCA; identical to SEQ ID NO: 14371

SEQ ID NO: 53861 - DNA, 1578 bp, Geobacter sulfurreducens PCA; identical to SEQ ID NO: 14372
  CDS (1)..(1578): transl_table=11

SEQ ID NO: 53862 - protein, 525 aa, Geobacter sulfurreducens PCA; identical to SEQ ID NO: 14373

SEQ ID NO: 53863 - DNA, 1470 bp, Lactobacillus johnsonii NCC 533; identical to SEQ ID NO: 14374
  CDS (1)..(1470): transl_table=11

SEQ ID NO: 53864 - protein, 489 aa, Lactobacillus johnsonii NCC 533; identical to SEQ ID NO: 14375

SEQ ID NO: 53865 - DNA, 1488 bp, Lactobacillus johnsonii NCC 533; identical to SEQ ID NO: 14376
  CDS (1)..(1488): transl_table=11

SEQ ID NO: 53866 - protein, 495 aa, Lactobacillus johnsonii NCC 533; identical to SEQ ID NO: 14377

SEQ ID NO: 53867 - DNA, 1593 bp, Bdellovibrio bacteriovorus HD100; identical to SEQ ID NO: 14378
  CDS (1)..(1593): transl_table=11

SEQ ID NO: 53868 - protein, 530 aa, Bdellovibrio bacteriovorus HD100; identical to SEQ ID NO: 14379

SEQ ID NO: 53869 - DNA, 1212 bp, Bacillus cereus ATCC 10987; identical to SEQ ID NO: 14380
  CDS (1)..(1212): transl_table=11

SEQ ID NO: 53870 - protein, 403 aa, Bacillus cereus ATCC 10987; identical to SEQ ID NO: 14381

SEQ ID NO: 53871 - DNA, 1446 bp, Desulfovibrio vulgaris subsp. vulgaris str. Hildenborough; identical to SEQ ID NO: 14382
  CDS (1)..(1446): transl_table=11

SEQ ID NO: 53872 - protein, 481 aa, Desulfovibrio vulgaris subsp. vulgaris str. Hildenborough; identical to SEQ ID NO: 14383

SEQ ID NO: 53873 - DNA, 1137 bp, Bacillus anthracis str. Sterne; identical to SEQ ID NO: 14384
  CDS (1)..(1137): transl_table=11

SEQ ID NO: 53874 - protein, 378 aa, Bacillus anthracis str. Sterne; identical to SEQ ID NO: 14385

SEQ ID NO: 53875 - DNA, 1572 bp, Bartonella quintana str. Toulouse; identical to SEQ ID NO: 14386
  CDS (1)..(1572): transl_table=11

SEQ ID NO: 53876 - protein, 523 aa, Bartonella quintana str. Toulouse; identical to SEQ ID NO: 14387

SEQ ID NO: 53877 - DNA, 1572 bp, Bartonella henselae str. Houston-1; identical to SEQ ID NO: 14388
  CDS (1)..(1572): transl_table=11

SEQ ID NO: 53878 - protein, 523 aa, Bartonella henselae str. Houston-1; identical to SEQ ID NO: 14389

SEQ ID NO: 53879 - DNA, 1530 bp, Bacillus thuringiensis serovar konkukian str. 97-27; identical to SEQ ID NO: 14390
  CDS (1)..(1530): transl_table=11

SEQ ID NO: 53880 - protein, 509 aa, Bacillus thuringiensis serovar konkukian str. 97-27; identical to SEQ ID NO: 14391

SEQ ID NO: 53881 - DNA, 1218 bp, Bacillus thuringiensis serovar konkukian str. 97-27; identical to SEQ ID NO: 14392
  CDS (1)..(1218): transl_table=11

SEQ ID NO: 53882 - protein, 405 aa, Bacillus thuringiensis serovar konkukian str. 97-27; identical to SEQ ID NO: 14393

SEQ ID NO: 53883 - DNA, 1134 bp, Bacillus thuringiensis serovar konkukian str. 97-27; identical to SEQ ID NO: 14394
  CDS (1)..(1134): transl_table=11

SEQ ID NO: 53884 - protein, 377 aa, Bacillus thuringiensis serovar konkukian str. 97-27; identical to SEQ ID NO: 14395

SEQ ID NO: 53885 - DNA, 1482 bp, Staphylococcus aureus subsp. aureus MSSA476; identical to SEQ ID NO: 14396
  CDS (1)..(1482): transl_table=11

SEQ ID NO: 53886 - protein, 493 aa, Staphylococcus aureus subsp. aureus MSSA476; identical to SEQ ID NO: 14397

SEQ ID NO: 53887 - DNA, 1563 bp, Acinetobacter sp. ADP1; identical to SEQ ID NO: 14398
  CDS (1)..(1563): transl_table=11

SEQ ID NO: 53888 - protein, 520 aa, Acinetobacter sp. ADP1; identical to SEQ ID NO: 14399

SEQ ID NO: 53889 - DNA, 1560 bp, Acinetobacter sp. ADP1; identical to SEQ ID NO: 14400
  CDS (1)..(1560): transl_table=11

SEQ ID NO: 53890 - protein, 519 aa, Acinetobacter sp. ADP1; identical to SEQ ID NO: 14401

SEQ ID NO: 53891 - DNA, 1461 bp, Erwinia carotovora subsp. atroseptica SCRI1043; identical to SEQ ID NO: 14402
  CDS (1)..(1461)

SEQ ID NO: 53892 - protein, 486 aa, Erwinia carotovora subsp. atroseptica SCRI1043; identical to SEQ ID NO: 14403

SEQ ID NO: 53893 - DNA, 1269 bp, Propionibacterium acnes KPA171202; identical to SEQ ID NO: 14404
  CDS (1)..(1269): transl_table=11

SEQ ID NO: 53894 - protein, 422 aa, Propionibacterium acnes KPA171202; identical to SEQ ID NO: 14405

SEQ ID NO: 53895 - DNA, 1464 bp, Leifsonia xyli subsp. xyli str. CTCB07; identical to SEQ ID NO: 14406
  CDS (1)..(1464): transl_table=11

SEQ ID NO: 53896 - protein, 487 aa, Leifsonia xyli subsp. xyli str. CTCB07; identical to SEQ ID NO: 14407

SEQ ID NO: 53897 - DNA, 1533 bp, Desulfotalea psychrophila LSv54; identical to SEQ ID NO: 14408
  CDS (1)..(1533): transl_table=11

SEQ ID NO: 53898 - protein, 510 aa, Desulfotalea psychrophila LSv54; identical to SEQ ID NO: 14409

SEQ ID NO: 53899 - DNA, 1461 bp, Yersinia pseudotuberculosis IP 32953; identical to SEQ ID NO: 14410
  CDS (1)..(1461): transl_table=11

SEQ ID NO: 53900 - protein, 486 aa, Yersinia pseudotuberculosis IP 32953; identical to SEQ ID NO: 14411

SEQ ID NO: 53901 - DNA, 1545 bp, Bacillus cereus E33L; identical to SEQ ID NO: 14412
  CDS (1)..(1545): transl_table=11

SEQ ID NO: 53902 - protein, 514 aa, Bacillus cereus E33L; identical to SEQ ID NO: 14413

SEQ ID NO: 53903 - DNA, 1212 bp, Bacillus cereus E33L; identical to SEQ ID NO: 14414
  CDS (1)..(1212): transl_table=11

SEQ ID NO: 53904 - protein, 403 aa, Bacillus cereus E33L; identical to SEQ ID NO: 14415

SEQ ID NO: 53905 - DNA, 1104 bp, Bacillus cereus E33L; identical to SEQ ID NO: 14416
  CDS (1)..(1104): transl_table=11

SEQ ID NO: 53906 - protein, 367 aa, Bacillus cereus E33L; identical to SEQ ID NO: 14417

SEQ ID NO: 53907 - DNA, 1536 bp, Mannheimia succiniciproducens MBEL55E; identical to SEQ ID NO: 14418
  CDS (1)..(1536): transl_table=11

SEQ ID NO: 53908 - protein, 511 aa, Mannheimia succiniciproducens MBEL55E; identical to SEQ ID NO: 14419

SEQ ID NO: 53909 - DNA, 1197 bp, Bacteroides fragilis YCH46; identical to SEQ ID NO: 14420
  CDS (1)..(1197): transl_table=11

SEQ ID NO: 53910 - protein, 398 aa, Bacteroides fragilis YCH46; identical to SEQ ID NO: 14421

SEQ ID NO: 53911 - DNA, 1440 bp, Burkholderia mallei ATCC 23344; identical to SEQ ID NO: 14422
  CDS (1)..(1440): transl_table=11

SEQ ID NO: 53912 - protein, 479 aa, Burkholderia mallei ATCC 23344; identical to SEQ ID NO: 14423

SEQ ID NO: 53913 - DNA, 1275 bp, Burkholderia pseudomallei K96243; identical to SEQ ID NO: 14424
  CDS (1)..(1275): transl_table=11

SEQ ID NO: 53914 - protein, 424 aa, Burkholderia pseudomallei K96243; identical to SEQ ID NO: 14425

SEQ ID NO: 53915 - DNA, 1653 bp, Burkholderia pseudomallei K96243; identical to SEQ ID NO: 14426
  CDS (1)..(1653): transl_table=11

SEQ ID NO: 53916 - protein, 550 aa, Burkholderia pseudomallei K96243; identical to SEQ ID NO: 14427

SEQ ID NO: 53917 - DNA, 1458 bp, Photobacterium profundum SS9; identical to SEQ ID NO: 14428
  CDS (1)..(1458): transl_table=11

SEQ ID NO: 53918 - protein, 485 aa, Photobacterium profundum SS9; identical to SEQ ID NO: 14429

SEQ ID NO: 53919 - DNA, 1533 bp, Photobacterium profundum SS9; identical to SEQ ID NO: 14430
  CDS (1)..(1533): transl_table=11

SEQ ID NO: 53920 - protein, 510 aa, Photobacterium profundum SS9; identical to SEQ ID NO: 14431

SEQ ID NO: 53921 - DNA, 1509 bp, Geobacillus kaustophilus HTA426; identical to SEQ ID NO: 14432
  CDS (1)..(1509): transl_table=11

SEQ ID NO: 53922 - protein, 502 aa, Geobacillus kaustophilus HTA426; identical to SEQ ID NO: 14433

SEQ ID NO: 53923 - DNA, 1242 bp, Salmonella enterica subsp. enterica serovar Paratyphi A str. ATCC; identical to SEQ ID NO: 14434
  CDS (1)..(1242): transl_table=11

SEQ ID NO: 53924 - protein, 413 aa, Salmonella enterica subsp. enterica serovar Paratyphi A str. ATCC; identical to SEQ ID NO: 14435

SEQ ID NO: 53925 - DNA, 1395 bp, Idiomarina loihiensis L2TR; identical to SEQ ID NO: 14436
  CDS (1)..(1395): transl_table=11

SEQ ID NO: 53926 - protein, 464 aa, Idiomarina loihiensis L2TR; identical to SEQ ID NO: 14437

SEQ ID NO: 53927 - DNA, 1383 bp, Azoarcus sp. EbN1; identical to SEQ ID NO: 14438
  CDS (1)..(1383): transl_table=11

SEQ ID NO: 53928 - protein, 460 aa, Azoarcus sp. EbN1; identical to SEQ ID NO: 14439

SEQ ID NO: 53929 - DNA, 1458 bp, Azoarcus sp. EbN1; identical to SEQ ID NO: 14440
  CDS (1)..(1458): transl_table=11

SEQ ID NO: 53930 - protein, 485 aa, Azoarcus sp. EbN1; identical to SEQ ID NO: 14441

SEQ ID NO: 53931 - DNA, 1419 bp, Zymomonas mobilis subsp. mobilis ZM4; identical to SEQ ID NO: 14442
  CDS (1)..(1419): transl_table=11

SEQ ID NO: 53932 - protein, 472 aa, Zymomonas mobilis subsp. mobilis ZM4; identical to SEQ ID NO: 14443

SEQ ID NO: 53933 - DNA, 1413 bp, Silicibacter pomeroyi DSS-3; identical to SEQ ID NO: 14444
  CDS (1)..(1413): transl_table=11

SEQ ID NO: 53934 - protein, 470 aa, Silicibacter pomeroyi DSS-3; identical to SEQ ID NO: 14445

SEQ ID NO: 53935 - DNA, 1467 bp, Bacillus clausii KSM-K16; identical to SEQ ID NO: 14446
  CDS (1)..(1467): transl_table=11

SEQ ID NO: 53936 - protein, 488 aa, Bacillus clausii KSM-K16; identical to SEQ ID NO: 14447

SEQ ID NO: 53937 - DNA, 1197 bp, Bacillus clausii KSM-K16; identical to SEQ ID NO: 14448
  CDS (1)..(1197): transl_table=11

SEQ ID NO: 53938 - protein, 398 aa, Bacillus clausii KSM-K16; identical to SEQ ID NO: 14449

SEQ ID NO: 53939 - DNA, 1482 bp, Staphylococcus aureus subsp. aureus COL; identical to SEQ ID NO: 14450
  CDS (1)..(1482): transl_table=11

SEQ ID NO: 53940 - protein, 493 aa, Staphylococcus aureus subsp. aureus COL; identical to SEQ ID NO: 14451

SEQ ID NO: 53941 - DNA, 2016 bp, Xanthomonas oryzae pv. oryzae KACC10331; identical to SEQ ID NO: 14452
  CDS (1)..(2016): transl_table=11

SEQ ID NO: 53942 - protein, 671 aa, Xanthomonas oryzae pv. oryzae KACC10331; identical to SEQ ID NO: 14453

SEQ ID NO: 53943 - DNA, 1419 bp, Xanthomonas oryzae pv. oryzae KACC10331; identical to SEQ ID NO: 14454
  CDS (1)..(1419): transl_table=11

SEQ ID NO: 53944 - protein, 472 aa, Xanthomonas oryzae pv. oryzae KACC10331; identical to SEQ ID NO: 14455

SEQ ID NO: 53945 - DNA, 1548 bp, Vibrio fischeri ES114; identical to SEQ ID NO: 14456
  CDS (1)..(1548): transl_table=11

SEQ ID NO: 53946 - protein, 515 aa, Vibrio fischeri ES114; identical to SEQ ID NO: 14457

SEQ ID NO: 53947 - DNA, 1455 bp, Vibrio fischeri ES114; identical to SEQ ID NO: 14458
  CDS (1)..(1455): transl_table=11

SEQ ID NO: 53948 - protein, 484 aa, Vibrio fischeri ES114; identical to SEQ ID NO: 14459

SEQ ID NO: 53949 - DNA, 1578 bp, Neisseria gonorrhoeae FA 1090; identical to SEQ ID NO: 14460
  CDS (1)..(1578): transl_table=11

SEQ ID NO: 53950 - protein, 525 aa, Neisseria gonorrhoeae FA 1090; identical to SEQ ID NO: 14461

SEQ ID NO: 53951 - DNA, 1440 bp, Bacteroides fragilis NCTC 9343; identical to SEQ ID NO: 14462
  CDS (1)..(1440): transl_table=11

SEQ ID NO: 53952 - protein, 479 aa, Bacteroides fragilis NCTC 9343; identical to SEQ ID NO: 14463

SEQ ID NO: 53953 - DNA, 1275 bp, Bacteroides fragilis NCTC 9343; identical to SEQ ID NO: 14464
  CDS (1)..(1275): transl_table=11

SEQ ID NO: 53954 - protein, 424 aa, Bacteroides fragilis NCTC 9343; identical to SEQ ID NO: 14465

SEQ ID NO: 53955 - DNA, 1242 bp, Salmonella enterica subsp. enterica serovar Choleraesuis str; identical to SEQ ID NO: 14466
  CDS (1)..(1242): transl_table=11

SEQ ID NO: 53956 - protein, 413 aa, Salmonella enterica subsp. enterica serovar Choleraesuis str; identical to SEQ ID NO: 14467

SEQ ID NO: 53957 - DNA, 1587 bp, Salmonella enterica subsp. enterica serovar Choleraesuis str; identical to SEQ ID NO: 14468
  CDS (1)..(1587): transl_table=11

SEQ ID NO: 53958 - protein, 528 aa, Salmonella enterica subsp. enterica serovar Choleraesuis str; identical to SEQ ID NO: 14469

SEQ ID NO: 53959 - DNA, 1581 bp, Pseudomonas syringae pv. syringae B728a; identical to SEQ ID NO: 14470
  CDS (1)..(1581)

SEQ ID NO: 53960 - protein, 526 aa, Pseudomonas syringae pv. syringae B728a; identical to SEQ ID NO: 14471

SEQ ID NO: 53961 - DNA, 1251 bp, Pseudomonas syringae pv. syringae B728a; identical to SEQ ID NO: 14472
  CDS (1)..(1251)

SEQ ID NO: 53962 - protein, 416 aa, Pseudomonas syringae pv. syringae B728a; identical to SEQ ID NO: 14473

SEQ ID NO: 53963 - DNA, 1158 bp, Pseudomonas syringae pv. syringae B728a; identical to SEQ ID NO: 14474
  CDS (1)..(1158)

SEQ ID NO: 53964 - protein, 385 aa, Pseudomonas syringae pv. syringae B728a; identical to SEQ ID NO: 14475

SEQ ID NO: 53965 - DNA, 1440 bp, Pseudomonas syringae pv. syringae B728a; identical to SEQ ID NO: 14476
  CDS (1)..(1440)

SEQ ID NO: 53966 - protein, 479 aa, Pseudomonas syringae pv. syringae B728a; identical to SEQ ID NO: 14477

SEQ ID NO: 53967 - DNA, 1512 bp, Corynebacterium jeikeium K411; identical to SEQ ID NO: 14478
  CDS (1)..(1512): transl_table=11

SEQ ID NO: 53968 - protein, 503 aa, Corynebacterium jeikeium K411; identical to SEQ ID NO: 14479

SEQ ID NO: 53969 - DNA, 1404 bp, Xylella fastidiosa Ann-1; identical to SEQ ID NO: 14480
  CDS (1)..(1404)

SEQ ID NO: 53970 - protein, 467 aa, Xylella fastidiosa Ann-1; identical to SEQ ID NO: 14481

SEQ ID NO: 53971 - DNA, 1488 bp, Lactobacillus gasseri; identical to SEQ ID NO: 14482
  CDS (1)..(1488)

SEQ ID NO: 53972 - protein, 495 aa, Lactobacillus gasseri; identical to SEQ ID NO: 14483

SEQ ID NO: 53973 - DNA, 1416 bp, Leuconostoc mesenteroides subsp. mesenteroides ATCC 8293; identical to SEQ ID NO: 14484
  CDS (1)..(1416)

SEQ ID NO: 53974 - protein, 471 aa, Leuconostoc mesenteroides subsp. mesenteroides ATCC 8293; identical to SEQ ID NO: 14485

SEQ ID NO: 53975 - DNA, 1455 bp, Desulfovibrio desulfuricans G20; identical to SEQ ID NO: 14486
  CDS (1)..(1455)

SEQ ID NO: 53976 - protein, 484 aa, Desulfovibrio desulfuricans G20; identical to SEQ ID NO: 14487

SEQ ID NO: 53977 - DNA, 1434 bp, Pseudomonas aeruginosa UCBPP-PA14; identical to SEQ ID NO: 14488
  CDS (1)..(1434)

SEQ ID NO: 53978 - protein, 477 aa, Pseudomonas aeruginosa UCBPP-PA14; identical to SEQ ID NO: 14489

SEQ ID NO: 53979 - DNA, 1440 bp, Fusobacterium nucleatum subsp. vincentii ATCC 49256; identical to SEQ ID NO: 14490
  CDS (1)..(1440): transl_table=11

SEQ ID NO: 53980 - protein, 479 aa, Fusobacterium nucleatum subsp. vincentii ATCC 49256; identical to SEQ ID NO: 14491

SEQ ID NO: 53981 - DNA, 1713 bp, Psychrobacter sp. 273-4; identical to SEQ ID NO: 14492
  CDS (1)..(1713)

SEQ ID NO: 53982 - protein, 570 aa, Psychrobacter sp. 273-4; identical to SEQ ID NO: 14493

SEQ ID NO: 53983 - DNA, 1644 bp, Psychrobacter sp. 273-4; identical to SEQ ID NO: 14494
  CDS (1)..(1644)

SEQ ID NO: 53984 - protein, 547 aa, Psychrobacter sp. 273-4; identical to SEQ ID NO: 14495

SEQ ID NO: 53985 - DNA, 1470 bp, Ralstonia eutropha JMP134; identical to SEQ ID NO: 14496
  CDS (1)..(1470)

SEQ ID NO: 53986 - protein, 489 aa, Ralstonia eutropha JMP134; identical to SEQ ID NO: 14497

SEQ ID NO: 53987 - DNA, 1617 bp, Ralstonia eutropha JMP134; identical to SEQ ID NO: 14498
  CDS (1)..(1617)

SEQ ID NO: 53988 - protein, 538 aa, Ralstonia eutropha JMP134; identical to SEQ ID NO: 14499

SEQ ID NO: 53989 - DNA, 1809 bp, Ralstonia eutropha JMP134; identical to SEQ ID NO: 14500
  CDS (1)..(1809)

SEQ ID NO: 53990 - protein, 602 aa, Ralstonia eutropha JMP134; identical to SEQ ID NO: 14501

SEQ ID NO: 53991 - DNA, 1329 bp, Ralstonia eutropha JMP134; identical to SEQ ID NO: 14502
  CDS (1)..(1329)

SEQ ID NO: 53992 - protein, 442 aa, Ralstonia eutropha JMP134; identical to SEQ ID NO: 14503

SEQ ID NO: 53993 - DNA, 1254 bp, Ralstonia eutropha JMP134; identical to SEQ ID NO: 14504
  CDS (1)..(1254)

SEQ ID NO: 53994 - protein, 417 aa, Ralstonia eutropha JMP134; identical to SEQ ID NO: 14505

SEQ ID NO: 53995 - DNA, 1551 bp, Burkholderia cepacia R18194; identical to SEQ ID NO: 14506
  CDS (1)..(1551)

SEQ ID NO: 53996 - protein, 516 aa, Burkholderia cepacia R18194; identical to SEQ ID NO: 14507

SEQ ID NO: 53997 - DNA, 1275 bp, Burkholderia cepacia R18194; identical to SEQ ID NO: 14508
  CDS (1)..(1275)

SEQ ID NO: 53998 - protein, 424 aa, Burkholderia cepacia R18194; identical to SEQ ID NO: 14509

SEQ ID NO: 53999 - DNA, 1515 bp, Listeria monocytogenes str. 4b H7858; identical to SEQ ID NO: 14510
  CDS (1)..(1515): transl_table=11

SEQ ID NO: 54000 - protein, 504 aa, Listeria monocytogenes str. 4b H7858; identical to SEQ ID NO: 14511

SEQ ID NO: 54001 - DNA, 1212 bp, Bacillus cereus G9241; identical to SEQ ID NO: 14512
  CDS (1)..(1212): transl_table=11

SEQ ID NO: 54002 - protein, 403 aa, Bacillus cereus G9241; identical to SEQ ID NO: 14513

SEQ ID NO: 54003 - DNA, 1530 bp, Bacillus cereus G9241; identical to SEQ ID NO: 14514
  CDS (1)..(1530): transl_table=11

SEQ ID NO: 54004 - protein, 509 aa, Bacillus cereus G9241; identical to SEQ ID NO: 14515

SEQ ID NO: 54005 - DNA, 1545 bp, Bacillus cereus G9241; identical to SEQ ID NO: 14516
  CDS (1)..(1545): transl_table=11

SEQ ID NO: 54006 - protein, 514 aa, Bacillus cereus G9241; identical to SEQ ID NO: 14517

SEQ ID NO: 54007 - DNA, 1167 bp, Bacillus cereus G9241; identical to SEQ ID NO: 14518
  CDS (1)..(1167): transl_table=11

SEQ ID NO: 54008 - protein, 388 aa, Bacillus cereus G9241; identical to SEQ ID NO: 14519

SEQ ID NO: 54009 - DNA, 1194 bp, Bacillus cereus G9241; identical to SEQ ID NO: 14520
  CDS (1)..(1194): transl_table=11

SEQ ID NO: 54010 - protein, 397 aa, Bacillus cereus G9241; identical to SEQ ID NO: 14521

SEQ ID NO: 54011 - DNA, 1314 bp, Rubrivivax gelatinosus PM1; identical to SEQ ID NO: 14522
  CDS (1)..(1314)

SEQ ID NO: 54012 - protein, 437 aa, Rubrivivax gelatinosus PM1; identical to SEQ ID NO: 14523

SEQ ID NO: 54013 - DNA, 1647 bp, Rubrivivax gelatinosus PM1; identical to SEQ ID NO: 14524
  CDS (1)..(1647)

SEQ ID NO: 54014 - protein, 548 aa, Rubrivivax gelatinosus PM1; identical to SEQ ID NO: 14525

SEQ ID NO: 54015 - DNA, 1287 bp, Pseudomonas fluorescens PfO-1; identical to SEQ ID NO: 14526
  CDS (1)..(1287)

SEQ ID NO: 54016 - protein, 428 aa, Pseudomonas fluorescens PfO-1; identical to SEQ ID NO: 14527

SEQ ID NO: 54017 - DNA, 1158 bp, Pseudomonas fluorescens PfO-1; identical to SEQ ID NO: 14528
  CDS (1)..(1158)

SEQ ID NO: 54018 - protein, 385 aa, Pseudomonas fluorescens PfO-1; identical to SEQ ID NO: 14529

SEQ ID NO: 54019 - DNA, 1263 bp, Burkholderia fungorum LB400; identical to SEQ ID NO: 14530
  CDS (1)..(1263)

SEQ ID NO: 54020 - protein, 420 aa, Burkholderia fungorum LB400; identical to SEQ ID NO: 14531

SEQ ID NO: 54021 - DNA, 1554 bp, Burkholderia fungorum LB400; identical to SEQ ID NO: 14532
  CDS (1)..(1554)

SEQ ID NO: 54022 - protein, 517 aa, Burkholderia fungorum LB400; identical to SEQ ID NO: 14533

SEQ ID NO: 54023 - DNA, 1452 bp, Burkholderia fungorum LB400; identical to SEQ ID NO: 14534
  CDS (1)..(1452)

SEQ ID NO: 54024 - protein, 483 aa, Burkholderia fungorum LB400; identical to SEQ ID NO: 14535

SEQ ID NO: 54025 - DNA, 1503 bp, Cytophaga hutchinsonii; identical to SEQ ID NO: 14536
  CDS (1)..(1503)

SEQ ID NO: 54026 - protein, 500 aa, Cytophaga hutchinsonii; identical to SEQ ID NO: 14537

SEQ ID NO: 54027 - DNA, 1434 bp, Oenococcus oeni PSU-1; identical to SEQ ID NO: 14538
  CDS (1)..(1434)

SEQ ID NO: 54028 - protein, 477 aa, Oenococcus oeni PSU-1; identical to SEQ ID NO: 14539

SEQ ID NO: 54029 - DNA, 1464 bp, Pediococcus pentosaceus ATCC 25745; identical to SEQ ID NO: 14540
  CDS (1)..(1464)

SEQ ID NO: 54030 - protein, 487 aa, Pediococcus pentosaceus ATCC 25745; identical to SEQ ID NO: 14541

SEQ ID NO: 54031 - DNA, 1365 bp, Pediococcus pentosaceus ATCC 25745; identical to SEQ ID NO: 14542
  CDS (1)..(1365)

SEQ ID NO: 54032 - protein, 454 aa, Pediococcus pentosaceus ATCC 25745; identical to SEQ ID NO: 14543

SEQ ID NO: 54033 - DNA, 1191 bp, Thiobacillus denitrificans ATCC 25259; identical to SEQ ID NO: 14544
  CDS (1)..(1191)

SEQ ID NO: 54034 - protein, 396 aa, Thiobacillus denitrificans ATCC 25259; identical to SEQ ID NO: 14545

SEQ ID NO: 54035 - DNA, 1443 bp, Thiobacillus denitrificans ATCC 25259; identical to SEQ ID NO: 14546
  CDS (1)..(1443)

SEQ ID NO: 54036 - protein, 480 aa, Thiobacillus denitrificans ATCC 25259; identical to SEQ ID NO: 14547

SEQ ID NO: 54037 - DNA, 1260 bp, Thiobacillus denitrificans ATCC 25259; identical to SEQ ID NO: 14548
  CDS (1)..(1260)

SEQ ID NO: 54038 - protein, 419 aa, Thiobacillus denitrificans ATCC 25259; identical to SEQ ID NO: 14549

SEQ ID NO: 54039 - DNA, 1959 bp, Xylella fastidiosa Ann-1; identical to SEQ ID NO: 14550
  CDS (1)..(1959)

SEQ ID NO: 54040 - protein, 652 aa, Xylella fastidiosa Ann-1; identical to SEQ ID NO: 14551

SEQ ID NO: 54041 - DNA, 1206 bp, Pseudomonas aeruginosa UCBPP-PA14; identical to SEQ ID NO: 14552
  CDS (1)..(1206)

SEQ ID NO: 54042 - protein, 401 aa, Pseudomonas aeruginosa UCBPP-PA14; identical to SEQ ID NO: 14553

SEQ ID NO: 54043 - DNA, 1203 bp, Erythrobacter litoralis HTCC2594; identical to SEQ ID NO: 14554
  CDS (1)..(1203): transl_table=11

SEQ ID NO: 54044 - protein, 400 aa, Erythrobacter litoralis HTCC2594; identical to SEQ ID NO: 14555

SEQ ID NO: 54045 - DNA, 1497 bp, Brevibacterium linens BL2; identical to SEQ ID NO: 14556
  CDS (1)..(1497)

SEQ ID NO: 54046 - protein, 498 aa, Brevibacterium linens BL2; identical to SEQ ID NO: 14557

SEQ ID NO: 54047 - DNA, 1446 bp, Lactococcus lactis subsp. cremoris SK11; identical to SEQ ID NO: 14558
  CDS (1)..(1446)

SEQ ID NO: 54048 - protein, 481 aa, Lactococcus lactis subsp. cremoris SK11; identical to SEQ ID NO: 14559

SEQ ID NO: 54049 - DNA, 1470 bp, Lactobacillus casei ATCC 334; identical to SEQ ID NO: 14560
  CDS (1)..(1470)

SEQ ID NO: 54050 - protein, 489 aa, Lactobacillus casei ATCC 334; identical to SEQ ID NO: 14561

SEQ ID NO: 54051 - DNA, 1212 bp, Bacillus anthracis str. A2012; identical to SEQ ID NO: 14562
  CDS (1)..(1212)

SEQ ID NO: 54052 - protein, 403 aa, Bacillus anthracis str. A2012; identical to SEQ ID NO: 14563

SEQ ID NO: 54053 - DNA, 2703 bp, Anaeromyxobacter dehalogenans 2CP-C; identical to SEQ ID NO: 14564
  CDS (1)..(2703): transl_table=11

SEQ ID NO: 54054 - protein, 900 aa, Anaeromyxobacter dehalogenans 2CP-C; identical to SEQ ID NO: 14565

SEQ ID NO: 54055 - DNA, 1461 bp, Anaeromyxobacter dehalogenans 2CP-C; identical to SEQ ID NO: 14566
  CDS (1)..(1461): transl_table=11

SEQ ID NO: 54056 - protein, 486 aa, Anaeromyxobacter dehalogenans 2CP-C; identical to SEQ ID NO: 14567

SEQ ID NO: 54057 - DNA, 1509 bp, Anaeromyxobacter dehalogenans 2CP-C; identical to SEQ ID NO: 14568
  CDS (1)..(1509): transl_table=11

SEQ ID NO: 54058 - protein, 502 aa, Anaeromyxobacter dehalogenans 2CP-C; identical to SEQ ID NO: 14569

SEQ ID NO: 54059 - DNA, 1533 bp, Arthrobacter sp. FB24; identical to SEQ ID NO: 14570
  CDS (1)..(1533): transl_table=11

SEQ ID NO: 54060 - protein, 510 aa, Arthrobacter sp. FB24; identical to SEQ ID NO: 14571

SEQ ID NO: 54061 - DNA, 1161 bp, Azotobacter vinelandii AvOP; identical to SEQ ID NO: 14572
  CDS (1)..(1161): transl_table=11

SEQ ID NO: 54062 - protein, 386 aa, Azotobacter vinelandii AvOP; identical to SEQ ID NO: 14573

SEQ ID NO: 54063 - DNA, 1446 bp, Azotobacter vinelandii AvOP; identical to SEQ ID NO: 14574
  CDS (1)..(1446): transl_table=11

SEQ ID NO: 54064 - protein, 481 aa, Azotobacter vinelandii AvOP; identical to SEQ ID NO: 14575

SEQ ID NO: 54065 - DNA, 1623 bp, Burkholderia vietnamiensis G4; identical to SEQ ID NO: 14576
  CDS (1)..(1623): transl_table=11

SEQ ID NO: 54066 - protein, 540 aa, Burkholderia vietnamiensis G4; identical to SEQ ID NO: 14577

SEQ ID NO: 54067 - DNA, 1452 bp, Burkholderia vietnamiensis G4; identical to SEQ ID NO: 14578
  CDS (1)..(1452): transl_table=11

SEQ ID NO: 54068 - protein, 483 aa, Burkholderia vietnamiensis G4; identical to SEQ ID NO: 14579

SEQ ID NO: 54069 - DNA, 1275 bp, Burkholderia mallei 10229; identical to SEQ ID NO: 14580
  CDS (1)..(1275)

SEQ ID NO: 54070 - protein, 424 aa, Burkholderia mallei 10229; identical to SEQ ID NO: 14581

SEQ ID NO: 54071 - DNA, 1275 bp, Burkholderia mallei 10399; identical to SEQ ID NO: 14582
  CDS (1)..(1275)

SEQ ID NO: 54072 - protein, 424 aa, Burkholderia mallei 10399; identical to SEQ ID NO: 14583

SEQ ID NO: 54073 - DNA, 1275 bp, Burkholderia cenocepacia AU 1054; identical to SEQ ID NO: 14621
  CDS (1)..(1275): transl_table=11

SEQ ID NO: 54074 - protein, 424 aa, Burkholderia cenocepacia AU 1054; identical to SEQ ID NO: 14622

SEQ ID NO: 54075 - DNA, 1623 bp, Burkholderia cenocepacia AU 1054; identical to SEQ ID NO: 14623
  CDS (1)..(1623): transl_table=11

SEQ ID NO: 54076 - protein, 540 aa, Burkholderia cenocepacia AU 1054; identical to SEQ ID NO: 14624

SEQ ID NO: 54077 - DNA, 1440 bp, Burkholderia cenocepacia AU 1054; identical to SEQ ID NO: 14625
  CDS (1)..(1440): transl_table=11

SEQ ID NO: 54078 - protein, 479 aa, Burkholderia cenocepacia AU 1054; identical to SEQ ID NO: 14626

SEQ ID NO: 54079 - DNA, 1077 bp, Burkholderia cenocepacia HI2424; identical to SEQ ID NO: 14627
  CDS (1)..(1077): transl_table=11

SEQ ID NO: 54080 - protein, 358 aa, Burkholderia cenocepacia HI2424; identical to SEQ ID NO: 14628

SEQ ID NO: 54081 - DNA, 1551 bp, Burkholderia cenocepacia HI2424; identical to SEQ ID NO: 14629
  CDS (1)..(1551): transl_table=11

SEQ ID NO: 54082 - protein, 516 aa, Burkholderia cenocepacia HI2424; identical to SEQ ID NO: 14630

SEQ ID NO: 54083 - DNA, 1425 bp, Chromohalobacter salexigens DSM 3043; identical to SEQ ID NO: 14631
  CDS (1)..(1425): transl_table=11

SEQ ID NO: 54084 - protein, 474 aa, Chromohalobacter salexigens DSM 3043; identical to SEQ ID NO: 14632

SEQ ID NO: 54085 - DNA, 1440 bp, Burkholderia pseudomallei 668; identical to SEQ ID NO: 14633
  CDS (1)..(1440)

SEQ ID NO: 54086 - protein, 479 aa, Burkholderia pseudomallei 668; identical to SEQ ID NO: 14634

SEQ ID NO: 54087 - DNA, 1719 bp, Polaromonas sp. JS666; identical to SEQ ID NO: 14635
  CDS (1)..(1719): transl_table=11

SEQ ID NO: 54088 - protein, 572 aa, Polaromonas sp. JS666; identical to SEQ ID NO: 14636

SEQ ID NO: 54089 - DNA, 1284 bp, Solibacter usitatus Ellin6076; identical to SEQ ID NO: 14637
  CDS (1)..(1284): transl_table=11

SEQ ID NO: 54090 - protein, 427 aa, Solibacter usitatus Ellin6076; identical to SEQ ID NO: 14638

SEQ ID NO: 54091 - DNA, 1191 bp, Geobacter metallireducens GS-15; identical to SEQ ID NO: 14639
  CDS (1)..(1191): transl_table=11

SEQ ID NO: 54092 - protein, 396 aa, Geobacter metallireducens GS-15; identical to SEQ ID NO: 14640

SEQ ID NO: 54093 - DNA, 1509 bp, Geobacter metallireducens GS-15; identical to SEQ ID NO: 14641
  CDS (1)..(1509): transl_table=11

SEQ ID NO: 54094 - protein, 502 aa, Geobacter metallireducens GS-15; identical to SEQ ID NO: 14642

SEQ ID NO: 54095 - DNA, 1524 bp, Exiguobacterium sp. 255-15; identical to SEQ ID NO: 14643
  CDS (1)..(1524): transl_table=11

SEQ ID NO: 54096 - protein, 507 aa, Exiguobacterium sp. 255-15; identical to SEQ ID NO: 14644

SEQ ID NO: 54097 - DNA, 1440 bp, Exiguobacterium sp. 255-15; identical to SEQ ID NO: 14645
  CDS (1)..(1440): transl_table=11

SEQ ID NO: 54098 - protein, 479 aa, Exiguobacterium sp. 255-15; identical to SEQ ID NO: 14646

SEQ ID NO: 54099 - DNA, 1512 bp, Exiguobacterium sp. 255-15; identical to SEQ ID NO: 14647
  CDS (1)..(1512): transl_table=11

SEQ ID NO: 54100 - protein, 503 aa, Exiguobacterium sp. 255-15; identical to SEQ ID NO: 14648

SEQ ID NO: 54101 - DNA, 1467 bp, Desulfuromonas acetoxidans DSM 684; identical to SEQ ID NO: 14649
  CDS (1)..(1467): transl_table=11

SEQ ID NO: 54102 - protein, 488 aa, Desulfuromonas acetoxidans DSM 684; identical to SEQ ID NO: 14650

SEQ ID NO: 54103 - DNA, 1443 bp, Desulfuromonas acetoxidans DSM 684; identical to SEQ ID NO: 14651
  CDS (1)..(1443): transl_table=11

SEQ ID NO: 54104 - protein, 480 aa, Desulfuromonas acetoxidans DSM 684; identical to SEQ ID NO: 14652

SEQ ID NO: 54105 - DNA, 1437 bp, Desulfitobacterium hafniense DCB-2; identical to SEQ ID NO: 14653
  CDS (1)..(1437): transl_table=11

SEQ ID NO: 54106 - protein, 478 aa, Desulfitobacterium hafniense DCB-2; identical to SEQ ID NO: 14654

SEQ ID NO: 54107 - DNA, 1608 bp, Methylobacillus flagellatus KT; identical to SEQ ID NO: 14655
  CDS (1)..(1608): transl_table=11

SEQ ID NO: 54108 - protein, 535 aa, Methylobacillus flagellatus KT; identical to SEQ ID NO: 14656

SEQ ID NO: 54109 - DNA, 1152 bp, Methylobacillus flagellatus KT; identical to SEQ ID NO: 14657
  CDS (1)..(1152): transl_table=11

SEQ ID NO: 54110 - protein, 383 aa, Methylobacillus flagellatus KT; identical to SEQ ID NO: 14658

SEQ ID NO: 54111 - DNA, 1173 bp, Sphingopyxis alaskensis RB2256; identical to SEQ ID NO: 14659
  CDS (1)..(1173): transl_table=11

SEQ ID NO: 54112 - protein, 390 aa, Sphingopyxis alaskensis RB2256; identical to SEQ ID NO: 14660

SEQ ID NO: 54113 - DNA, 1140 bp, Sphingopyxis alaskensis RB2256; identical to SEQ ID NO: 14661
  CDS (1)..(1140): transl_table=11

SEQ ID NO: 54114 - protein, 379 aa, Sphingopyxis alaskensis RB2256; identical to SEQ ID NO: 14662

SEQ ID NO: 54115 - DNA, 1527 bp, Shewanella amazonensis SB2B; identical to SEQ ID NO: 14663
  CDS (1)..(1527): transl_table=11

SEQ ID NO: 54116 - protein, 508 aa, Shewanella amazonensis SB2B; identical to SEQ ID NO: 14664

SEQ ID NO: 54117 - DNA, 1518 bp, Ralstonia metallidurans CH34; identical to SEQ ID NO: 14665
  CDS (1)..(1518): transl_table=11

SEQ ID NO: 54118 - protein, 505 aa, Ralstonia metallidurans CH34; identical to SEQ ID NO: 14666

SEQ ID NO: 54119 - DNA, 1605 bp, Ralstonia metallidurans CH34; identical to SEQ ID NO: 14667
  CDS (1)..(1605): transl_table=11

SEQ ID NO: 54120 - protein, 534 aa, Ralstonia metallidurans CH34; identical to SEQ ID NO: 14668

SEQ ID NO: 54121 - DNA, 1599 bp, Ralstonia metallidurans CH34; identical to SEQ ID NO: 14669
  CDS (1)..(1599): transl_table=11

SEQ ID NO: 54122 - protein, 532 aa, Ralstonia metallidurans CH34; identical to SEQ ID NO: 14670

SEQ ID NO: 54123 - DNA, 1281 bp, Rubrobacter xylanophilus DSM 9941; identical to SEQ ID NO: 14671
  CDS (1)..(1281): transl_table=11

SEQ ID NO: 54124 - protein, 426 aa, Rubrobacter xylanophilus DSM 9941; identical to SEQ ID NO: 14672

SEQ ID NO: 54125 - DNA, 1437 bp, Mesorhizobium sp. BNC1; identical to SEQ ID NO: 14673
  CDS (1)..(1437): transl_table=11

SEQ ID NO: 54126 - protein, 478 aa, Mesorhizobium sp. BNC1; identical to SEQ ID NO: 14674

SEQ ID NO: 54127 - DNA, 1404 bp, Kineococcus radiotolerans SRS30216; identical to SEQ ID NO: 14675
  CDS (1)..(1404): transl_table=11

SEQ ID NO: 54128 - protein, 467 aa, Kineococcus radiotolerans SRS30216; identical to SEQ ID NO: 14676

SEQ ID NO: 54129 - DNA, 1476 bp, Kineococcus radiotolerans SRS30216; identical to SEQ ID NO: 14677
  CDS (1)..(1476): transl_table=11

SEQ ID NO: 54130 - protein, 491 aa, Kineococcus radiotolerans SRS30216; identical to SEQ ID NO: 14678

SEQ ID NO: 54131 - DNA, 1551 bp, Silicibacter sp. TM1040; identical to SEQ ID NO: 14679
  CDS (1)..(1551): transl_table=11

SEQ ID NO: 54132 - protein, 516 aa, Silicibacter sp. TM1040; identical to SEQ ID NO: 14680

SEQ ID NO: 54133 - DNA, 1554 bp, Nitrobacter hamburgensis X14; identical to SEQ ID NO: 14681
  CDS (1)..(1554): transl_table=11

SEQ ID NO: 54134 - protein, 517 aa, Nitrobacter hamburgensis X14; identical to SEQ ID NO: 14682

SEQ ID NO: 54135 - DNA, 1428 bp, Paracoccus denitrificans PD1222; identical to SEQ ID NO: 14683
  CDS (1)..(1428): transl_table=11

SEQ ID NO: 54136 - protein, 475 aa, Paracoccus denitrificans PD1222; identical to SEQ ID NO: 14684

SEQ ID NO: 54137 - DNA, 1569 bp, Pseudomonas fluorescens; identical to SEQ ID NO: 14685
  CDS (1)..(1569): transl_table=11

SEQ ID NO: 54138 - protein, 522 aa, Pseudomonas fluorescens; identical to SEQ ID NO: 14686

SEQ ID NO: 54139 - DNA, 1158 bp, Pseudomonas fluorescens; identical to SEQ ID NO: 14687
  CDS (1)..(1158): transl_table=11

SEQ ID NO: 54140 - protein, 385 aa, Pseudomonas fluorescens; identical to SEQ ID NO: 14688

SEQ ID NO: 54141 - DNA, 1485 bp, Staphylococcus haemolyticus; identical to SEQ ID NO: 14689
  CDS (1)..(1485): transl_table=11

SEQ ID NO: 54142 - protein, 494 aa, Staphylococcus haemolyticus; identical to SEQ ID NO: 14690

SEQ ID NO: 54143 - DNA, 1515 bp, Listeria monocytogenes; identical to SEQ ID NO: 14691
  CDS (1)..(1515): transl_table=11

SEQ ID NO: 54144 - protein, 504 aa, Listeria monocytogenes; identical to SEQ ID NO: 14692

SEQ ID NO: 54145 - DNA, 1485 bp, Salmonella typhimurium; identical to SEQ ID NO: 14693
  CDS (1)..(1485): transl_table=11

SEQ ID NO: 54146 - protein, 494 aa, Salmonella typhimurium; identical to SEQ ID NO: 14694

SEQ ID NO: 54147 - DNA, 1530 bp, Bacillus anthracis; identical to SEQ ID NO: 14695
  CDS (1)..(1530): transl_table=11

SEQ ID NO: 54148 - protein, 509 aa, Bacillus anthracis; identical to SEQ ID NO: 14696

SEQ ID NO: 54149 - DNA, 1530 bp, Bacillus cereus; identical to SEQ ID NO: 14697
  CDS (1)..(1530): transl_table=11

SEQ ID NO: 54150 - protein, 509 aa, Bacillus cereus; identical to SEQ ID NO: 14698

SEQ ID NO: 54151 - DNA, 1503 bp, Bacillus subtilis; identical to SEQ ID NO: 14699
  CDS (1)..(1503): transl_table=11

SEQ ID NO: 54152 - protein, 500 aa, Bacillus subtilis; identical to SEQ ID NO: 14700

SEQ ID NO: 54153 - DNA, 1482 bp, Staphylococcus aureus; identical to SEQ ID NO: 14701
  CDS (1)..(1482): transl_table=11

SEQ ID NO: 54154 - protein, 493 aa, Staphylococcus aureus; identical to SEQ ID NO: 14702

SEQ ID NO: 54155 - DNA, 1473 bp, Staphylococcus epidermidis; identical to SEQ ID NO: 14703
  CDS (1)..(1473): transl_table=11

SEQ ID NO: 54156 - protein, 490 aa, Staphylococcus epidermidis; identical to SEQ ID NO: 14704

SEQ ID NO: 54157 - DNA, 1473 bp, Staphylococcus epidermidis; identical to SEQ ID NO: 14705
  CDS (1)..(1473): transl_table=11

SEQ ID NO: 54158 - protein, 490 aa, Staphylococcus epidermidis; identical to SEQ ID NO: 14706

SEQ ID NO: 54159 - DNA, 1545 bp, Bacillus cereus; identical to SEQ ID NO: 14707
  CDS (1)..(1545): transl_table=11

SEQ ID NO: 54160 - protein, 514 aa, Bacillus cereus; identical to SEQ ID NO: 14708

SEQ ID NO: 54161 - DNA, 1449 bp, Bacillus subtilis; identical to SEQ ID NO: 14709
  CDS (1)..(1449): transl_table=11

SEQ ID NO: 54162 - protein, 482 aa, Bacillus subtilis; identical to SEQ ID NO: 14710

SEQ ID NO: 54163 - DNA, 1485 bp, Staphylococcus aureus; identical to SEQ ID NO: 14711
  CDS (1)..(1485): transl_table=11

SEQ ID NO: 54164 - protein, 494 aa, Staphylococcus aureus; identical to SEQ ID NO: 14712

SEQ ID NO: 54165 - DNA, 1467 bp, Staphylococcus epidermidis; identical to SEQ ID NO: 14713
  CDS (1)..(1467)

SEQ ID NO: 54166 - protein, 488 aa, Staphylococcus epidermidis; identical to SEQ ID NO: 14714

SEQ ID NO: 54167 - DNA, 1512 bp, Bacillus halodurans; identical to SEQ ID NO: 14715
  CDS (1)..(1512): transl_table=11

SEQ ID NO: 54168 - protein, 503 aa, Bacillus halodurans; identical to SEQ ID NO: 14716

SEQ ID NO: 54169 - DNA, 1512 bp, Bacillus pseudofirmus; identical to SEQ ID NO: 14717
  CDS (1)..(1512): transl_table=11

SEQ ID NO: 54170 - protein, 503 aa, Bacillus pseudofirmus; identical to SEQ ID NO: 14718

SEQ ID NO: 54171 - DNA, 1473 bp, Buchnera aphidicola; identical to SEQ ID NO: 14719
  CDS (1)..(1473): transl_table=11

SEQ ID NO: 54172 - protein, 490 aa, Buchnera aphidicola; identical to SEQ ID NO: 14720

SEQ ID NO: 54173 - DNA, 1431 bp, Clostridium perfringens; identical to SEQ ID NO: 14721
  CDS (1)..(1431): transl_table=11

SEQ ID NO: 54174 - protein, 476 aa, Clostridium perfringens; identical to SEQ ID NO: 14722

SEQ ID NO: 54175 - DNA, 1461 bp, Escherichia coli O157; identical to SEQ ID NO: 14723
  CDS (1)..(1461): transl_table=11

SEQ ID NO: 54176 - protein, 486 aa, Escherichia coli O157; identical to SEQ ID NO: 14724

SEQ ID NO: 54177 - DNA, 1449 bp, Listeria monocytogenes; identical to SEQ ID NO: 14725
  CDS (1)..(1449): transl_table=11

SEQ ID NO: 54178 - protein, 482 aa, Listeria monocytogenes; identical to SEQ ID NO: 14726

SEQ ID NO: 54179 - DNA, 1473 bp, Pseudomonas aeruginosa; identical to SEQ ID NO: 14727
  CDS (1)..(1473): transl_table=11

SEQ ID NO: 54180 - protein, 490 aa, Pseudomonas aeruginosa; identical to SEQ ID NO: 14728

SEQ ID NO: 54181 - DNA, 1446 bp, Pseudomonas putida; identical to SEQ ID NO: 14729
  CDS (1)..(1446): transl_table=11

SEQ ID NO: 54182 - protein, 481 aa, Pseudomonas putida; identical to SEQ ID NO: 14730

SEQ ID NO: 54183 - DNA, 1446 bp, Pseudomonas putida; identical to SEQ ID NO: 14731
  CDS (1)..(1446): transl_table=11

SEQ ID NO: 54184 - protein, 481 aa, Pseudomonas putida; identical to SEQ ID NO: 14732

SEQ ID NO: 54185 - DNA, 1440 bp, Pseudomonas syringae; identical to SEQ ID NO: 14733
  CDS (1)..(1440): transl_table=11

SEQ ID NO: 54186 - protein, 479 aa, Pseudomonas syringae; identical to SEQ ID NO: 14734

SEQ ID NO: 54187 - DNA, 1461 bp, Salmonella typhi; identical to SEQ ID NO: 14735
  CDS (1)..(1461): transl_table=11

SEQ ID NO: 54188 - protein, 486 aa, Salmonella typhi; identical to SEQ ID NO: 14736

SEQ ID NO: 54189 - DNA, 1461 bp, Shigella flexneri; identical to SEQ ID NO: 14737
  CDS (1)..(1461): transl_table=11

SEQ ID NO: 54190 - protein, 486 aa, Shigella flexneri; identical to SEQ ID NO: 14738

SEQ ID NO: 54191 - DNA, 1485 bp, Staphylococcus aureus; identical to SEQ ID NO: 14739
  CDS (1)..(1485): transl_table=11

SEQ ID NO: 54192 - protein, 494 aa, Staphylococcus aureus; identical to SEQ ID NO: 14740

SEQ ID NO: 54193 - DNA, 1461 bp, Yersinia pestis; identical to SEQ ID NO: 14741
  CDS (1)..(1461): transl_table=11

SEQ ID NO: 54194 - protein, 486 aa, Yersinia pestis; identical to SEQ ID NO: 14742

SEQ ID NO: 54195 - DNA, 1509 bp, Helicobacter pylori J99; identical to SEQ ID NO: 14743
  CDS (1)..(1509): transl_table=11

SEQ ID NO: 54196 - protein, 502 aa, Helicobacter pylori J99; identical to SEQ ID NO: 14744

SEQ ID NO: 54197 - DNA, 1509 bp, Helicobacter pylori; identical to SEQ ID NO: 14745
  CDS (1)..(1509): transl_table=11

SEQ ID NO: 54198 - protein, 502 aa, Helicobacter pylori; identical to SEQ ID NO: 14746

SEQ ID NO: 54199 - DNA, 1242 bp, Escherichia coli; identical to SEQ ID NO: 14747
  CDS (1)..(1242): transl_table=11

SEQ ID NO: 54200 - protein, 413 aa, Escherichia coli; identical to SEQ ID NO: 14748

SEQ ID NO: 54201 - DNA, 1242 bp, Salmonella typhimurium; identical to SEQ ID NO: 14749
  CDS (1)..(1242): transl_table=11

SEQ ID NO: 54202 - protein, 413 aa, Salmonella typhimurium; identical to SEQ ID NO: 14750

SEQ ID NO: 54203 - DNA, 1242 bp, Shigella flexneri; identical to SEQ ID NO: 14751
  CDS (1)..(1242): transl_table=11

SEQ ID NO: 54204 - protein, 413 aa, Shigella flexneri; identical to SEQ ID NO: 14752

SEQ ID NO: 54205 - DNA, 23 bp, Artificial sequence
  (1)..(23): primer
atgatgaagaaaacgcccacctc

SEQ ID NO: 54206 - DNA, 24 bp, Artificial sequence
  (1)..(24): primer
ttacaataaccattccacgggcaa

SEQ ID NO: 54207 - protein, 736 aa, Artificial sequence; identical to SEQ ID NO: 14755
  Variant (3)..(4): xaa in position 3 to 4 is any amino acid
  Variant (6)..(7): xaa in position 6 to 7 is any amino acid
  Variant (9)..(10): xaa in position 9 to 10 is any amino acid
  Variant (12)..(16): xaa in position 12 to 16 is any amino acid
  Variant (18)..(19): xaa in position 18 to 19 is any or no amino acid
  Variant (21)..(21): xaa in position 21 is any amino acid
  Variant (22)..(93): xaa in position 22 to 93 is any or no amino acid
  Variant (95)..(105): xaa in position 95 to 105 is any amino acid
  Variant (106)..(109): xaa in position 106 to 109 is any or no amino acid
  Variant (111)..(111): xaa in position 111 is any amino acid
  Variant (113)..(113): xaa in position 113 is any amino acid
  Variant (116)..(117): xaa in position 116 to 117 is any amino acid
  Variant (119)..(119): xaa in position 119 is any or no amino acid
  Variant (121)..(121): xaa in position 121 is any amino acid
  Variant (123)..(123): xaa in position 123 is any amino acid
  Variant (127)..(128): xaa in position 127 to 128 is any amino acid
  Variant (130)..(131): xaa in position 130 to 131 is any amino acid
  Variant (133)..(135): xaa in position 133 to 135 is any amino acid
  Variant (137)..(137): xaa in position 137 is any amino acid
  Variant (139)..(139): xaa in position 139 is any amino acid
  Variant (144)..(145): xaa in position 144 to 145 is any amino acid
  Variant (147)..(147): xaa in position 147 is any amino acid
  Variant (150)..(151): xaa in position 150 to 151 is any amino acid
  Variant (153)..(154): xaa in position 153 to 154 is any amino acid
  Variant (158)..(158): xaa in position 158 is any amino acid
  Variant (161)..(161): xaa in position 161 is any amino acid
  Variant (165)..(165): xaa in position 165 is any amino acid
  Variant (172)..(172): xaa in position 172 is any amino acid
  Variant (176)..(183): xaa in position 176 to 183 is any amino acid
  Variant (184)..(190): xaa in position 184 to 190 is any or no amino acid
  Variant (192)..(194): xaa in position 192 to 194 is any amino acid
  Variant (197)..(197): xaa in position 197 is any amino acid
  Variant (199)..(200): xaa in position 199 to 200 is any amino acid
  Variant (202)..(202): xaa in position 202 is any amino acid
  Variant (204)..(209): xaa in position 204 to 209 is any amino acid
  Variant (210)..(229): xaa in position 210 to 229 is any or no amino acid
  Variant (233)..(233): xaa in position 233 is any amino acid
  Variant (235)..(235): xaa in position 235 is any amino acid
  Variant (245)..(245): xaa in position 245 is any amino acid
  Variant (252)..(252): xaa in position 252 is any amino acid
  Variant (259)..(261): xaa in position 259 to 261 is any amino acid
  Variant (262)..(286): xaa in position 262 to 286 is any or no amino acid
  Variant (288)..(288): xaa in position 288 is any or no amino acid
  Variant (290)..(291): xaa in position 290 to 291 is any amino acid
  Variant (295)..(295): xaa in position 295 is any amino acid
  Variant (298)..(298): xaa in position 298 is any amino acid
  Variant (300)..(301): xaa in position 300 to 301 is any amino acid
  Variant (303)..(305): xaa in position 303 to 305 is any amino acid
  Variant (307)..(308): xaa in position 307 to 308 is any amino acid
  Variant (311)..(313): xaa in position 311 to 313 is any amino acid
  Variant (315)..(327): xaa in position 315 to 327 is any amino acid
  Variant (328)..(382): xaa in position 328 to 382 is any or no amino acid
  Variant (384)..(384): xaa in position 384 is any or no amino acid
  Variant (388)..(388): xaa in position 388 is any amino acid
  Variant (391)..(396): xaa in position 391 to 396 is any amino acid
  Variant (398)..(400): xaa in position 398 to 400 is any amino acid
  Variant (401)..(413): xaa in position 401 to 413 is any or no amino acid
  Variant (415)..(415): xaa in position 415 is any or no amino acid
  Variant (418)..(419): xaa in position 418 to 419 is any amino acid
  Variant (423)..(423): xaa in position 423 is any or no amino acid
  Variant (425)..(425): xaa in position 425 is any or no amino acid
  Variant (427)..(427): xaa in position 427 is any or no amino acid
  Variant (434)..(436): xaa in position 434 to 436 is any amino acid
  Variant (439)..(439): xaa in position 439 is any amino acid
  Variant (442)..(443): xaa in position 442 to 443 is any amino acid
  Variant (446)..(446): xaa in position 446 is any amino acid
  Variant (450)..(454): xaa in position 450 to 454 is any or no amino acid
  Variant (456)..(456): xaa in position 456 is any amino acid
  Variant (461)..(463): xaa in position 461 to 463 is any amino acid
  Variant (465)..(466): xaa in position 465 to 466 is any amino acid
  Variant (469)..(470): xaa in position 469 to 470 is any amino acid
  Variant (472)..(474): xaa in position 472 to 474 is any amino acid
  Variant (476)..(477): xaa in position 476 to 477 is any amino acid
  Variant (478)..(488): xaa in position 478 to 488 is any or no amino acid
  Variant (491)..(491): xaa in position 491 is any amino acid
  Variant (498)..(498): xaa in position 498 is any amino acid
  Variant (500)..(503): xaa in position 500 to 503 is any amino acid
  Variant (504)..(608): xaa in position 504 to 608 is any or no amino acid
  Variant (613)..(613): xaa in position 613 is any amino acid
  Variant (618)..(618): xaa in position 618 is any amino acid
  Variant (619)..(626): xaa in position 619 to 626 is any or no amino acid
  Variant (629)..(629): xaa in position 629 is any amino acid
  Variant (637)..(637): xaa in position 637 is any amino acid
  Variant (640)..(641): xaa in position 640 to 641 is any amino acid
  Variant (644)..(644): xaa in position 644 is any amino acid
  Variant (647)..(647): xaa in position 647 is any amino acid
  Variant (651)..(651): xaa in position 651 is any amino acid
  Variant (653)..(653): xaa in position 653 is any amino acid
  Variant (654)..(655): xaa in position 654 to 655 is any or no amino acid
  Variant (658)..(659): xaa in position 658 to 659 is any amino acid
  Variant (661)..(666): xaa in position 661 to 666 is any amino acid
  Variant (669)..(669): xaa in position 669 is any amino acid
  Variant (670)..(670): xaa in position 670 is any or no amino acid
  Variant (672)..(672): xaa in position 672 is any amino acid
  Variant (673)..(673): xaa in position 673 is any or no amino acid
  Variant (675)..(678): xaa in position 675 to 678 is any amino acid
  Variant (680)..(681): xaa in position 680 to 681 is any amino acid
  Variant (683)..(684): xaa in position 683 to 684 is any amino acid
  Variant (685)..(722): xaa in position 685 to 722 is any or no amino acid
  Variant (725)..(727): xaa in position 725 to 727 is any amino acid
  Variant (729)..(729): xaa in position 729 is any amino acid
  Variant (734)..(734): xaa in position 734 is any amino acid

SEQ ID NO: 54208 - protein, 17 aa, Artificial sequence
  Variant (2)..(3): xaa in position 2 to 3 is any amino acid
  Variant (4)..(4): xaa in position 4 is any or no amino acid
  Variant (6)..(7): xaa in position 6 to 7 is any amino acid
  Variant (8)..(8): xaa in position 8 is any or no amino acid
  Variant (10)..(10): xaa in position 10 is Ile or Val
  Variant (11)..(11): xaa in position 11 is any amino acid
  Variant (12)..(12): xaa in position 12 is Ala, Cys, Thr or Val
  Variant (13)..(16): xaa in position 13 to 16 is any amino acid
LXXXAXXXGXXXXXXXD

SEQ ID NO: 54209 - protein, 20 aa, Artificial sequence
  Variant (2)..(2): xaa in position 2 is any amino acid
  Variant (4)..(4): xaa in position 4 is Asn or Arg
  Variant (6)..(8): xaa in position 6 to 8 is any amino acid
  Variant (9)..(9): xaa in position 9 is Ala, Ile or Val
  Variant (11)..(13): xaa in position 11 to 13 is any amino acid
  Variant (14)..(14): xaa in position 14 is Ala, Gly, Ser, Thr or Val
  Variant (15)..(16): xaa in position 15 to 16 is any amino acid
  Variant (18)..(18): xaa in position 18 is Gly or Ser
  Variant (19)..(19): xaa in position 19 is any amino acid
RXHXKXXXXDXXXXXXGXXN

SEQ ID NO: 54210 - protein, 22 aa, Artificial sequence
  Variant (2)..(2): xaa in position 2 is Phe or Leu
  Variant (3)..(3): xaa in position 3 is Phe, Ile, Leu or Val
  Variant (5)..(11): xaa in position 5 to 11 is any amino acid
  Variant (12)..(12): xaa in position 12 is Phe, Ile, Leu, Met or Val
  Variant (13)..(18): xaa in position 13 to 18 is any amino acid
  Variant (20)..(21): xaa in position 20 to 21 is any or no amino acid
YXXPXXXXXXXXXXXXXXGXXV

SEQ ID NO: 54211 - protein, 29 aa, Artificial sequence
  Variant (2)..(2): xaa in position 2 is Ala, Gly, Gln, Ser or Thr
  Variant (4)..(7): xaa in position 4 to 7 is any amino acid
  Variant (9)..(13): xaa in position 9 to 13 is any amino acid
  Variant (14)..(14): xaa in position 14 is any or no amino acid
  Variant (16)..(16): xaa in position 16 is Ser or Thr
  Variant (17)..(17): xaa in position 17 is any amino acid
  Variant (19)..(19): xaa in position 19 is any amino acid
  Variant (20)..(20): xaa in position 20 is Asp, Asn or Thr
  Variant (21)..(21): xaa in position 21 is any amino acid
  Variant (24)..(28): xaa in position 24 to 28 is any amino acid
HXKXXXXDXXXXXXGXXNXXXRSXXXXXE

SEQ ID NO: 54212 - DNA, 1242 bp, Escherichia coli K12; identical to SEQ ID NO: 19626
  CDS (1)..(1242): transl_table=11

SEQ ID NO: 54213 - protein, 413 aa, Escherichia coli K12; identical to SEQ ID NO: 19627

SEQ ID NO: 54214 - DNA, 1212 bp, Caenorhabditis elegans; identical to SEQ ID NO: 19628
  CDS (1)..(1212)

SEQ ID NO: 54215 - protein, 403 aa, Caenorhabditis elegans; identical to SEQ ID NO: 19629

SEQ ID NO: 54216 - DNA, 1329 bp, Saccharomyces cerevisiae; identical to SEQ ID NO: 19630
  CDS (1)..(1329)

SEQ ID NO: 54217 - protein, 442 aa, Saccharomyces cerevisiae; identical to SEQ ID NO: 19631

SEQ ID NO: 54218 - DNA, 1380 bp, Homo sapiens; identical to SEQ ID NO: 19632
  CDS (1)..(1380)

SEQ ID NO: 54219 - protein, 459 aa, Homo sapiens; identical to SEQ ID NO: 19633

SEQ ID NO: 54220 - DNA, 1380 bp, Mus musculus; identical to SEQ ID NO: 19634
  CDS (1)..(1380)

SEQ ID NO: 54221 - protein, 459 aa, Mus musculus [sequence omitted]

SEQ ID NO: 54222 - DNA, 1302 bp, Mesorhizobium loti MAFF303099; identical to SEQ ID NO: 19636
  CDS (1)..(1302): transl_table=11

SEQ ID NO: 54223 - protein, 433 aa, Mesorhizobium loti MAFF303099; identical to SEQ ID NO: 19637

SEQ ID NO: 54224 - DNA, 1263 bp, Mesorhizobium loti MAFF303099; identical to SEQ ID NO: 19638
  CDS (1)..(1263): transl_table=11

SEQ ID NO: 54225 - protein, 420 aa, Mesorhizobium loti MAFF303099; identical to SEQ ID NO: 19639

SEQ ID NO: 54226 - DNA, 1245 bp, Clostridium acetobutylicum ATCC 824; identical to SEQ ID NO: 19640
  CDS (1)..(1245): transl_table=11

SEQ ID NO: 54227 - protein, 414 aa, Clostridium acetobutylicum ATCC 824; identical to SEQ ID NO: 19641

SEQ ID NO: 54228 - DNA, 1239 bp, Helicobacter pylori 26695; identical to SEQ ID NO: 19642
  CDS (1)..(1239): transl_table=11

SEQ ID NO: 54229 - protein, 412 aa, Helicobacter pylori 26695; identical to SEQ ID NO: 19643

SEQ ID NO: 54230 - DNA, 1248 bp, Aquifex aeolicus VF5; identical to SEQ ID NO: 19644
  CDS (1)..(1248): transl_table=11

SEQ ID NO: 54231 - protein, 415 aa, Aquifex aeolicus VF5; identical to SEQ ID NO: 19645

SEQ ID NO: 54232 - DNA, 1257 bp, Chlamydia trachomatis D/UW-3/CX; identical to SEQ ID NO: 19646
  CDS (1)..(1257): transl_table=11

SEQ ID NO: 54233 - protein, 418 aa, Chlamydia trachomatis D/UW-3/CX; identical to SEQ ID NO: 19647

SEQ ID NO: 54234 - DNA, 1281 bp, Rickettsia prowazekii str. Madrid E; identical to SEQ ID NO: 19648
  CDS (1)..(1281): transl_table=11

SEQ ID NO: 54235 - protein, 426 aa, Rickettsia prowazekii str. Madrid E; identical to SEQ ID NO: 19649

SEQ ID NO: 54236 - DNA, 1239 bp, Helicobacter pylori J99; identical to SEQ ID NO: 19650
  CDS (1)..(1239): transl_table=11

SEQ ID NO: 54237 - protein, 412 aa, Helicobacter pylori J99; identical to SEQ ID NO: 19651

SEQ ID NO: 54238 - DNA, 1239 bp, Thermotoga maritima MSB8; identical to SEQ ID NO: 19652
  CDS (1)..(1239): transl_table=11

SEQ ID NO: 54239 - protein, 412 aa, Thermotoga maritima MSB8; identical to SEQ ID NO: 19653

SEQ ID NO: 54240 - DNA, 1245 bp, Vibrio cholerae O1 biovar eltor str. N16961; identical to SEQ ID NO: 19654
  CDS (1)..(1245): transl_table=11

SEQ ID NO: 54241 - protein, 414 aa, Vibrio cholerae O1 biovar eltor str. N16961; identical to SEQ ID NO: 19655

SEQ ID NO: 54242 - DNA, 1236 bp, Bacillus halodurans C-125; identical to SEQ ID NO: 19656
  CDS (1)..(1236): transl_table=11

SEQ ID NO: 54243 - protein, 411 aa, Bacillus halodurans C-125; identical to SEQ ID NO: 19657

SEQ ID NO: 54244 - DNA, 1221 bp, Pasteurella multocida subsp. multocida str. Pm70; identical to SEQ ID NO: 19658
  CDS (1)..(1221): transl_table=11

SEQ ID NO: 54245 - protein, 406 aa, Pasteurella multocida subsp. multocida str. Pm70; identical to SEQ ID NO: 19659

SEQ ID NO: 54246 - DNA, 1269 bp, Pseudomonas aeruginosa PAO1; identical to SEQ ID NO: 19660
  CDS (1)..(1269): transl_table=11

SEQ ID NO: 54247 - protein, 422 aa, Pseudomonas aeruginosa PAO1; identical to SEQ ID NO: 19661

SEQ ID NO: 54248 - DNA, 1245 bp, Pseudomonas aeruginosa PAO1; identical to SEQ ID NO: 19662
  CDS (1)..(1245): transl_table=11

SEQ ID NO: 54249 - protein, 414 aa, Pseudomonas aeruginosa PAO1; identical to SEQ ID NO: 19663

SEQ ID NO: 54250 - DNA, 1230 bp, Lactococcus lactis subsp. lactis Il1403; identical to SEQ ID NO: 19664
  CDS (1)..(1230): transl_table=11

SEQ ID NO: 54251 - protein, 409 aa, Lactococcus lactis subsp. lactis Il1403; identical to SEQ ID NO: 19665

SEQ ID NO: 54252 - DNA, 1248 bp, Neisseria meningitidis MC58; identical to SEQ ID NO: 19666
  CDS (1)..(1248): transl_table=11

SEQ ID NO: 54253 - protein, 415 aa, Neisseria meningitidis MC58; identical to SEQ ID NO: 19667

SEQ ID NO: 54254 - DNA, 1215 bp, Campylobacter jejuni subsp. jejuni NCTC 11168; identical to SEQ ID NO: 19668
  CDS (1)..(1215): transl_table=11

SEQ ID NO: 54255 - protein, 404 aa, Campylobacter jejuni subsp. jejuni NCTC 11168; identical to SEQ ID NO: 19669

SEQ ID NO: 54256 - DNA, 1248 bp, Neisseria meningitidis Z2491; identical to SEQ ID NO: 19670
  CDS (1)..(1248): transl_table=11

SEQ ID NO: 54257 - protein, 415 aa, Neisseria meningitidis Z2491; identical to SEQ ID NO: 19671

SEQ ID NO: 54258 - DNA, 1287 bp, Deinococcus radiodurans R1; identical to SEQ ID NO: 19672
  CDS (1)..(1287): transl_table=11

SEQ ID NO: 54259 - protein, 428 aa, Deinococcus radiodurans R1; identical to SEQ ID NO: 19673

SEQ ID NO: 54260 - DNA, 1257 bp, Chlamydia muridarum Nigg; identical to SEQ ID NO: 19674
  CDS (1)..(1257): transl_table=11

SEQ ID NO: 54261 - protein, 418 aa, Chlamydia muridarum Nigg; identical to SEQ ID NO: 19675

SEQ ID NO: 54262 - DNA, 1236 bp, Xylella fastidiosa 9a5c; identical to SEQ ID NO: 19676
  CDS (1)..(1236): transl_table=11

SEQ ID NO: 54263 - protein, 411 aa, Xylella fastidiosa 9a5c; identical to SEQ ID NO: 19677

SEQ ID NO: 54264 - DNA, 1236 bp, Streptococcus pneumoniae TIGR4; identical to SEQ ID NO: 19678
  CDS (1)..(1236): transl_table=11

SEQ ID NO: 54265 - protein, 411 aa, Streptococcus pneumoniae TIGR4; identical to SEQ ID NO: 19679

SEQ ID NO: 54266 - DNA, 1236 bp, Clostridium acetobutylicum ATCC 824; identical to SEQ ID NO: 19680
  CDS (1)..(1236): transl_table=11

SEQ ID NO: 54267 - protein, 411 aa, Clostridium acetobutylicum ATCC 824; identical to SEQ ID NO: 19681

SEQ ID NO: 54268 - DNA, 1329 bp, Agrobacterium tumefaciens str. C58; identical to SEQ ID NO: 19682
  CDS (1)..(1329): transl_table=11

SEQ ID NO: 54269 - protein, 442 aa, Agrobacterium tumefaciens str. C58; identical to SEQ ID NO: 19683

SEQ ID NO: 54270 - DNA, 1383 bp, Agrobacterium tumefaciens str. C58; identical to SEQ ID NO: 19684
  CDS (1)..(1383): transl_table=11

SEQ ID NO: 54271 - protein, 460 aa, Agrobacterium tumefaciens str. C58; identical to SEQ ID NO: 19685

SEQ ID NO: 54272 - DNA, 1245 bp, Streptococcus pneumoniae R6; identical to SEQ ID NO: 19686
  CDS (1)..(1245): transl_table=11

SEQ ID NO: 54273 - protein, 414 aa, Streptococcus pneumoniae R6; identical to SEQ ID NO: 19687

SEQ ID NO: 54274 - DNA, 1287 bp, Rickettsia conorii str. Malish 7; identical to SEQ ID NO: 19688
  CDS (1)..(1287): transl_table=11

SEQ ID NO: 54275 - protein, 428 aa, Rickettsia conorii str. Malish 7; identical to SEQ ID NO: 19689

SEQ ID NO: 54276 - DNA, 1245 bp, Staphylococcus aureus subsp. aureus Mu50; identical to SEQ ID NO: 19690
  CDS (1)..(1245): transl_table=11

SEQ ID NO: 54277 - protein, 414 aa, Staphylococcus aureus subsp. aureus Mu50; identical to SEQ ID NO: 19691

SEQ ID NO: 54278 - DNA, 1242 bp, Bacillus subtilis subsp. subtilis str. 168; identical to SEQ ID NO: 19692
  CDS (1)..(1242): transl_table=11

SEQ ID NO: 54279 - protein, 413 aa, Bacillus subtilis subsp. subtilis str. 168; identical to SEQ ID NO: 19693

SEQ ID NO: 54280 - DNA, 1281 bp, Caulobacter crescentus CB15; identical to SEQ ID NO: 19694
  CDS (1)..(1281): transl_table=11

SEQ ID NO: 54281 - protein, 426 aa, Caulobacter crescentus CB15; identical to SEQ ID NO: 19695

SEQ ID NO: 54282 - DNA, 1251 bp, Chlamydophila pneumoniae AR39; identical to SEQ ID NO: 19696
  CDS (1)..(1251): transl_table=11

SEQ ID NO: 54283 - protein, 416 aa, Chlamydophila pneumoniae AR39; identical to SEQ ID NO: 19697

SEQ ID NO: 54284 - DNA, 1242 bp, Listeria monocytogenes EGD-e; identical to SEQ ID NO: 19698
  CDS (1)..(1242): transl_table=11

SEQ ID NO: 54285 - protein, 413 aa, Listeria monocytogenes EGD-e; identical to SEQ ID NO: 19699

SEQ ID NO: 54286 - DNA, 1242 bp, Listeria innocua Clip11262; identical to SEQ ID NO: 19700
  CDS (1)..(1242): transl_table=11

SEQ ID NO: 54287 - protein, 413 aa, Listeria innocua Clip11262; identical to SEQ ID NO: 19701

SEQ ID NO: 54288 - DNA, 1251 bp, Nostoc sp. PCC 7120; identical to SEQ ID NO: 19702
  CDS (1)..(1251): transl_table=11

SEQ ID NO: 54289 - protein, 416 aa, Nostoc sp. PCC 7120; identical to SEQ ID NO: 19703

SEQ ID NO: 54290 - DNA, 1233 bp, Ralstonia solanacearum GMI1000; identical to SEQ ID NO: 19704
  CDS (1)..(1233): transl_table=11

SEQ ID NO: 54291 - protein, 410 aa, Ralstonia solanacearum GMI1000; identical to SEQ ID NO: 19705

SEQ ID NO: 54292 - DNA, 1263 bp, Agrobacterium tumefaciens str. C58; identical to SEQ ID NO: 19706
  CDS (1)..(1263): transl_table=11

SEQ ID NO: 54293 - protein, 420 aa, Agrobacterium tumefaciens str. C58; identical to SEQ ID NO: 19707

SEQ ID NO: 54294 - DNA, 1299 bp, Agrobacterium tumefaciens str. C58; identical to SEQ ID NO: 19708
  CDS (1)..(1299): transl_table=11

SEQ ID NO: 54295 - protein, 432 aa, Agrobacterium tumefaciens str. C58; identical to SEQ ID NO: 19709

SEQ ID NO: 54296 - DNA, 1242 bp, Clostridium perfringens str. 13; identical to SEQ ID NO: 19710
  CDS (1)..(1242): transl_table=11

SEQ ID NO: 54297 - protein, 413 aa, Clostridium perfringens str. 13; identical to SEQ ID NO: 19711

SEQ ID NO: 54298 - DNA, 1281 bp, Schizosaccharomyces pombe 972h-; identical to SEQ ID NO: 19712
  CDS (1)..(1281)

SEQ ID NO: 54299 - protein, 426 aa, Schizosaccharomyces pombe 972h-; identical to SEQ ID NO: 19713

SEQ ID NO: 54300 - DNA, 1242 bp, Fusobacterium nucleatum subsp. nucleatum ATCC 25586; identical to SEQ ID NO: 19714
  CDS (1)..(1242): transl_table=11

SEQ ID NO: 54301 - protein, 413 aa, Fusobacterium nucleatum subsp. nucleatum ATCC 25586; identical to SEQ ID NO: 19715

SEQ ID NO: 54302 - DNA, 1230 bp, Thermoanaerobacter tengcongensis MB4; identical to SEQ ID NO: 19716
  CDS (1)..(1230): transl_table=11

SEQ ID NO: 54303 - protein, 409 aa, Thermoanaerobacter tengcongensis MB4; identical to SEQ ID NO: 19717

SEQ ID NO: 54304 - DNA, 1287 bp, Streptomyces coelicolor A3(2); identical to SEQ ID NO: 19718
  CDS (1)..(1287): transl_table=11

SEQ ID NO: 54305 - protein, 428 aa, Streptomyces coelicolor A3(2); identical to SEQ ID NO: 19719

SEQ ID NO: 54306 - DNA, 1269 bp, Streptomyces coelicolor A3(2); identical to SEQ ID NO: 19720
  CDS (1)..(1269): transl_table=11

SEQ ID NO: 54307 - protein, 422 aa, Streptomyces coelicolor A3(2); identical to SEQ ID NO: 19721

SEQ ID NO: 54308 - DNA, 1290 bp, Streptomyces coelicolor A3(2); identical to SEQ ID NO: 19722
  CDS (1)..(1290): transl_table=11

SEQ ID NO: 54309 - protein, 429 aa, Streptomyces coelicolor A3(2); identical to SEQ ID NO: 19723

SEQ ID NO: 54310 - DNA, 1224 bp, Streptomyces coelicolor A3(2); identical to SEQ ID NO: 19724
  CDS (1)..(1224): transl_table=11

SEQ ID NO: 54311 - protein, 407 aa, Streptomyces coelicolor A3(2); identical to SEQ ID NO: 19725

SEQ ID NO: 54312 - DNA, 1236 bp, Xanthomonas axonopodis pv. citri str. 306; identical to SEQ ID NO: 19726
  CDS (1)..(1236): transl_table=11

SEQ ID NO: 54313 - protein, 411 aa, Xanthomonas axonopodis pv. citri str. 306; identical to SEQ ID NO: 19727

SEQ ID NO: 54314 - DNA, 1317 bp, Drosophila melanogaster; identical to SEQ ID NO: 19728
  CDS (1)..(1317)

SEQ ID NO: 54315 - protein, 438 aa, Drosophila melanogaster; identical to SEQ ID NO: 19729

SEQ ID NO: 54316 - DNA, 1242 bp, Chlorobium tepidum TLS; identical to SEQ ID NO: 19730
  CDS (1)..(1242): transl_table=11

SEQ ID NO: 54317 - protein, 413 aa, Chlorobium tepidum TLS; identical to SEQ ID NO: 19731

SEQ ID NO: 54318 - DNA, 1029 bp, Yersinia pestis KIM; identical to SEQ ID NO: 19732
  CDS (1)..(1029): transl_table=11

SEQ ID NO: 54319 - protein, 342 aa, Yersinia pestis KIM; identical to SEQ ID NO: 19733

SEQ ID NO: 54320 - DNA, 1263 bp, Thermosynechococcus elongatus BP-1; identical to SEQ ID NO: 19734
  CDS (1)..(1263): transl_table=11

SEQ ID NO: 54321 - protein, 420 aa, Thermosynechococcus elongatus BP-1; identical to SEQ ID NO: 19735

SEQ ID NO: 54322 - DNA, 1233 bp, Streptococcus agalactiae 2603V/R; identical to SEQ ID NO: 19736
  CDS (1)..(1233): transl_table=11

SEQ ID NO: 54323 - protein, 410 aa, Streptococcus agalactiae 2603V/R; identical to SEQ ID NO: 19737

SEQ ID NO: 54324 - DNA, 1239 bp, Oceanobacillus iheyensis HTE831; identical to SEQ ID NO: 19738
  CDS (1)..(1239): transl_table=11

SEQ ID NO: 54325 - protein, 412 aa, Oceanobacillus iheyensis HTE831; identical to SEQ ID NO: 19739

SEQ ID NO: 54326 - DNA, 1263 bp, Brucella suis 1330; identical to SEQ ID NO: 19740
  CDS (1)..(1263): transl_table=11

SEQ ID NO: 54327 - protein, 420 aa, Brucella suis 1330; identical to SEQ ID NO: 19741

SEQ ID NO: 54328 - DNA, 1425 bp, Plasmodium falciparum 3D7; identical to SEQ ID NO: 19742
  CDS (1)..(1425)

SEQ ID NO: 54329 - protein, 474 aa, Plasmodium falciparum 3D7; identical to SEQ ID NO: 19743

SEQ ID NO: 54330 - DNA, 1239 bp, Shewanella oneidensis MR-1; identical to SEQ ID NO: 19744
  CDS (1)..(1239): transl_table=11

SEQ ID NO: 54331 - protein, 412 aa, Shewanella oneidensis MR-1; identical to SEQ ID NO: 19745

SEQ ID NO: 54332 - DNA, 1233 bp, Streptococcus mutans UA159; identical to SEQ ID NO: 19746
  CDS (1)..(1233): transl_table=11

SEQ ID NO: 54333 - protein, 410 aa, Streptococcus mutans UA159; identical to SEQ ID NO: 19747

SEQ ID NO: 54334 - DNA, 1245 bp, Pseudomonas putida KT2440; identical to SEQ ID NO: 19748
  CDS (1)..(1245): transl_table=11

SEQ ID NO: 54335 - protein, 414 aa, Pseudomonas putida KT2440; identical to SEQ ID NO: 19749

SEQ ID NO: 54336 - DNA, 1314 bp, Pseudomonas putida KT2440; identical to SEQ ID NO: 19750
  CDS (1)..(1314): transl_table=11

SEQ ID NO: 54337 - protein, 437 aa, Pseudomonas putida KT2440; identical to SEQ ID NO: 19751

SEQ ID NO: 54338 - DNA, 1263 bp, Vibrio vulnificus CMCP6; identical to SEQ ID NO: 19752
  CDS (1)..(1263): transl_table=11

SEQ ID NO: 54339 - protein, 420 aa, Vibrio vulnificus CMCP6; identical to SEQ ID NO: 19753

SEQ ID NO: 54340 - DNA, 1263 bp, Bradyrhizobium japonicum USDA 110; identical to SEQ ID NO: 19754
  CDS (1)..(1263): transl_table=11

SEQ ID NO: 54341 - protein, 420 aa, Bradyrhizobium japonicum USDA 110; identical to SEQ ID NO: 19755

SEQ ID NO: 54342 - DNA, 1266 bp, Bradyrhizobium japonicum USDA 110; identical to SEQ ID NO: 19756
  CDS (1)..(1266): transl_table=11

SEQ ID NO: 54343 - protein, 421 aa, Bradyrhizobium japonicum USDA 110; identical to SEQ ID NO: 19757

SEQ ID NO: 54344 - DNA, 1236 bp, Xylella fastidiosa Temecula1; identical to SEQ ID NO: 19758
  CDS (1)..(1236): transl_table=11

SEQ ID NO: 54345 - protein, 411 aa, Xylella fastidiosa Temecula1; identical to SEQ ID NO: 19759

SEQ ID NO: 54346 - DNA, 1245 bp, Clostridium tetani E88; identical to SEQ ID NO: 19760
  CDS (1)..(1245): transl_table=11

SEQ ID NO: 54347 - protein, 414 aa, Clostridium tetani E88; identical to SEQ ID NO: 19761

SEQ ID NO: 54348 - DNA, 1233 bp, Lactobacillus plantarum WCFS1; identical to SEQ ID NO: 19762
  CDS (1)..(1233): transl_table=11

SEQ ID NO: 54349 - protein, 410 aa, Lactobacillus plantarum WCFS1; identical to SEQ ID NO: 19763

SEQ ID NO: 54350 - DNA, 1245 bp, Pseudomonas syringae pv. tomato str. DC3000; identical to SEQ ID NO: 19764
  CDS (1)..(1245): transl_table=11

SEQ ID NO: 54351 - protein, 414 aa, Pseudomonas syringae pv. tomato str. DC3000; identical to SEQ ID NO: 19765

SEQ ID NO: 54352 - DNA, 1251 bp, Vibrio parahaemolyticus RIMD 2210633; identical to SEQ ID NO: 19766
  CDS (1)..(1251): transl_table=11

SEQ ID NO: 54353 - protein, 416 aa, Vibrio parahaemolyticus RIMD 2210633; identical to SEQ ID NO: 19767

SEQ ID NO: 54354 - DNA, 1212 bp, Vibrio parahaemolyticus RIMD 2210633; identical to SEQ ID NO: 19768
  CDS (1)..(1212): transl_table=11

SEQ ID NO: 54355 - protein, 403 aa, Vibrio parahaemolyticus RIMD 2210633; identical to SEQ ID NO: 19769

SEQ ID NO: 54356 - DNA, 1233 bp, Streptococcus pyogenes SSI-1; identical to SEQ ID NO: 19770
  CDS (1)..(1233): transl_table=11

SEQ ID NO: 54357 - protein, 410 aa, Streptococcus pyogenes SSI-1; identical to SEQ ID NO: 19771

SEQ ID NO: 54358 - DNA, 1242 bp, Salmonella enterica subsp. enterica serovar Typhi Ty2; identical to SEQ ID NO: 19772
  CDS (1)..(1242): transl_table=11

SEQ ID NO: 54359 - protein, 413 aa, Salmonella enterica subsp. enterica serovar Typhi Ty2; identical to SEQ ID NO: 19773

SEQ ID NO: 54360 - DNA, 1263 bp, Bacteroides thetaiotaomicron VPI-5482; identical to SEQ ID NO: 19774
  CDS (1)..(1263): transl_table=11

SEQ ID NO: 54361 - protein, 420 aa, Bacteroides thetaiotaomicron VPI-5482; identical to SEQ ID NO: 19775

SEQ ID NO: 54362 - DNA, 1239 bp, Enterococcus faecalis V583; identical to SEQ ID NO: 19776
  CDS (1)..(1239): transl_table=11

SEQ ID NO: 54363 - protein, 412 aa, Enterococcus faecalis V583; identical to SEQ ID NO: 19777

SEQ ID NO: 54364 - DNA, 1236 bp, Enterococcus faecalis V583; identical to SEQ ID NO: 19778
  CDS (1)..(1236): transl_table=11

SEQ ID NO: 54365 - protein, 411 aa, Enterococcus faecalis V583; identical to SEQ ID NO: 19779

SEQ ID NO: 54366 - DNA, 1245 bp, Coxiella burnetii RSA 493; identical to SEQ ID NO: 19780
  CDS (1)..(1245): transl_table=11

SEQ ID NO: 54367 - protein, 414 aa, Coxiella burnetii RSA 493; identical to SEQ ID NO: 19781

SEQ ID NO: 54368 - DNA, 1221 bp, Streptomyces avermitilis MA-4680; identical to SEQ ID NO: 19782
  CDS (1)..(1221): transl_table=11

SEQ ID NO: 54369 - protein, 406 aa, Streptomyces avermitilis MA-4680; identical to SEQ ID NO: 19783

SEQ ID NO: 54370 - DNA, 1251 bp, Streptomyces avermitilis MA-4680; identical to SEQ ID NO: 19784
  CDS (1)..(1251): transl_table=11

SEQ ID NO: 54371 - protein, 416 aa, Streptomyces avermitilis MA-4680; identical to SEQ ID NO: 19785

SEQ ID NO: 54372 - DNA, 1272 bp, Streptomyces avermitilis MA-4680; identical to SEQ ID NO: 19786
  CDS (1)..(1272): transl_table=11

SEQ ID NO: 54373 - protein, 423 aa, Streptomyces avermitilis MA-4680; identical to SEQ ID NO: 19787

SEQ ID NO: 54374 - DNA, 1251 bp, Chlamydophila caviae GPIC; identical to SEQ ID NO: 19788
  CDS (1)..(1251): transl_table=11

SEQ ID NO: 54375 - protein, 416 aa, Chlamydophila caviae GPIC; identical to SEQ ID NO: 19789

SEQ ID NO: 54376 - DNA, 1239 bp, Bacillus cereus ATCC 14579; identical to SEQ ID NO: 19790
  CDS (1)..(1239): transl_table=11

SEQ ID NO: 54377 - protein, 412 aa, Bacillus cereus ATCC 14579; identical to SEQ ID NO: 19791

SEQ ID NO: 54378 - DNA, 1242 bp, Nitrosomonas europaea ATCC 19718; identical to SEQ ID NO: 19792
  CDS (1)..(1242): transl_table=11

SEQ ID NO: 54379 - protein, 413 aa, Nitrosomonas europaea ATCC 19718; identical to SEQ ID NO: 19793

SEQ ID NO: 54380 - DNA, 1626 bp, Arabidopsis thaliana; identical to SEQ ID NO: 19794
  CDS (1)..(1626)

SEQ ID NO: 54381 - protein, 541 aa, Arabidopsis thaliana; identical to SEQ ID NO: 19795

SEQ ID NO: 54382 - DNA, 1266 bp, Streptomyces rochei; identical to SEQ ID NO: 19796
  CDS (1)..(1266): transl_table=11

SEQ ID NO: 54383 - protein, 421 aa, Streptomyces rochei; identical to SEQ ID NO: 19797

SEQ ID NO: 54384 - DNA, 1236 bp, Helicobacter hepaticus ATCC 51449; identical to SEQ ID NO: 19798
  CDS (1)..(1236): transl_table=11

SEQ ID NO: 54385 - protein, 411 aa, Helicobacter hepaticus ATCC 51449; identical to SEQ ID NO: 19799

SEQ ID NO: 54386 - DNA, 1290 bp, Rhodopirellula baltica SH 1; identical to SEQ ID NO: 19800
  CDS (1)..(1290): transl_table=11

SEQ ID NO: 54387 - protein, 429 aa, Rhodopirellula baltica SH 1; identical to SEQ ID NO: 19801

SEQ ID NO: 54388 - DNA, 1290 bp, Rhodopirellula baltica SH 1; identical to SEQ ID NO: 19802
  CDS (1)..(1290): transl_table=11

SEQ ID NO: 54389 - protein, 429 aa, Rhodopirellula baltica SH 1; identical to SEQ ID NO: 19803

SEQ ID NO: 54390 - DNA, 1248 bp, Prochlorococcus marinus subsp. marinus str. CCMP1375; identical to SEQ ID NO: 19804
  CDS (1)..(1248): transl_table=11

SEQ ID NO: 54391 - protein, 415 aa, Prochlorococcus marinus subsp. marinus str. CCMP1375; identical to SEQ ID NO: 19805

SEQ ID NO: 54392 - DNA, 1230 bp, Bordetella bronchiseptica RB50; identical to SEQ ID NO: 19806
  CDS (1)..(1230): transl_table=11

SEQ ID NO: 54393 - protein, 409 aa, Bordetella bronchiseptica RB50; identical to SEQ ID NO: 19807

SEQ ID NO: 54394 - DNA, 1245 bp, Prochlorococcus marinus subsp. pastoris str. CCMP1986; identical to SEQ ID NO: 19808
  CDS (1)..(1245): transl_table=11

SEQ ID NO: 54395 - protein, 414 aa, Prochlorococcus marinus subsp. pastoris str. CCMP1986; identical to SEQ ID NO: 19809

SEQ ID NO: 54396 - DNA, 1248 bp, Prochlorococcus marinus str. MIT 9313; identical to SEQ ID NO: 19810
  CDS (1)..(1248): transl_table=11

SEQ ID NO: 54397 - protein, 415 aa, Prochlorococcus marinus str. MIT 9313; identical to SEQ ID NO: 19811

SEQ ID NO: 54398 - DNA, 1248 bp, Synechococcus sp. WH 8102; identical to SEQ ID NO: 19812
  CDS (1)..(1248): transl_table=11

SEQ ID NO: 54399 - protein, 415 aa, Synechococcus sp. WH 8102; identical to SEQ ID NO: 19813

SEQ ID NO: 54400 - DNA, 1242 bp, Chromobacterium violaceum ATCC 12472; identical to SEQ ID NO: 19814
  CDS (1)..(1242): transl_table=11

SEQ ID NO: 54401 - protein, 413 aa, Chromobacterium violaceum ATCC 12472; identical to SEQ ID NO: 19815

SEQ ID NO: 54402 - DNA, 1257 bp, Porphyromonas gingivalis W83; identical to SEQ ID NO: 19816
  CDS (1)..(1257): transl_table=11

SEQ ID NO: 54403 - protein, 418 aa, Porphyromonas gingivalis W83; identical to SEQ ID NO: 19817

SEQ ID NO: 54404 - DNA, 1242 bp, Wolinella succinogenes DSM 1740; identical to SEQ ID NO: 19818
  CDS (1)..(1242): transl_table=11

SEQ ID NO: 54405 - protein, 413 aa, Wolinella succinogenes DSM 1740; identical to SEQ ID NO: 19819

SEQ ID NO: 54406 - DNA, 1272 bp, Gloeobacter violaceus PCC 7421; identical to SEQ ID NO: 19820
  CDS (1)..(1272): transl_table=11

SEQ ID NO: 54407 - protein, 423 aa, Gloeobacter violaceus PCC 7421; identical to SEQ ID NO: 19821

SEQ ID NO: 54408 - DNA, 1248 bp, Gloeobacter violaceus PCC 7421; identical to SEQ ID NO: 19822
  CDS (1)..(1248): transl_table=11

SEQ ID NO: 54409 - protein, 415 aa, Gloeobacter violaceus PCC 7421; identical to SEQ ID NO: 19823

SEQ ID NO: 54410 - DNA, 1251 bp, Photorhabdus luminescens subsp. laumondii TTO1; identical to SEQ ID NO: 19824
  CDS (1)..(1251): transl_table=11

SEQ ID NO: 54411 - protein, 416 aa, Photorhabdus luminescens subsp. laumondii TTO1; identical to SEQ ID NO: 19825

SEQ ID NO: 54412 - DNA, 1242 bp, Vibrio vulnificus YJ016; identical to SEQ ID NO: 19826
  CDS (1)..(1242): transl_table=11

SEQ ID NO: 54413 - protein, 413 aa, Vibrio vulnificus YJ016; identical to SEQ ID NO: 19827

SEQ ID NO: 54414 - DNA, 1266 bp, Rhodopseudomonas palustris CGA009; identical to SEQ ID NO: 19828
  CDS (1)..(1266): transl_table=11

SEQ ID NO: 54415 - protein, 421 aa, Rhodopseudomonas palustris CGA009; identical to SEQ ID NO: 19829

SEQ ID NO: 54416 - DNA, 1233 bp, Geobacter sulfurreducens PCA; identical to SEQ ID NO: 19830
  CDS (1)..(1233): transl_table=11

SEQ ID NO: 54417 - protein, 410 aa, Geobacter sulfurreducens PCA; identical to SEQ ID NO: 19831

SEQ ID NO: 54418 - DNA, 1251 bp, Mycobacterium avium subsp. paratuberculosis K-10; identical to SEQ ID NO: 19832
  CDS (1)..(1251): transl_table=11

SEQ ID NO: 54419 - protein, 416 aa, Mycobacterium avium subsp. paratuberculosis K-10; identical to SEQ ID NO: 19833

SEQ ID NO: 54420 - DNA, 1272 bp, Wolbachia endosymbiont of Drosophila melanogaster; identical to SEQ ID NO: 19834
  CDS (1)..(1272): transl_table=11

SEQ ID NO: 54421 - protein, 423 aa, Wolbachia endosymbiont of Drosophila melanogaster; identical to SEQ ID NO: 19835

SEQ ID NO: 54422 - DNA, 1272 bp, Bdellovibrio bacteriovorus HD100; identical to SEQ ID NO: 19836
  CDS (1)..(1272): transl_table=11

SEQ ID NO: 54423 - protein, 423 aa, Bdellovibrio bacteriovorus HD100; identical to SEQ ID NO: 19837

SEQ ID NO: 54424 - DNA, 1236 bp, Treponema denticola ATCC 35405; identical to SEQ ID NO: 19838
  CDS (1)..(1236): transl_table=11

SEQ ID NO: 54425 - protein, 411 aa, Treponema denticola ATCC 35405; identical to SEQ ID NO: 19839

SEQ ID NO: 54426 - DNA, 1239 bp, Bacillus cereus ATCC 10987; identical to SEQ ID NO: 19840
  CDS (1)..(1239): transl_table=11

SEQ ID NO: 54427 - protein, 412 aa, Bacillus cereus ATCC 10987; identical to SEQ ID NO: 19841

SEQ ID NO: 54428 - DNA, 1302 bp, Eremothecium gossypii; identical to SEQ ID NO: 19842
  CDS (1)..(1302)

SEQ ID NO: 54429 - protein, 433 aa, Eremothecium gossypii; identical to SEQ ID NO: 19843

SEQ ID NO: 54430 - DNA, 1335 bp, Anopheles gambiae str. PEST; identical to SEQ ID NO: 19844
  CDS (1)..(1335)

SEQ ID NO: 54431 - protein, 444 aa, Anopheles gambiae str. PEST; identical to SEQ ID NO: 19845

SEQ ID NO: 54432 - DNA, 1524 bp, Oryza sativa (japonica cultivar-group); identical to SEQ ID NO: 19846
  CDS (1)..(1524)

SEQ ID NO: 54433 - protein, 507 aa, Oryza sativa (japonica cultivar-group); identical to SEQ ID NO: 19847

SEQ ID NO: 54434 - DNA, 1245 bp, Anopheles gambiae str. PEST; identical to SEQ ID NO: 19848
  CDS (1)..(1245)

SEQ ID NO: 54435 - protein, 414 aa, Anopheles gambiae str. PEST; identical to SEQ ID NO: 19849

SEQ ID NO: 54436 - DNA, 1227 bp, Thermus thermophilus HB27; identical to SEQ ID NO: 19850
  CDS (1)..(1227): transl_table=11

SEQ ID NO: 54437 - protein, 408 aa, Thermus thermophilus HB27; identical to SEQ ID NO: 19851

SEQ ID NO: 54438 - DNA, 1257 bp, Parachlamydia sp. UWE25; identical to SEQ ID NO: 19852
  CDS (1)..(1257): transl_table=11

SEQ ID NO: 54439 - protein, 418 aa, Parachlamydia sp. UWE25; identical to SEQ ID NO: 19853

SEQ ID NO: 54440 - DNA, 1248 bp, Desulfovibrio vulgaris subsp. vulgaris str. Hildenborough; identical to SEQ ID NO: 19854
  CDS (1)..(1248): transl_table=11

SEQ ID NO: 54441 - protein, 415 aa, Desulfovibrio vulgaris subsp. vulgaris str. Hildenborough; identical to SEQ ID NO: 19855

SEQ ID NO: 54442 - DNA, 1242 bp, Listeria monocytogenes str. 4b F2365; identical to SEQ ID NO: 19856
  CDS (1)..(1242): transl_table=11

SEQ ID NO: 54443 - protein, 413 aa, Listeria monocytogenes str. 4b F2365; identical to SEQ ID NO: 19857

SEQ ID NO: 54444 - DNA, 1239 bp, Bacillus anthracis str. Sterne; identical to SEQ ID NO: 19858
  CDS (1)..(1239): transl_table=11

SEQ ID NO: 54445 - protein, 412 aa, Bacillus anthracis str. Sterne; identical to SEQ ID NO: 19859

SEQ ID NO: 54446 - DNA, 1263 bp, Bartonella quintana str. Toulouse; identical to SEQ ID NO: 19860
  CDS (1)..(1263): transl_table=11

SEQ ID NO: 54447 - protein, 420 aa, Bartonella quintana str. Toulouse; identical to SEQ ID NO: 19861

SEQ ID NO: 54448 - DNA, 1263 bp, Bartonella henselae str. Houston-1; identical to SEQ ID NO: 19862
  CDS (1)..(1263): transl_table=11

SEQ ID NO: 54449 - protein, 420 aa, Bartonella henselae str. Houston-1; identical to SEQ ID NO: 19863

SEQ ID NO: 54450 - DNA, 1245 bp, Staphylococcus aureus subsp. aureus MRSA252; identical to SEQ ID NO: 19864
  CDS (1)..(1245): transl_table=11

SEQ ID NO: 54451 - protein, 414 aa, Staphylococcus aureus subsp. aureus MRSA252; identical to SEQ ID NO: 19865

SEQ ID NO: 54452 - DNA, 1245 bp, Staphylococcus aureus subsp. aureus MSSA476; identical to SEQ ID NO: 19866
  CDS (1)..(1245): transl_table=11

SEQ ID NO: 54453 - protein, 414 aa, Staphylococcus aureus subsp. aureus MSSA476; identical to SEQ ID NO: 19867

SEQ ID NO: 54454 - DNA, 1242 bp, Erwinia carotovora subsp. atroseptica SCRI1043; identical to SEQ ID NO: 19868
  CDS (1)..(1242): transl_table=11

SEQ ID NO: 54455 - protein, 413 aa, Erwinia carotovora subsp. atroseptica SCRI1043; identical to SEQ ID NO: 19869

SEQ ID NO: 54456 - DNA, 1290 bp, Erwinia carotovora subsp. atroseptica SCRI1043; identical to SEQ ID NO: 19870
  CDS (1)..(1290): transl_table=11

SEQ ID NO: 54457 - protein, 429 aa, Erwinia carotovora subsp. atroseptica SCRI1043; identical to SEQ ID NO: 19871

SEQ ID NO: 54458 - DNA, 1272 bp, Propionibacterium acnes KPA171202; identical to SEQ ID NO: 19872
  CDS (1)..(1272): transl_table=11

SEQ ID NO: 54459 - protein, 423 aa, Propionibacterium acnes KPA171202; identical to SEQ ID NO: 19873

SEQ ID NO: 54460 - DNA, 1233 bp, Streptococcus pyogenes MGAS10394; identical to SEQ ID NO: 19874
  CDS (1)..(1233): transl_table=11

SEQ ID NO: 54461 - protein, 410 aa, Streptococcus pyogenes MGAS10394; identical to SEQ ID NO: 19875

SEQ ID NO: 54462 - DNA, 1263 bp, Leifsonia xyli subsp. xyli str. CTCB07; identical to SEQ ID NO: 19876
  CDS (1)..(1263): transl_table=11

SEQ ID NO: 54463 - protein, 420 aa, Leifsonia xyli subsp. xyli str. CTCB07; identical to SEQ ID NO: 19877

SEQ ID NO: 54464 - DNA, 1245 bp, Desulfotalea psychrophila LSv54; identical to SEQ ID NO: 19878
  CDS (1)..(1245): transl_table=11

SEQ ID NO: 54465 - protein, 414 aa, Desulfotalea psychrophila LSv54; identical to SEQ ID NO: 19879

SEQ ID NO: 54466 - DNA, 1281 bp, Rickettsia typhi str. Wilmington; identical to SEQ ID NO: 19880
  CDS (1)..(1281): transl_table=11

SEQ ID NO: 54467 - protein, 426 aa, Rickettsia typhi str. Wilmington; identical to SEQ ID NO: 19881

SEQ ID NO: 54468 - DNA, 1275 bp, Yersinia pseudotuberculosis IP 32953; identical to SEQ ID NO: 19882
  CDS (1)..(1275): transl_table=11

SEQ ID NO: 54469 - protein, 424 aa, Yersinia pseudotuberculosis IP 32953; identical to SEQ ID NO: 19883

SEQ ID NO: 54470 - DNA, 1242 bp, Yersinia pseudotuberculosis IP 32953; identical to SEQ ID NO: 19884
  CDS (1)..(1242): transl_table=11

SEQ ID NO: 54471 - protein, 413 aa, Yersinia pseudotuberculosis IP 32953; identical to SEQ ID NO: 19885

SEQ ID NO: 54472 - DNA, 1242 bp, Symbiobacterium thermophilum IAM 14863; identical to SEQ ID NO: 19886
  CDS (1)..(1242): transl_table=11

SEQ ID NO: 54473 - protein, 413 aa, Symbiobacterium thermophilum IAM 14863; identical to SEQ ID NO: 19887

SEQ ID NO: 54474 - DNA, 1239 bp, Bacillus licheniformis ATCC 14580; identical to SEQ ID NO: 19888
  CDS (1)..(1239): transl_table=11

SEQ ID NO: 54475 - protein, 412 aa, Bacillus licheniformis ATCC 14580; identical to SEQ ID NO: 19889

SEQ ID NO: 54476 - DNA, 1221 bp, Mannheimia succiniciproducens MBEL55E; identical to SEQ ID NO: 19890
  CDS (1)..(1221): transl_table=11

SEQ ID NO: 54477 - protein, 406 aa, Mannheimia succiniciproducens MBEL55E; identical to SEQ ID NO: 19891

SEQ ID NO: 54478 - DNA, 1230 bp, Legionella pneumophila subsp. pneumophila str. Philadelphia 1; identical to SEQ ID NO: 19892
  CDS (1)..(1230): transl_table=11

SEQ ID NO: 54479 - protein, 409 aa, Legionella pneumophila subsp. pneumophila str. Philadelphia 1; identical to SEQ ID NO: 19893

SEQ ID NO: 54480 - DNA, 1293 bp, Legionella pneumophila subsp. pneumophila str. Philadelphia 1; identical to SEQ ID NO: 19894
  CDS (1)..(1293): transl_table=11

SEQ ID NO: 54481 - protein, 430 aa, Legionella pneumophila subsp. pneumophila str. Philadelphia 1; identical to SEQ ID NO: 19895

SEQ ID NO: 54482 - DNA, 1239 bp, Legionella pneumophila subsp. pneumophila str. Philadelphia 1; identical to SEQ ID NO: 19896
  CDS (1)..(1239): transl_table=11

SEQ ID NO: 54483 - protein, 412 aa, Legionella pneumophila subsp. pneumophila str. Philadelphia 1; identical to SEQ ID NO: 19897

SEQ ID NO: 54484 - DNA, 1263 bp, Bacteroides fragilis YCH46; identical to SEQ ID NO: 19898
  CDS (1)..(1263): transl_table=11

SEQ ID NO: 54485 - protein, 420 aa, Bacteroides fragilis YCH46; identical to SEQ ID NO: 19899

SEQ ID NO: 54486 - DNA, 1239 bp, Burkholderia mallei ATCC 23344; identical to SEQ ID NO: 19900
  CDS (1)..(1239): transl_table=11

SEQ ID NO: 54487 - protein, 412 aa, Burkholderia mallei ATCC 23344; identical to SEQ ID NO: 19901

SEQ ID NO: 54488 - DNA, 1206 bp, Methylococcus capsulatus str. Bath; identical to SEQ ID NO: 19902
  CDS (1)..(1206): transl_table=11

SEQ ID NO: 54489 - protein, 401 aa, Methylococcus capsulatus str. Bath; identical to SEQ ID NO: 19903

SEQ ID NO: 54490 - DNA, 1251 bp, Nocardia farcinica IFM 10152; identical to SEQ ID NO: 19904
  CDS (1)..(1251): transl_table=11

SEQ ID NO: 54491 - protein, 416 aa, Nocardia farcinica IFM 10152; identical to SEQ ID NO: 19905

SEQ ID NO: 54492 - DNA, 1230 bp, Legionella pneumophila str. Paris; identical to SEQ ID NO: 19906
  CDS (1)..(1230): transl_table=11

SEQ ID NO: 54493 - protein, 409 aa, Legionella pneumophila str. Paris; identical to SEQ ID NO: 19907

SEQ ID NO: 54494 - DNA, 1293 bp, Legionella pneumophila str. Paris; identical to SEQ ID NO: 19908
  CDS (1)..(1293): transl_table=11

SEQ ID NO: 54495 - protein, 430 aa, Legionella pneumophila str. Paris; identical to SEQ ID NO: 19909

SEQ ID NO: 54496 - DNA, 1239 bp, Legionella pneumophila str. Paris; identical to SEQ ID NO: 19910
  CDS (1)..(1239): transl_table=11

SEQ ID NO: 54497 - protein, 412 aa, Legionella pneumophila str. Paris; identical to SEQ ID NO: 19911

SEQ ID NO: 54498 - DNA, 1239 bp, Legionella pneumophila str. Lens; identical to SEQ ID NO: 19912
  CDS (1)..(1239): transl_table=11

SEQ ID NO: 54499 - protein, 412 aa, Legionella pneumophila str. Lens; identical to SEQ ID NO: 19913

SEQ ID NO: 54500 - DNA, 1242 bp, Photobacterium profundum SS9; identical to SEQ ID NO: 19914
  CDS (1)..(1242): transl_table=11

SEQ ID NO: 54501 - protein, 413 aa, Photobacterium profundum SS9; identical to SEQ ID NO: 19915

SEQ ID NO: 54502 - DNA, 1233 bp, Streptococcus thermophilus LMG 18311; identical to SEQ ID NO: 19916
  CDS (1)..(1233): transl_table=11

SEQ ID NO: 54503 - protein, 410 aa, Streptococcus thermophilus LMG 18311; identical to SEQ ID NO: 19917

SEQ ID NO: 54504 - DNA, 1227 bp, Thermus thermophilus HB8; identical to SEQ ID NO: 19918
  CDS (1)..(1227): transl_table=11

SEQ ID NO: 54505 - protein, 408 aa, Thermus thermophilus HB8; identical to SEQ ID NO: 19919

SEQ ID NO: 54506 - DNA, 1239 bp, Geobacillus kaustophilus HTA426; identical to SEQ ID NO: 19920
  CDS (1)..(1239): transl_table=11

SEQ ID NO: 54507 - protein, 412 aa, Geobacillus kaustophilus HTA426; identical to SEQ ID NO: 19921

SEQ ID NO: 54508 - DNA, 1242 bp, Salmonella enterica subsp. enterica serovar Paratyphi A str. ATCC; identical to SEQ ID NO: 19922
  CDS (1)..(1242): transl_table=11

SEQ ID NO: 54509 - protein, 413 aa, Salmonella enterica subsp. enterica serovar Paratyphi A str. ATCC; identical to SEQ ID NO: 19923

SEQ ID NO: 54510 - DNA, 1284 bp, Anaplasma marginale str. St. Maries; identical to SEQ ID NO: 19924
  CDS (1)..(1284): transl_table=11

SEQ ID NO: 54511 - protein, 427 aa, Anaplasma marginale str. St. Maries; identical to SEQ ID NO: 19925

SEQ ID NO: 54512 - DNA, 1239 bp, Azoarcus sp. EbN1; identical to SEQ ID NO: 19926
  CDS (1)..(1239): transl_table=11

SEQ ID NO: 54513 - protein, 412 aa, Azoarcus sp. EbN1; identical to SEQ ID NO: 19927

SEQ ID NO: 54514 - DNA, 1299 bp, Zymomonas mobilis subsp. mobilis ZM4; identical to SEQ ID NO: 19928
  CDS (1)..(1299): transl_table=11

SEQ ID NO: 54515 - protein, 432 aa, Zymomonas mobilis subsp. mobilis ZM4; identical to SEQ ID NO: 19929

SEQ ID NO: 54516 - DNA, 1209 bp, Silicibacter pomeroyi DSS-3; identical to SEQ ID NO: 19930
  CDS (1)..(1209): transl_table=11

SEQ ID NO: 54517 - protein, 402 aa, Silicibacter pomeroyi DSS-3; identical to SEQ ID NO: 19931

SEQ ID NO: 54518 - DNA, 1266 bp, Silicibacter pomeroyi DSS-3; identical to SEQ ID NO: 19932
  CDS (1)..(1266): transl_table=11

SEQ ID NO: 54519 - protein, 421 aa, Silicibacter pomeroyi DSS-3; identical to SEQ ID NO: 19933

SEQ ID NO: 54520 - DNA, 1260 bp, Francisella tularensis subsp. tularensis SCHU S4; identical to SEQ ID NO: 19934
  CDS (1)..(1260): transl_table=11

SEQ ID NO: 54521 - protein, 419 aa, Francisella tularensis subsp. tularensis SCHU S4; identical to SEQ ID NO: 19935

SEQ ID NO: 54522 - DNA, 1254 bp, Synechococcus elongatus PCC 6301; identical to SEQ ID NO: 19936
  CDS (1)..(1254): transl_table=11

SEQ ID NO: 54523 - protein, 417 aa, Synechococcus elongatus PCC 6301; identical to SEQ ID NO: 19937

SEQ ID NO: 54524 - DNA, 1242 bp, Bacillus clausii KSM-K16; identical to SEQ ID NO: 19938
  CDS (1)..(1242): transl_table=11

SEQ ID NO: 54525 - protein, 413 aa, Bacillus clausii KSM-K16; identical to SEQ ID NO: 19939

SEQ ID NO: 54526 - DNA, 1215 bp, Campylobacter jejuni RM1221; identical to SEQ ID NO: 19940
  CDS (1)..(1215): transl_table=11

SEQ ID NO: 54527 - protein, 404 aa, Campylobacter jejuni RM1221; identical to SEQ ID NO: 19941

SEQ ID NO: 54528 - DNA, 1272 bp, Ehrlichia ruminantium str. Welgevonden; identical to SEQ ID NO: 19942
  CDS (1)..(1272): transl_table=11

SEQ ID NO: 54529 - protein, 423 aa, Ehrlichia ruminantium str. Welgevonden; identical to SEQ ID NO: 19943

SEQ ID NO: 54530 - DNA, 1269 bp, Dehalococcoides ethenogenes 195; identical to SEQ ID NO: 19944
  CDS (1)..(1269): transl_table=11

SEQ ID NO: 54531 - protein, 422 aa, Dehalococcoides ethenogenes 195; identical to SEQ ID NO: 19945

SEQ ID NO: 54532 - DNA, 1245 bp, Staphylococcus epidermidis RP62A; identical to SEQ ID NO: 19946
  CDS (1)..(1245): transl_table=11

SEQ ID NO: 54533 - protein, 414 aa, Staphylococcus epidermidis RP62A; identical to SEQ ID NO: 19947

SEQ ID NO: 54534 - DNA, 1287 bp, Gluconobacter oxydans 621H; identical to SEQ ID NO: 19948
  CDS (1)..(1287): transl_table=11

SEQ ID NO: 54535 - protein, 428 aa, Gluconobacter oxydans 621H; identical to SEQ ID NO: 19949

SEQ ID NO: 54536 - DNA, 1272 bp, Ehrlichia ruminantium str. Gardel; identical to SEQ ID NO: 19950
  CDS (1)..(1272): transl_table=11

SEQ ID NO: 54537 - protein, 423 aa, Ehrlichia ruminantium str. Gardel; identical to SEQ ID NO: 19951

SEQ ID NO: 54538 - DNA, 1269 bp, Wolbachia endosymbiont strain TRS of Brugia malayi; identical to SEQ ID NO: 19952
  CDS (1)..(1269): transl_table=11

SEQ ID NO: 54539 - protein, 422 aa, Wolbachia endosymbiont strain TRS of Brugia malayi; identical to SEQ ID NO: 19953

SEQ ID NO: 54540 - DNA, 1299 bp, Xanthomonas oryzae pv. oryzae KACC10331; identical to SEQ ID NO: 19954
  CDS (1)..(1299): transl_table=11

SEQ ID NO: 54541 - protein, 432 aa, Xanthomonas oryzae pv. oryzae KACC10331; identical to SEQ ID NO: 19955

SEQ ID NO: 54542 - DNA, 1245 bp, Vibrio fischeri ES114; identical to SEQ ID NO: 19956
  CDS (1)..(1245): transl_table=11

SEQ ID NO: 54543 - protein, 414 aa, Vibrio fischeri ES114; identical to SEQ ID NO: 19957

SEQ ID NO: 54544 - DNA, 1248 bp, Neisseria gonorrhoeae FA 1090; identical to SEQ ID NO: 19958
  CDS (1)..(1248): transl_table=11

SEQ ID NO: 54545 - protein, 415 aa, Neisseria gonorrhoeae FA 1090; identical to SEQ ID NO: 19959

SEQ ID NO: 54546 - DNA, 1263 bp, Bacteroides fragilis NCTC 9343; identical to SEQ ID NO: 19960
  CDS (1)..(1263): transl_table=11

SEQ ID NO: 54547 - protein, 420 aa, Bacteroides fragilis NCTC 9343; identical to SEQ ID NO: 19961

SEQ ID NO: 54548 - DNA, 1251 bp, Chlamydophila abortus S26/3; identical to SEQ ID NO: 19962
  CDS (1)..(1251): transl_table=11

SEQ ID NO: 54549 - protein, 416 aa, Chlamydophila abortus S26/3; identical to SEQ ID NO: 19963

SEQ ID NO: 54550 - DNA, 1263 bp, Brucella abortus biovar 1 str. 9-941; identical to SEQ ID NO: 19964
  CDS (1)..(1263): transl_table=11

SEQ ID NO: 54551 - protein, 420 aa, Brucella abortus biovar 1 str. 9-941; identical to SEQ ID NO: 19965

SEQ ID NO: 54552 - DNA, 1236 bp, Xanthomonas campestris pv. campestris str. 8004; identical to SEQ ID NO: 19966
  CDS (1)..(1236): transl_table=11

SEQ ID NO: 54553 - protein, 411 aa, Xanthomonas campestris pv. campestris str. 8004; identical to SEQ ID NO: 19967

SEQ ID NO: 54554 - DNA, 1281 bp, Rickettsia felis URRWXCal2; identical to SEQ ID NO: 19968
  CDS (1)..(1281): transl_table=11

SEQ ID NO: 54555 - protein, 426 aa, Rickettsia felis URRWXCal2; identical to SEQ ID NO: 19969

SEQ ID NO: 54556 - DNA, 1245 bp, Staphylococcus haemolyticus JCSC1435; identical to SEQ ID NO: 19970
  CDS (1)..(1245): transl_table=11

SEQ ID NO: 54557 - protein, 414 aa, Staphylococcus haemolyticus JCSC1435; identical to SEQ ID NO: 19971

SEQ ID NO: 54558 - DNA, 1245 bp, Pseudomonas fluorescens Pf-5; identical to SEQ ID NO: 19972
  CDS (1)..(1245): transl_table=11

SEQ ID NO: 54559 - protein, 414 aa, Pseudomonas fluorescens Pf-5; identical to SEQ ID NO: 19973

SEQ ID NO: 54560 - DNA, 1269 bp, Pseudomonas fluorescens Pf-5; identical to SEQ ID NO: 19974
  CDS (1)..(1269): transl_table=11

SEQ ID NO: 54561 - protein, 422 aa, Pseudomonas fluorescens Pf-5; identical to SEQ ID NO: 19975

SEQ ID NO: 54562 - DNA, 1416 bp, Psychrobacter arcticum 273-4; identical to SEQ ID NO: 19976
  CDS (1)..(1416): transl_table=11

SEQ ID NO: 54563 - protein, 471 aa, Psychrobacter arcticum 273-4; identical to SEQ ID NO: 19977

SEQ ID NO: 54564 - DNA, 1239 bp, Colwellia psychrerythraea 34H; identical to SEQ ID NO: 19978
  CDS (1)..(1239): transl_table=11

SEQ ID NO: 54565 - protein, 412 aa, Colwellia psychrerythraea 34H; identical to SEQ ID NO: 19979

SEQ ID NO: 54566 - DNA, 1212 bp, Colwellia psychrerythraea 34H; identical to SEQ ID NO: 19980
  CDS (1)..(1212): transl_table=11

SEQ ID NO: 54567 - protein, 403 aa, Colwellia psychrerythraea 34H; identical to SEQ ID NO: 19981

SEQ ID NO: 54568 - DNA, 1245 bp, Pseudomonas syringae pv. phaseolicola 1448A; identical to SEQ ID NO: 19982
  CDS (1)..(1245): transl_table=11

SEQ ID NO: 54569 - protein, 414 aa, Pseudomonas syringae pv. phaseolicola 1448A; identical to SEQ ID NO: 19983

SEQ ID NO: 54570 - DNA, 1233 bp, Streptococcus pyogenes MGAS5005; identical to SEQ ID NO: 19984
  CDS (1)..(1233): transl_table=11

SEQ ID NO: 54571 - protein, 410 aa, Streptococcus pyogenes MGAS5005; identical to SEQ ID NO: 19985

SEQ ID NO: 54572 - DNA, 1236 bp, Dechloromonas aromatica RCB; identical to SEQ ID NO: 19986
  CDS (1)..(1236): transl_table=11

SEQ ID NO: 54573 - protein, 411 aa, Dechloromonas aromatica RCB; identical to SEQ ID NO: 19987

SEQ ID NO: 54574 - DNA, 1263 bp, Thermobifida fusca YX; identical to SEQ ID NO: 19988
  CDS (1)..(1263): transl_table=11

SEQ ID NO: 54575 - protein, 420 aa, Thermobifida fusca YX; identical to SEQ ID NO: 19989

SEQ ID NO: 54576 - DNA, 1239 bp, Thermobifida fusca YX; identical to SEQ ID NO: 19990
  CDS (1)..(1239): transl_table=11

SEQ ID NO: 54577 - protein, 412 aa, Thermobifida fusca YX; identical to SEQ ID NO: 19991

SEQ ID NO: 54578 - DNA, 1248 bp, Prochlorococcus marinus str. NATL2A; identical to SEQ ID NO: 19992
  CDS (1)..(1248): transl_table=11

SEQ ID NO: 54579 - protein, 415 aa, Prochlorococcus marinus str. NATL2A; identical to SEQ ID NO: 19993

SEQ ID NO: 54580 - DNA, 1233 bp, Ralstonia eutropha JMP134; identical to SEQ ID NO: 19994
  CDS (1)..(1233): transl_table=11

SEQ ID NO: 54581 - protein, 410 aa, Ralstonia eutropha JMP134; identical to SEQ ID NO: 19995

SEQ ID NO: 54582 - DNA, 1245 bp, Staphylococcus saprophyticus subsp. saprophyticus ATCC 15305; identical to SEQ ID NO: 19996
  CDS (1)..(1245): transl_table=11

SEQ ID NO: 54583 - protein, 414 aa, Staphylococcus saprophyticus subsp. saprophyticus ATCC 15305; identical to SEQ ID NO: 19997

SEQ ID NO: 54584 - DNA, 1269 bp, Ehrlichia canis str. Jake; identical to SEQ ID NO: 19998
  CDS (1)..(1269): transl_table=11

SEQ ID NO: 54585 - protein, 422 aa, Ehrlichia canis str. Jake; identical to SEQ ID NO: 19999

SEQ ID NO: 54586 - DNA, 1269 bp, Dehalococcoides sp. CBDB1; identical to SEQ ID NO: 20000
  CDS (1)..(1269): transl_table=11

SEQ ID NO: 54587 - protein, 422 aa, Dehalococcoides sp. CBDB1; identical to SEQ ID NO: 20001

SEQ ID NO: 54588 - DNA, 1233 bp, Thiobacillus denitrificans ATCC 25259; identical to SEQ ID NO: 20002
  CDS (1)..(1233): transl_table=11

SEQ ID NO: 54589 - protein, 410 aa, Thiobacillus denitrificans ATCC 25259; identical to SEQ ID NO: 20003

SEQ ID NO: 54590 - DNA, 1215 bp, Pseudomonas syringae pv. syringae B728a; identical to SEQ ID NO: 20004
  CDS (1)..(1215)

SEQ ID NO: 54591 - protein, 404 aa, Pseudomonas syringae pv. syringae B728a; identical to SEQ ID NO: 20005

SEQ ID NO: 54592 - DNA, 1215 bp, Pseudomonas aeruginosa UCBPP-PA14; identical to SEQ ID NO: 20006
  CDS (1)..(1215)

SEQ ID NO: 54593 - protein, 404 aa, Pseudomonas aeruginosa UCBPP-PA14; identical to SEQ ID NO: 20007

SEQ ID NO: 54594 - DNA, 1215 bp, Pseudomonas fluorescens PfO-1; identical to SEQ ID NO: 20008
  CDS (1)..(1215)

SEQ ID NO: 54595 - protein, 404 aa, Pseudomonas fluorescens PfO-1; identical to SEQ ID NO: 20009

SEQ ID NO: 54596 - DNA, 1236 bp, Enterococcus faecium DO; identical to SEQ ID NO: 20010
  CDS (1)..(1236): transl_table=11

SEQ ID NO: 54597 - protein, 411 aa, Enterococcus faecium DO; identical to SEQ ID NO: 20011

SEQ ID NO: 54598 - DNA, 1308 bp, Neurospora crassa; identical to SEQ ID NO: 20012
  CDS (1)..(1308): n means a or g or c or t/u, s means g or c

SEQ ID NO: 54599 - protein, 435 aa, Neurospora crassa; identical to SEQ ID NO: 20013
  Xaa in positions 84, 155, 174, 226, 303, 328, 332, 345, 346, 349, 356, 384, 422 and 434 is unknown

SEQ ID NO: 54600 - DNA, 1425 bp, Perilla frutescens; identical to SEQ ID NO: 20014
  CDS (1)..(1425)

SEQ ID NO: 54601 - protein, 474 aa, Perilla frutescens; identical to SEQ ID NO: 20015

SEQ ID NO: 54602 - DNA, 1593 bp, Perilla frutescens; identical to SEQ ID NO: 20016
  CDS (1)..(1593)

SEQ ID NO: 54603 - protein, 530 aa, Perilla frutescens; identical to SEQ ID NO: 20017

SEQ ID NO: 54604 - DNA, 1278 bp, Streptomyces roseofulvus; identical to SEQ ID NO: 20018
  CDS (1)..(1278): transl_table=11

SEQ ID NO: 54605 - protein, 425 aa, Streptomyces roseofulvus; identical to SEQ ID NO: 20019

SEQ ID NO: 54606 - DNA, 1467 bp, Capsicum chinense; identical to SEQ ID NO: 20020
  CDS (1)..(1467)

SEQ ID NO: 54607 - protein, 488 aa, Capsicum chinense; identical to SEQ ID NO: 20021

SEQ ID NO: 54608 - DNA, 1554 bp, Cuphea wrightii; identical to SEQ ID NO: 20022
  CDS (1)..(1554)

SEQ ID NO: 54609 - protein, 517 aa, Cuphea wrightii; identical to SEQ ID NO: 20023

SEQ ID NO: 54610 - DNA, 1623 bp, Cuphea wrightii; identical to SEQ ID NO: 20024
  CDS (1)..(1623)

SEQ ID NO: 54611 - protein, 540 aa, Cuphea wrightii; identical to SEQ ID NO: 20025

SEQ ID NO: 54612 - DNA, 1488 bp, Hordeum vulgare; identical to SEQ ID NO: 20026
  CDS (1)..(1488)

SEQ ID NO: 54613 - protein, 495 aa, Hordeum vulgare; identical to SEQ ID NO: 20027

SEQ ID NO: 54614 - DNA, 1470 bp, Hordeum vulgare; identical to SEQ ID NO: 20028
  CDS (1)..(1470)

SEQ ID NO: 54615 - protein, 489 aa, Hordeum vulgare; identical to SEQ ID NO: 20029

SEQ ID NO: 54616 - DNA, 1608 bp, Ricinus communis; identical to SEQ ID NO: 20030
  CDS (1)..(1608)

SEQ ID NO: 54617 - protein, 535 aa, Ricinus communis; identical to SEQ ID NO: 20031

SEQ ID NO: 54618 - DNA, 1410 bp, Ricinus communis; identical to SEQ ID NO: 20032
  CDS (1)..(1410)

SEQ ID NO: 54619 - protein, 469 aa, Ricinus communis; identical to SEQ ID NO: 20033

SEQ ID NO: 54620 - DNA, 1269 bp, Pseudomonas syringae pv; identical to SEQ ID NO: 20034
  CDS (1)..(1269): transl_table=11

SEQ ID NO: 54621 - protein, 422 aa, Pseudomonas syringae pv; identical to SEQ ID NO: 20035

SEQ ID NO: 54622 - DNA, 1272 bp, Streptomyces glaucescens; identical to SEQ ID NO: 20036
  CDS (1)..(1272): transl_table=11

SEQ ID NO: 54623 - protein, 423 aa, Streptomyces glaucescens; identical to SEQ ID NO: 20037

SEQ ID NO: 54624 - DNA, 1269 bp, Streptomyces griseus; identical to SEQ ID NO: 20038
  CDS (1)..(1269): transl_table=11

SEQ ID NO: 54625 - protein, 422 aa, Streptomyces griseus; identical to SEQ ID NO: 20039

SEQ ID NO: 54626 - DNA, 1293 bp, Streptomyces nogalater; identical to SEQ ID NO: 20040
  CDS (1)..(1293): transl_table=11

SEQ ID NO: 54627 - protein, 430 aa, Streptomyces nogalater; identical to SEQ ID NO: 20041

SEQ ID NO: 54628 - DNA, 1260 bp, Streptomyces peucetius; identical to SEQ ID NO: 20042
  CDS (1)..(1260): transl_table=11

SEQ ID NO: 54629 - protein, 419 aa, Streptomyces peucetius; identical to SEQ ID NO: 20043

SEQ ID NO: 54630 - DNA, 1278 bp, Streptomyces roseofulvus; identical to SEQ ID NO: 20044
  CDS (1)..(1278): transl_table=11

SEQ ID NO: 54631 - protein, 425 aa, Streptomyces roseofulvus; identical to SEQ ID NO: 20045

SEQ ID NO: 54632 - DNA, 1467 bp, Glycine max; identical to SEQ ID NO: 20046
  CDS (1)..(1467)

SEQ ID NO: 54633 - protein, 488 aa, Glycine max; identical to SEQ ID NO: 20047

SEQ ID NO: 54634 - DNA, 1470 bp, Glycine max; identical to SEQ ID NO: 20048
  CDS (1)..(1470)

SEQ ID NO: 54635 - protein, 489 aa, Glycine max; identical to SEQ ID NO: 20049

SEQ ID NO: 54636 - DNA, 1299 bp, Streptomyces spiramyceticus; identical to SEQ ID NO: 20050
  CDS (1)..(1299): transl_table=11

SEQ ID NO: 54637 - protein, 432 aa, Streptomyces spiramyceticus; identical to SEQ ID NO: 20051

SEQ ID NO: 54638 - DNA, 1218 bp, Saccharopolyspora erythraea; identical to SEQ ID NO: 20052
  CDS (1)..(1218): transl_table=11

SEQ ID NO: 54639 - protein, 405 aa, Saccharopolyspora erythraea; identical to SEQ ID NO: 20053

SEQ ID NO: 54640 - DNA, 1269 bp, Streptomyces griseoruber; identical to SEQ ID NO: 20054
  CDS (1)..(1269): transl_table=11

SEQ ID NO: 54641 - protein, 422 aa, Streptomyces griseoruber; identical to SEQ ID NO: 20055

SEQ ID NO: 54642 - DNA, 1398 bp, Oryza sativa; identical to SEQ ID NO: 20056
  CDS (1)..(1398)

SEQ ID NO: 54643 - protein, 465 aa, Oryza sativa; identical to SEQ ID NO: 20057

SEQ ID NO: 54644 - DNA, 1254 bp, Treponema hyodysenteriae; identical to SEQ ID NO: 20058
  CDS (1)..(1254): transl_table=11

SEQ ID NO: 54645 - protein, 417 aa, Treponema hyodysenteriae; identical to SEQ ID NO: 20059

SEQ ID NO: 54646 - DNA, 1269 bp, Rhizobium sp; identical to SEQ ID NO: 20060
  CDS (1)..(1269): transl_table=11

SEQ ID NO: 54647 - protein, 422 aa, Rhizobium sp; identical to SEQ ID NO: 20061

SEQ ID NO: 54648 - DNA, 1305 bp, Plasmodium yoelii yoelii; identical to SEQ ID NO: 20062
  CDS (1)..(1305)

SEQ ID NO: 54649 - protein, 434 aa, Plasmodium yoelii yoelii; identical to SEQ ID NO: 20063

SEQ ID NO: 54650 - DNA, 1275 bp, Streptomyces murayamaensis; identical to SEQ ID NO: 20064
  CDS (1)..(1275): transl_table=11

SEQ ID NO: 54651 - protein, 424 aa, Streptomyces murayamaensis; identical to SEQ ID NO: 20065

SEQ ID NO: 54652 - DNA, 1446 bp, Dictyostelium discoideum; identical to SEQ ID NO: 20066
  CDS (1)..(1446)

SEQ ID NO: 54653 - protein, 481 aa, Dictyostelium discoideum; identical to SEQ ID NO: 20067

SEQ ID NO: 54654 - DNA, 1248 bp, Heliobacillus mobilis; identical to SEQ ID NO: 20068
  CDS (1)..(1248): transl_table=11

SEQ ID NO: 54655 - protein, 415 aa, Heliobacillus mobilis; identical to SEQ ID NO: 20069

SEQ ID NO: 54656 - DNA, 1626 bp, Arabidopsis thaliana; identical to SEQ ID NO: 20070
  CDS (1)..(1626)

SEQ ID NO: 54657 - protein, 541 aa, Arabidopsis thaliana; identical to SEQ ID NO: 20071

SEQ ID NO: 54658 - DNA, 1272 bp, Streptomyces galilaeus; identical to SEQ ID NO: 20072
  CDS (1)..(1272): transl_table=11

SEQ ID NO: 54659 - protein, 423 aa, Streptomyces galilaeus; identical to SEQ ID NO: 20073

SEQ ID NO: 54660 - DNA, 1617 bp, Cuphea lanceolata; identical to SEQ ID NO: 20074
  CDS (1)..(1617)

SEQ ID NO: 54661 - protein, 538 aa, Cuphea lanceolata; identical to SEQ ID NO: 20075

SEQ ID NO: 54662 - DNA, 1371 bp, Coriandrum sativum; identical to SEQ ID NO: 20076
  CDS (1)..(1371)

SEQ ID NO: 54663 - protein, 456 aa, Coriandrum sativum; identical to SEQ ID NO: 20077

SEQ ID NO: 54664 - DNA, 1236 bp, Xanthomonas albilineans; identical to SEQ ID NO: 20078
  CDS (1)..(1236): transl_table=11

SEQ ID NO: 54665 - protein, 411 aa, Xanthomonas albilineans; identical to SEQ ID NO: 20079

SEQ ID NO: 54666 - DNA, 1272 bp, Streptomyces maritimus; identical to SEQ ID NO: 20080
  CDS (1)..(1272): transl_table=11

SEQ ID NO: 54667 - protein, 423 aa, Streptomyces maritimus; identical to SEQ ID NO: 20081

SEQ ID NO: 54668 - DNA, 1272 bp, Streptomyces galilaeus; identical to SEQ ID NO: 20082
  CDS (1)..(1272): transl_table=11

SEQ ID NO: 54669 - protein, 423 aa, Streptomyces galilaeus; identical to SEQ ID NO: 20083

SEQ ID NO: 54670 - DNA, 1635 bp, Brassica napus; identical to SEQ ID NO: 20084
  CDS (1)..(1635)

SEQ ID NO: 54671 - protein, 544 aa, Brassica napus; identical to SEQ ID NO: 20085

SEQ ID NO: 54672 - DNA, 1302 bp, Brassica napus; identical to SEQ ID NO: 20086
  CDS (1)..(1302)

SEQ ID NO: 54673 - protein, 433 aa, Brassica napus; identical to SEQ ID NO: 20087

SEQ ID NO: 54674 - DNA, 1467 bp, Glycine max; identical to SEQ ID NO: 20088
  CDS (1)..(1467)

SEQ ID NO: 54675 - protein, 488 aa, Glycine max; identical to SEQ ID NO: 20089

SEQ ID NO: 54676 - DNA, 1410 bp, Glycine max; identical to SEQ ID NO: 20090
  CDS (1)..(1410)

SEQ ID NO: 54677 - protein, 469 aa, Glycine max; identical to SEQ ID NO: 20091

SEQ ID NO: 54678 - DNA, 1410 bp, Glycine max; identical to SEQ ID NO: 20092
  CDS (1)..(1410)

SEQ ID NO: 54679 - protein, 469 aa, Glycine max; identical to SEQ ID NO: 20093

SEQ ID NO: 54680 - DNA, 1722 bp, Elaeis guineensis var; identical to SEQ ID NO: 20094
  CDS (1)..(1722)

SEQ ID NO: 54681 - protein, 573 aa, Elaeis guineensis var; identical to SEQ ID NO: 20095

SEQ ID NO: 54682 - DNA, 1248 bp, Vibrio marinus; identical to SEQ ID NO: 20096
  CDS (1)..(1248): transl_table=11

SEQ ID NO: 54683 - protein, 415 aa, Vibrio marinus; identical to SEQ ID NO: 20097

SEQ ID NO: 54684 - DNA, 1260 bp, Streptomyces rochei; identical to SEQ ID NO: 20098
  CDS (1)..(1260): transl_table=11

SEQ ID NO: 54685 - protein, 419 aa, Streptomyces rochei; identical to SEQ ID NO: 20099

SEQ ID NO: 54686 - DNA, 1689 bp, Arabidopsis thaliana; identical to SEQ ID NO: 20100
  CDS (1)..(1689)

SEQ ID NO: 54687 - protein, 562 aa, Arabidopsis thaliana; identical to SEQ ID NO: 20101

SEQ ID NO: 54688 - DNA, 1605 bp, Cuphea hookeriana; identical to SEQ ID NO: 20102
  CDS (1)..(1605)

SEQ ID NO: 54689 - protein, 534 aa, Cuphea hookeriana; identical to SEQ ID NO: 20103

SEQ ID NO: 54690 - DNA, 1641 bp, Cuphea pulcherrima; identical to SEQ ID NO: 20104
  CDS (1)..(1641)

SEQ ID NO: 54691 - protein, 546 aa, Cuphea pulcherrima; identical to SEQ ID NO: 20105

SEQ ID NO: 54692 - DNA, 1329 bp, Saccharomyces cerevisiae; identical to SEQ ID NO: 20106
  CDS (1)..(1329)

SEQ ID NO: 54693 - protein, 442 aa, Saccharomyces cerevisiae; identical to SEQ ID NO: 20107

SEQ ID NO: 54694 - DNA, 1251 bp, Mycobacterium leprae; identical to SEQ ID NO: 20108
  CDS (1)..(1251): transl_table=11

SEQ ID NO: 54695 - protein, 416 aa, Mycobacterium leprae; identical to SEQ ID NO: 20109

SEQ ID NO: 54696 - DNA, 1221 bp, Haemophilus influenzae; identical to SEQ ID NO: 20110
  CDS (1)..(1221): transl_table=11

SEQ ID NO: 54697 - protein, 406 aa, Haemophilus influenzae; identical to SEQ ID NO: 20111

SEQ ID NO: 54698 - DNA, 1266 bp, Rhizobium meliloti; identical to SEQ ID NO: 20112
  CDS (1)..(1266): transl_table=11

SEQ ID NO: 54699 - protein, 421 aa, Rhizobium meliloti; identical to SEQ ID NO: 20113

SEQ ID NO: 54700 - DNA, 1251 bp, Synechocystis sp; identical to SEQ ID NO: 20114
  CDS (1)..(1251): transl_table=11

SEQ ID NO: 54701 - protein, 416 aa, Synechocystis sp; identical to SEQ ID NO: 20115

SEQ ID NO: 54702 - DNA, 1245 bp, Vibrio cholerae; identical to SEQ ID NO: 20116
  CDS (1)..(1245)

SEQ ID NO: 54703 - protein, 414 aa, Vibrio cholerae; identical to SEQ ID NO: 19655

SEQ ID NO: 54704 - DNA, 1248 bp, Vibrio harveyi; identical to SEQ ID NO: 20118
  CDS (1)..(1248)

SEQ ID NO: 54705 - protein, 415 aa, Vibrio harveyi; identical to SEQ ID NO: 20119

SEQ ID NO: 54706 - DNA, 1272 bp, Streptomyces coelicolor; identical to SEQ ID NO: 20120
  CDS (1)..(1272): transl_table=11

SEQ ID NO: 54707 - protein, 423 aa, Streptomyces coelicolor; identical to SEQ ID NO: 20121

SEQ ID NO: 54708 - DNA, 1269 bp, Streptomyces halstedii; identical to SEQ ID NO: 20122
  CDS (1)..(1269): transl_table=11

SEQ ID NO: 54709 - protein, 422 aa, Streptomyces halstedii; identical to SEQ ID NO: 20123

SEQ ID NO: 54710 - DNA, 1422 bp, Arabidopsis thaliana; identical to SEQ ID NO: 20124
  CDS (1)..(1422)

SEQ ID NO: 54711 - protein, 473 aa, Arabidopsis thaliana; identical to SEQ ID NO: 20125

SEQ ID NO: 54712 - DNA, 1389 bp, Hordeum vulgare; identical to SEQ ID NO: 20126
  CDS (1)..(1389)

SEQ ID NO: 54713 - protein, 462 aa, Hordeum vulgare; identical to SEQ ID NO: 20127

SEQ ID NO: 54714 - DNA, 1386 bp, Arabidopsis thaliana; identical to SEQ ID NO: 20128
  CDS (1)..(1386)

SEQ ID NO: 54715 - protein, 461 aa, Arabidopsis thaliana; identical to SEQ ID NO: 20129

SEQ ID NO: 54716 - DNA, 24 bp, Artificial sequence
  (1)..(24): primer
atgtctaagcgtcgtgtagttgtg

SEQ ID NO: 54717 - DNA, 27 bp, Artificial sequence
  (1)..(27): primer
ttagatctttttaaagatcaaagaacc

SEQ ID NO: 54718 - protein, 494 aa, Artificial sequence; identical to SEQ ID NO: 20132
  Variant (10)..(10): xaa in position 10 is any amino acid
  Variant (16)..(21): xaa in position 16 to 21 is any amino acid
  Variant (23)..(24): xaa in position 23 to 24 is any amino acid
  Variant (26)..(27): xaa in position 26 to 27 is any amino acid
  Variant (29)..(30): xaa in position 29 to 30 is any amino acid
  Variant (33)..(34): xaa in position 33 to 34 is any amino acid
  Variant (36)..(45): xaa in position 36 to 45 is any amino acid
  Variant (46)..(57): xaa in position 46 to 57 is any or no amino acid
  Variant (60)..(60): xaa in position 60 is any amino acid
  Variant (62)..(69): xaa in position 62 to 69 is any amino acid
  Variant (70)..(86): xaa in position 70 to 86 is any or no amino acid
  Variant (88)..(89): xaa in position 88 to 89 is any amino acid
  Variant (94)..(97): xaa in position 94 to 97 is any amino acid
  Variant (101)..(101): xaa in position 101 is any amino acid
  Variant (104)..(105): xaa in position 104 to 105 is any amino acid
  Variant (108)..(109): xaa in position 108 to 109 is any amino acid
  Variant (111)..(117): xaa in position 111 to 117 is any amino acid
  Variant (118)..(131): xaa in position 118 to 131 is any or no amino acid
  Variant (133)..(133): xaa in position 133 is any amino acid
  Variant (136)..(136): xaa in position 136 is any amino acid
  Variant (145)..(157): xaa in position 145 to 157 is any amino acid
  Variant (158)..(172): xaa in position 158 to 172 is any or no amino acid
  Variant (174)..(179): xaa in position 174 to 179 is any or no amino acid
  Variant (181)..(181): xaa in position 181 is any amino acid
  Variant (183)..(184): xaa in position 183 to 184 is any amino acid
  Variant (187)..(188): xaa in position 187 to 188 is any amino acid
  Variant (190)..(191): xaa in position 190 to 191 is any amino acid
  Variant (193)..(193): xaa in position 193 is any amino acid
  Variant (196)..(196): xaa in position 196 is any amino acid
  Variant (200)..(201): xaa in position 200 to 201 is any amino acid
  Variant (203)..(204): xaa in position 203 to 204 is any amino acid
  Variant (206)..(211): xaa in position 206 to 211 is any amino acid
  Variant (215)..(215): xaa in position 215 is any amino acid
  Variant (217)..(220): xaa in position 217 to 220 is any amino acid
  Variant (223)..(223): xaa in position 223 is any amino acid
  Variant (225)..(227): xaa in position 225 to 227 is any amino acid
  Variant (229)..(230): xaa in position 229 to 230 is any amino acid
  Variant (232)..(232): xaa in position 232 is any amino acid
  Variant (234)..(244): xaa in position 234 to 244 is any or no amino acid
  Variant (246)..(246): xaa in position 246 is any amino acid
  Variant (249)..(249): xaa in position 249 is any amino acid
  Variant (252)..(252): xaa in position 252 is any amino acid
  Variant (254)..(254): xaa in position 254 is any amino acid
  Variant (255)..(255): xaa in position 255 is any or no amino acid
  Variant (257)..(258): xaa in position 257 to 258 is any amino acid
  Variant (260)..(260): xaa in position 260 is any amino acid
  Variant (265)..(265): xaa in position 265 is any amino acid
  Variant (267)..(267): xaa in position 267 is any amino acid
  Variant (272)..(272): xaa in position 272 is any amino acid
  Variant (273)..(274): xaa in position 273 to 274 is any or no amino acid
  Variant (276)..(277): xaa in position 276 to 277 is any or no amino acid
  Variant (279)..(279): xaa in position 279 is any or no amino acid
  Variant (281)..(282): xaa in position 281 to 282 is any or no amino acid
  Variant (289)..(290): xaa in position 289 to 290 is any amino acid
  Variant (292)..(292): xaa in position 292 is any amino acid
  Variant (307)..(308): xaa in position 307 to 308 is any amino acid
  Variant (312)..(313): xaa in position 312 to 313 is any amino acid
  Variant (317)..(317): xaa in position 317 is any amino acid
  Variant (319)..(319): xaa in position 319 is any amino acid
  Variant (323)..(323): xaa in position 323 is any amino acid
  Variant (325)..(325): xaa in position 325 is any amino acid
  Variant (327)..(327): xaa in position 327 is any amino acid
  Variant (329)..(329): xaa in position 329 is any amino acid
  Variant (332)..(332): xaa in position 332 is any amino acid
  Variant (336)..(336): xaa in position 336 is any amino acid
  Variant (338)..(338): xaa in position 338 is any amino acid
  Variant (339)..(340): xaa in position 339 to 340 is any or no amino acid
  Variant (342)..(342): xaa in position 342 is any amino acid
  Variant (344)..(346): xaa in position 344 to 346 is any amino acid
  Variant (347)..(347): xaa in position 347 is any or no amino acid
  Variant (349)..(350): xaa in position 349 to 350 is any amino acid
  Variant (353)..(354): xaa in position 353 to 354 is any amino acid
  Variant (356)..(356): xaa in position 356 is any amino acid
  Variant (358)..(363): xaa in position 358 to 363 is any or no amino acid
  Variant (365)..(365): xaa in position 365 is any amino acid
  Variant (375)..(376): xaa in position 375 to 376 is any amino acid
  Variant (377)..(377): xaa in position 377 is any or no amino acid
  Variant (379)..(380): xaa in position 379 to 380 is any amino acid
  Variant (382)..(383): xaa in position 382 to 383 is any amino acid
  Variant (386)..(389): xaa in position 386 to 389 is any amino acid
  Variant (391)..(392): xaa in position 391 to 392 is any amino acid
  Variant (393)..(406): xaa in position 393 to 406 is any or no amino acid
  Variant (408)..(408): xaa in position 408 is any or no amino acid
  Variant (410)..(410): xaa in position 410 is any amino acid
  Variant (415)..(416): xaa in position 415 to 416 is any amino acid
  Variant (419)..(419): xaa in position 419 is any amino acid
  Variant (430)..(431): xaa in position 430 to 431 is any amino acid
  Variant (433)..(433): xaa in position 433 is any amino acid
  Variant (436)..(441): xaa in position 436 to 441 is any amino acid
  Variant (446)..(452): xaa in position 446 to 452 is any amino acid
  Variant (453)..(459): xaa in position 453 to 459 is any or no amino acid
  Variant (461)..(462): xaa in position 461 to 462 is any amino acid
  Variant (464)..(473): xaa in position 464 to 473 is any amino acid
  Variant (474)..(480): xaa in position 474 to 480 is any or no amino acid
  Variant (484)..(484): xaa in position 484 is any amino acid
  Variant (490)..(490): xaa in position 490 is any amino acid
  Variant (492)..(493): xaa in position 492 to 493 is any amino acid

SEQ ID NO: 54719 - protein, 31 aa, Artificial sequence; identical to SEQ ID NO: 20133
  Variant (2)..(2): xaa in position 2 is any amino acid
  Variant (3)..(3): xaa in position 3 is any or no amino acid
  Variant (5)..(5): xaa in position 5 is Ile or Val
  Variant (8)..(8): xaa in position 8 is any amino acid
  Variant (10)..(11): xaa in position 10 to 11 is any amino acid
  Variant (12)..(12): xaa in position 12 is Ala, Ser or Thr
  Variant (13)..(14): xaa in position 13 to 14 is any amino acid
  Variant (15)..(15): xaa in position 15 is Ala or Gly
  Variant (16)..(16): xaa in position 16 is any amino acid
  Variant (17)..(17): xaa in position 17 is Asp, Glu, Gly, Asn, Ser or Thr
  Variant (18)..(27): xaa in position 18 to 27 is any amino acid
  Variant (29)..(30): xaa in position 29 to 30 is any amino acid
  Variant (31)..(31): xaa in position 31 is Ala or Gly

SEQ ID NO: 54720 - protein, 10 aa, Artificial sequence
  Variant (2)..(4): xaa in position 2 to 4 is any amino acid
  Variant (6)..(6): xaa in position 6 is Ala, Cys, Asn, Ser, Thr or Val
  Variant (7)..(8): xaa in position 7 to 8 is any amino acid
  Variant (10)..(10): xaa in position 10 is Ala, Cys, Asp, Gly, Asn or Ser
GXXXGXXXGX

SEQ ID NO: 54721 - protein, 45 aa, Artificial sequence; identical to SEQ ID NO: 20135
  Variant (2)..(5): xaa in position 2 to 5 is any amino acid
  Variant (6)..(6): xaa in position 6 is Asp or Asn
  Variant (7)..(7): xaa in position 7 is any amino acid
  Variant (8)..(8): xaa in position 8 is Ala, Gly, Ile, Leu, Pro or Val
  Variant (9)..(9): xaa in position 9 is Ala, Gly, Pro, Ser or Thr
  Variant (10)..(10): xaa in position 10 is Ala or Gly
  Variant (11)..(12): xaa in position 11 to 12 is any amino acid
  Variant (13)..(13): xaa in position 13 is Ala, Gly, Ser or Thr
  Variant (14)..(14): xaa in position 14 is Ile, Leu, Met or Val
  Variant (15)..(19): xaa in position 15 to 19 is any amino acid
  Variant (21)..(25): xaa in position 21 to 25 is any amino acid
  Variant (26)..(27): xaa in position 26 to 27 is any or no amino acid
  Variant (29)..(30): xaa in position 29 to 30 is any or no amino acid
  Variant (32)..(33): xaa in position 32 to 33 is Ala, Ser or Thr
  Variant (34)..(34): xaa in position 34 is Ala, Gly or Ser
  Variant (35)..(36): xaa in position 35 to 36 is any amino acid
  Variant (37)..(37): xaa in position 37 is Ala, Cys, Asn, Ser or Thr
  Variant (38)..(38): xaa in position 38 is Phe, Ile, Leu, Met or Val
  Variant (39)..(40): xaa in position 39 to 40 is any amino acid
  Variant (41)..(41): xaa in position 41 is Ala, Gly or Ser
  Variant (42)..(44): xaa in position 42 to 44 is any amino acid
  Variant (45)..(45): xaa in position 45 is Ile, Leu or Val

SEQ ID NO: 54722 - protein, 37 aa, Artificial sequence; identical to SEQ ID NO: 20136
  Variant (2)..(6): xaa in position 2 to 6 is any amino acid
  Variant (8)..(8): xaa in position 8 is Asp, Asn or Ser
  Variant (12)..(12): xaa in position 12 is Ile, Leu or Met
  Variant (13)..(13): xaa in position 13 is Ala, Gly or Ser
  Variant (14)..(14): xaa in position 14 is Asp, Glu or Gly
  Variant (16)..(16): xaa in position 16 is Ala, Cys, Gly or Ser
  Variant (17)..(17): xaa in position 17 is Ala or Gly
  Variant (18)..(18): xaa in position 18 is any amino acid
  Variant (19)..(19): xaa in position 19 is Phe, Ile, Leu, Met or Val
  Variant (20)..(20): xaa in position 20 is Ile, Leu, Met or Val
  Variant (21)..(21): xaa in position 21 is Phe, Ile, Leu, Met or Val
  Variant (23)..(23): xaa in position 23 is Ala, Asp, Glu, Ser or Thr
  Variant (24)..(26): xaa in position 24 to 26 is any amino acid
  Variant (28)..(29): xaa in position 28 to 29 is any amino acid
  Variant (31)..(31): xaa in position 31 is any amino acid
  Variant (33)..(33): xaa in position 33 is any amino acid
  Variant (34)..(34): xaa in position 34 is Ile, Pro or Val
  Variant (35)..(36): xaa in position 35 to 36 is any amino acid

SEQ ID NO: 54723 - protein, 23 aa, Artificial sequence
  Variant (2)..(2): xaa in position 2 is Ile, Leu or Val
  Variant (3)..(3): xaa in position 3 is Asn or Ser
  Variant (4)..(4): xaa in position 4 is Ala, Cys, Thr or Val
  Variant (6)..(6): xaa in position 6 is Ala or Gly
  Variant (7)..(7): xaa in position 7 is Ser or Thr
  Variant (8)..(8): xaa in position 8 is Ala, Gly or Ser
  Variant (10)..(11): xaa in position 10 to 11 is any amino acid
  Variant (12)..(12): xaa in position 12 is any or no amino acid
  Variant (14)..(15): xaa in position 14 to 15 is any amino acid
  Variant (17)..(18): xaa in position 17 to 18 is any amino acid
  Variant (19)..(22): xaa in position 19 to 22 is any or no amino acid
YXXXHXXXTXXXDXXEXXXXXXA

SEQ ID NO: 54724 - protein, 32 aa, Artificial sequence; identical to SEQ ID NO: 20138
  Variant (3)..(3): xaa in position 3 is Gly or Ser
  Variant (4)..(5): xaa in position 4 to 5 is any amino acid
  Variant (8)..(8): xaa in position 8 is any or no amino acid
  Variant (10)..(10): xaa in position 10 is any or no amino acid
  Variant (12)..(12): xaa in position 12 is Ala or Gly
  Variant (13)..(13): xaa in position 13 is Ala, Ser or Thr
  Variant (15)..(15): xaa in position 15 is Ala, Gly, Asn, Ser or Val
  Variant (16)..(16): xaa in position 16 is any amino acid
  Variant (18)..(30): xaa in position 18 to 30 is any amino acid
  Variant (31)..(31): xaa in position 31 is any or no amino acid

SEQ ID NO: 54725 - DNA, 1251 bp, Escherichia coli; identical to SEQ ID NO: 27883
  CDS (1)..(1251)

SEQ ID NO: 54726 - protein, 416 aa, Escherichia coli; identical to SEQ ID NO: 27884

SEQ ID NO: 54727 - DNA, 1218 bp, Thermoplasma volcanium GSS1; identical to SEQ ID NO: 27885
  CDS (1)..(1218): transl_table=11

SEQ ID NO: 54728 - protein, 405 aa, Thermoplasma volcanium GSS1; identical to SEQ ID NO: 27886

SEQ ID NO: 54729 - DNA, 1308 bp, Aeropyrum pernix K1; identical to SEQ ID NO: 27887
  CDS (1)..(1308): transl_table=11

SEQ ID NO: 54730 - protein, 435 aa, Aeropyrum pernix K1; identical to SEQ ID NO: 27888

SEQ ID NO: 54731 - DNA, 1104 bp, Arabidopsis thaliana; identical to SEQ ID NO: 27889
  CDS (1)..(1104)

SEQ ID NO: 54732 - protein, 367 aa, Arabidopsis thaliana; identical to SEQ ID NO: 27890

SEQ ID NO: 54733 - DNA, 1104 bp, Arabidopsis thaliana; identical to SEQ ID NO: 27891
  CDS (1)..(1104)

SEQ ID NO: 54734 - protein, 367 aa, Arabidopsis thaliana; identical to SEQ ID NO: 27892

SEQ ID NO: 54735 - DNA, 1107 bp, Arabidopsis thaliana; identical to SEQ ID NO: 27893
  CDS (1)..(1107)

SEQ ID NO: 54736 - protein, 368 aa, Arabidopsis thaliana; identical to SEQ ID NO: 27894

SEQ ID NO: 54737 - DNA, 1269 bp, Bacillus halodurans C-125; identical to SEQ ID NO: 27895
  CDS (1)..(1269): transl_table=11

SEQ ID NO: 54738 - protein, 422 aa, Bacillus halodurans C-125; identical to SEQ ID NO: 27896

SEQ ID NO: 54739 - DNA, 1248 bp, Pasteurella multocida subsp. multocida str. Pm70; identical to SEQ ID NO: 27897
  CDS (1)..(1248): transl_table=11

SEQ ID NO: 54740 - protein, 415 aa, Pasteurella multocida subsp. multocida str. Pm70; identical to SEQ ID NO: 27898

SEQ ID NO: 54741 - DNA, 1257 bp, Pseudomonas aeruginosa PAO1; identical to SEQ ID NO: 27899
  CDS (1)..(1257): transl_table=11

SEQ ID NO: 54742 - protein, 418 aa, Pseudomonas aeruginosa PAO1; identical to SEQ ID NO: 27900

SEQ ID NO: 54743 - DNA, 1239 bp, Lactococcus lactis subsp. lactis Il1403; identical to SEQ ID NO: 27901
  CDS (1)..(1239): transl_table=11

SEQ ID NO: 54744 - protein, 412 aa, Lactococcus lactis subsp. lactis Il1403; identical to SEQ ID NO: 27902

SEQ ID NO: 54745 - DNA, 996 bp, Methanothermobacter thermautotrophicus str. Delta H; identical to SEQ ID NO: 27903
  CDS (1)..(996): transl_table=11

SEQ ID NO: 54746 - protein, 331 aa, Methanothermobacter thermautotrophicus str. Delta H; identical to SEQ ID NO: 27904

SEQ ID NO: 54747 - DNA, 1269 bp, Halobacterium sp. NRC-1; identical to SEQ ID NO: 27905
  CDS (1)..(1269): transl_table=11

SEQ ID NO: 54748 - protein, 422 aa, Halobacterium sp. NRC-1; identical to SEQ ID NO: 27906

SEQ ID NO: 54749 - DNA, 1008 bp, Xylella fastidiosa 9a5c; identical to SEQ ID NO: 27907
  CDS (1)..(1008): transl_table=11

SEQ ID NO: 54750 - protein, 335 aa, Xylella fastidiosa 9a5c; identical to SEQ ID NO: 27908

SEQ ID NO: 54751 - DNA, 1242 bp, Sulfolobus solfataricus P2; identical to SEQ ID NO: 27909
  CDS (1)..(1242): transl_table=11

SEQ ID NO: 54752 - protein, 413 aa, Sulfolobus solfataricus P2; identical to SEQ ID NO: 5668

SEQ ID NO: 54753 - DNA, 1005 bp, Clostridium acetobutylicum ATCC 824; identical to SEQ ID NO: 27911
  CDS (1)..(1005): transl_table=11

SEQ ID NO: 54754 - protein, 334 aa, Clostridium acetobutylicum ATCC 824; identical to SEQ ID NO: 27912

SEQ ID NO: 54755 - DNA, 1230 bp, Sulfolobus tokodaii str. 7; identical to SEQ ID NO: 27913
  CDS (1)..(1230): transl_table=11

SEQ ID NO: 54756 - protein, 409 aa, Sulfolobus tokodaii str. 7; identical to SEQ ID NO: 27914

SEQ ID NO: 54757 - DNA, 1218 bp, Thermoplasma acidophilum DSM 1728; identical to SEQ ID NO: 27915
  CDS (1)..(1218): transl_table=11

SEQ ID NO: 54758 - protein, 405 aa, Thermoplasma acidophilum DSM 1728; identical to SEQ ID NO: 27916

SEQ ID NO: 54759 - DNA, 1428 bp, Synechocystis sp. PCC 6803; identical to SEQ ID NO: 27917
  CDS (1)..(1428): transl_table=11

SEQ ID NO: 54760 - protein, 475 aa, Synechocystis sp. PCC 6803; identical to SEQ ID NO: 27918

SEQ ID NO: 54761 - DNA, 1263 bp, Listeria monocytogenes EGD-e; identical to SEQ ID NO: 27919
  CDS (1)..(1263): transl_table=11

SEQ ID NO: 54762 - protein, 420 aa, Listeria monocytogenes EGD-e; identical to SEQ ID NO: 27920

SEQ ID NO: 54763 - DNA, 1263 bp, Listeria innocua Clip11262; identical to SEQ ID NO: 27921
  CDS (1)..(1263): transl_table=11

SEQ ID NO: 54764 - protein, 420 aa, Listeria innocua Clip11262; identical to SEQ ID NO: 27922

SEQ ID NO: 54765 - DNA, 1251 bp, Ralstonia solanacearum GMI1000; identical to SEQ ID NO: 27923
  CDS (1)..(1251): transl_table=11

SEQ ID NO: 54766 - protein, 416 aa, Ralstonia solanacearum GMI1000; identical to SEQ ID NO: 27924

SEQ ID NO: 54767 - DNA, 1320 bp, Pyrobaculum aerophilum str. IM2; identical to SEQ ID NO: 27925
  CDS (1)..(1320): transl_table=11

SEQ ID NO: 54768 - protein, 439 aa, Pyrobaculum aerophilum str. IM2; identical to SEQ ID NO: 27926

SEQ ID NO: 54769 - DNA, 1125 bp, Arabidopsis thaliana; identical to SEQ ID NO: 27927
  CDS (1)..(1125)

SEQ ID NO: 54770 - protein, 374 aa, Arabidopsis thaliana; identical to SEQ ID NO: 27928

SEQ ID NO: 54771 - DNA, 1065 bp, Drosophila melanogaster; identical to SEQ ID NO: 27929
  CDS (1)..(1065)

SEQ ID NO: 54772 - protein, 354 aa, Drosophila melanogaster; identical to SEQ ID NO: 27930

SEQ ID NO: 54773 - DNA, 1203 bp, Pyrococcus furiosus DSM 3638; identical to SEQ ID NO: 27931
  CDS (1)..(1203): transl_table=11

SEQ ID NO: 54774 - protein, 400 aa, Pyrococcus furiosus DSM 3638; identical to SEQ ID NO: 27932

SEQ ID NO: 54775 - DNA, 1068 bp, Pyrococcus furiosus DSM 3638; identical to SEQ ID NO: 27933
  CDS (1)..(1068): transl_table=11

SEQ ID NO: 54776 - protein, 355 aa, Pyrococcus furiosus DSM 3638; identical to SEQ ID NO: 27934

SEQ ID NO: 54777 - DNA, 1008 bp, Methanopyrus kandleri AV19; identical to SEQ ID NO: 27935
  CDS (1)..(1008): transl_table=11

SEQ ID NO: 54778 - protein, 335 aa, Methanopyrus kandleri AV19; identical to SEQ ID NO: 27936

SEQ ID NO: 54779 - DNA, 1128 bp, Methanosarcina acetivorans C2A; identical to SEQ ID NO: 27937
  CDS (1)..(1128): transl_table=11

SEQ ID NO: 54780 - protein, 375 aa, Methanosarcina acetivorans C2A; identical to SEQ ID NO: 27938

SEQ ID NO: 54781 - DNA, 1029 bp, Methanosarcina acetivorans C2A; identical to SEQ ID NO: 27939
  CDS (1)..(1029): transl_table=11

SEQ ID NO: 54782 - protein, 342 aa, Methanosarcina acetivorans C2A; identical to SEQ ID NO: 27940

SEQ ID NO: 54783 - DNA, 1029 bp, Methanosarcina mazei Go1; identical to SEQ ID NO: 27941
  CDS (1)..(1029): transl_table=11

SEQ ID NO: 54784 - protein, 342 aa, Methanosarcina mazei Go1; identical to SEQ ID NO: 27942

SEQ ID NO: 54785 - DNA, 1128 bp, Methanosarcina mazei Go1; identical to SEQ ID NO: 27943
  CDS (1)..(1128): transl_table=11

SEQ ID NO: 54786 - protein, 375 aa, Methanosarcina mazei Go1; identical to SEQ ID NO: 27944

SEQ ID NO: 54787 - DNA, 1008 bp, Xanthomonas axonopodis pv. citri str. 306; identical to SEQ ID NO: 27945
  CDS (1)..(1008): transl_table=11

SEQ ID NO: 54788 - protein, 335 aa, Xanthomonas axonopodis pv. citri str. 306; identical to SEQ ID NO: 27946

SEQ ID NO: 54789 - DNA, 1305 bp, Yersinia pestis KIM; identical to SEQ ID NO: 27947
  CDS (1)..(1305): transl_table=11

SEQ ID NO: 54790 - protein, 434 aa, Yersinia pestis KIM; identical to SEQ ID NO: 27948

SEQ ID NO: 54791 - DNA, 1077 bp, Thermosynechococcus elongatus BP-1; identical to SEQ ID NO: 27949
  CDS (1)..(1077): transl_table=11

SEQ ID NO: 54792 - protein, 358 aa, Thermosynechococcus elongatus BP-1; identical to SEQ ID NO: 27950

SEQ ID NO: 54793 - DNA, 1269 bp, Oceanobacillus iheyensis HTE831; identical to SEQ ID NO: 27951
  CDS (1)..(1269): transl_table=11

SEQ ID NO: 54794 - protein, 422 aa, Oceanobacillus iheyensis HTE831; identical to SEQ ID NO: 27952

SEQ ID NO: 54795 - DNA, 1008 bp, Shewanella oneidensis MR-1; identical to SEQ ID NO: 27953
  CDS (1)..(1008): transl_table=11

SEQ ID NO: 54796 - protein, 335 aa, Shewanella oneidensis MR-1; identical to SEQ ID NO: 27954

SEQ ID NO: 54797 - DNA, 2160 bp, Drosophila melanogaster; identical to SEQ ID NO: 27955
  CDS (1)..(2160)

SEQ ID NO: 54798 - protein, 719 aa, Drosophila melanogaster; identical to SEQ ID NO: 27956

SEQ ID NO: 54799 - DNA, 1257 bp, Pseudomonas putida KT2440; identical to SEQ ID NO: 27957
  CDS (1)..(1257): transl_table=11

SEQ ID NO: 54800 - protein, 418 aa, Pseudomonas putida KT2440; identical to SEQ ID NO: 27958

SEQ ID NO: 54801 - DNA, 1008 bp, Xylella fastidiosa Temecula1; identical to SEQ ID NO: 27959
  CDS (1)..(1008): transl_table=11

SEQ ID NO: 54802 - protein, 335 aa, Xylella fastidiosa Temecula1; identical to SEQ ID NO: 27960

SEQ ID NO: 54803 - DNA, 1191 bp, Bacteroides thetaiotaomicron VPI-5482; identical to SEQ ID NO: 27961
  CDS (1)..(1191): transl_table=11

SEQ ID NO: 54804 - protein, 396 aa, Bacteroides thetaiotaomicron VPI-5482; identical to SEQ ID NO: 27962

SEQ ID NO: 54805 - DNA, 1284 bp, Coxiella burnetii RSA 493; identical to SEQ ID NO: 27963
  CDS (1)..(1284): transl_table=11

SEQ ID NO: 54806 - protein, 427 aa, Coxiella burnetii RSA 493; identical to SEQ ID NO: 27964

SEQ ID NO: 54807 - DNA, 1248 bp, Nitrosomonas europaea ATCC 19718; identical to SEQ ID NO: 27965
  CDS (1)..(1248): transl_table=11

SEQ ID NO: 54808 - protein, 415 aa, Nitrosomonas europaea ATCC 19718; identical to SEQ ID NO: 27966

SEQ ID NO: 54809 - DNA, 1092 bp, Arabidopsis thaliana; identical to SEQ ID NO: 27967
  CDS (1)..(1092)

SEQ ID NO: 54810 - protein, 363 aa, Arabidopsis thaliana; identical to SEQ ID NO: 27968

SEQ ID NO: 54811 - DNA, 1125 bp, Arabidopsis thaliana; identical to SEQ ID NO: 27969
  CDS (1)..(1125)

SEQ ID NO: 54812 - protein, 374 aa, Arabidopsis thaliana; identical to SEQ ID NO: 27970

SEQ ID NO: 54813 - DNA, 1425 bp, Prochlorococcus marinus subsp. marinus str. CCMP1375; identical to SEQ ID NO: 27971
  CDS (1)..(1425): transl_table=11

SEQ ID NO: 54814 - protein, 474 aa, Prochlorococcus marinus subsp. marinus str. CCMP1375; identical to SEQ ID NO: 27972

SEQ ID NO: 54815 - DNA, 1257 bp, Bordetella parapertussis 12822; identical to SEQ ID NO: 27973
  CDS (1)..(1257): transl_table=11

SEQ ID NO: 54816 - protein, 418 aa, Bordetella parapertussis 12822; identical to SEQ ID NO: 27974

SEQ ID NO: 54817 - DNA, 1257 bp, Bordetella bronchiseptica RB50; identical to SEQ ID NO: 27975
  CDS (1)..(1257): transl_table=11

SEQ ID NO: 54818 - protein, 418 aa, Bordetella bronchiseptica RB50; identical to SEQ ID NO: 27976

SEQ ID NO: 54819 - DNA, 1425 bp, Prochlorococcus marinus subsp. pastoris str. CCMP1986; identical to SEQ ID NO: 27977
  CDS (1)..(1425): transl_table=11

SEQ ID NO: 54820 - protein, 474 aa, Prochlorococcus marinus subsp. pastoris str. CCMP1986; identical to SEQ ID NO: 27978

SEQ ID NO: 54821 - DNA, 1425 bp, Prochlorococcus marinus str. MIT 9313; identical to SEQ ID NO: 27979
  CDS (1)..(1425): transl_table=11

SEQ ID NO: 54822 - protein, 474 aa, Prochlorococcus marinus str. MIT 9313; identical to SEQ ID NO: 27980

SEQ ID NO: 54823 - DNA, 1425 bp, Synechococcus sp. WH 8102; identical to SEQ ID NO: 27981
  CDS (1)..(1425): transl_table=11

SEQ ID NO: 54824 - protein, 474 aa, Synechococcus sp. WH 8102; identical to SEQ ID NO: 27982

SEQ ID NO: 54825 - DNA, 1293 bp, Wolinella succinogenes DSM 1740; identical to SEQ ID NO: 27983
  CDS (1)..(1293): transl_table=11

SEQ ID NO: 54826 - protein, 430 aa, Wolinella succinogenes DSM 1740; identical to SEQ ID NO: 27984

SEQ ID NO: 54827 - DNA, 1089 bp, Oryza sativa (japonica cultivar-group); identical to SEQ ID NO: 27985
  CDS (1)..(1089)

SEQ ID NO: 54828 - protein, 362 aa, Oryza sativa (japonica cultivar-group); identical to SEQ ID NO: 27986

SEQ ID NO: 54829 - DNA, 1080 bp, Gloeobacter violaceus PCC 7421; identical to SEQ ID NO: 27987
  CDS (1)..(1080): transl_table=11

SEQ ID NO: 54830 - protein, 359 aa, Gloeobacter violaceus PCC 7421; identical to SEQ ID NO: 27988

SEQ ID NO: 54831 - DNA, 1254 bp, Photorhabdus luminescens subsp. laumondii TTO1; identical to SEQ ID NO: 27989
  CDS (1)..(1254): transl_table=11

SEQ ID NO: 54832 - protein, 417 aa, Photorhabdus luminescens subsp. laumondii TTO1; identical to SEQ ID NO: 27990

SEQ ID NO: 54833 - DNA, 1098 bp, Danio rerio; identical to SEQ ID NO: 27991
  CDS (1)..(1098)

SEQ ID NO: 54834 - protein, 365 aa, Danio rerio; identical to SEQ ID NO: 27992

SEQ ID NO: 54835 - DNA, 1419 bp, Wolbachia endosymbiont of Drosophila melanogaster; identical to SEQ ID NO: 27993
  CDS (1)..(1419): transl_table=11

SEQ ID NO: 54836 - protein, 472 aa, Wolbachia endosymbiont of Drosophila melanogaster; identical to SEQ ID NO: 27994

SEQ ID NO: 54837 - DNA, 1002 bp, Bdellovibrio bacteriovorus HD100; identical to SEQ ID NO: 27995
  CDS (1)..(1002): transl_table=11

SEQ ID NO: 54838 - protein, 333 aa, Bdellovibrio bacteriovorus HD100; identical to SEQ ID NO: 27996

SEQ ID NO: 54839 - DNA, 1308 bp, Bacillus cereus ATCC 10987; identical to SEQ ID NO: 27997
  CDS (1)..(1308): transl_table=11

SEQ ID NO: 54840 - protein, 435 aa, Bacillus cereus ATCC 10987; identical to SEQ ID NO: 27998

SEQ ID NO: 54841 - DNA, 1104 bp, Eremothecium gossypii; identical to SEQ ID NO: 27999
  CDS (1)..(1104)

SEQ ID NO: 54842 - protein, 367 aa, Eremothecium gossypii; identical to SEQ ID NO: 28000

SEQ ID NO: 54843 - DNA, 1104 bp, Eremothecium gossypii; identical to SEQ ID NO: 28001
  CDS (1)..(1104)

SEQ ID NO: 54844 - protein, 367 aa, Eremothecium gossypii; identical to SEQ ID NO: 28002

SEQ ID NO: 54845 - DNA, 993 bp, Methanococcus maripaludis S2; identical to SEQ ID NO: 28003
  CDS (1)..(993): transl_table=11

SEQ ID NO: 54846 - protein, 330 aa, Methanococcus maripaludis S2; identical to SEQ ID NO: 28004

SEQ ID NO: 54847 - DNA, 1020 bp, Methanococcus maripaludis S2; identical to SEQ ID NO: 28005
  CDS (1)..(1020): transl_table=11

SEQ ID NO: 54848 - protein, 339 aa, Methanococcus maripaludis S2; identical to SEQ ID NO: 28006

SEQ ID NO: 54849 - DNA, 1101 bp, Xenopus tropicalis; identical to SEQ ID NO: 28007
  CDS (1)..(1101)

SEQ ID NO: 54850 - protein, 366 aa, Xenopus tropicalis; identical to SEQ ID NO: 28008

SEQ ID NO: 54851 - DNA, 1161 bp, Ustilago maydis 521; identical to SEQ ID NO: 28009
  CDS (1)..(1161)

SEQ ID NO: 54852 - protein, 386 aa, Ustilago maydis 521; identical to SEQ ID NO: 28010

SEQ ID NO: 54853 - DNA, 1467 bp, Leptospira interrogans serovar Copenhageni str. Fiocruz L1-130; identical to SEQ ID NO: 28011
  CDS (1)..(1467): transl_table=11

SEQ ID NO: 54854 - protein, 488 aa, Leptospira interrogans serovar Copenhageni str. Fiocruz L1-130; identical to SEQ ID NO: 28012

SEQ ID NO: 54855 - DNA, 1005 bp, Thermus thermophilus HB27; identical to SEQ ID NO: 28013
  CDS (1)..(1005): transl_table=11

SEQ ID NO: 54856 - protein, 334 aa, Thermus thermophilus HB27; identical to SEQ ID NO: 28014

SEQ ID NO: 54857 - DNA, 1491 bp, Thermus thermophilus HB27; identical to SEQ ID NO: 28015
  CDS (1)..(1491): transl_table=11

SEQ ID NO: 54858 - protein, 496 aa, Thermus thermophilus HB27; identical to SEQ ID NO: 28016

SEQ ID NO: 54859 - DNA, 1452 bp, Parachlamydia sp. UWE25; identical to SEQ ID NO: 28017
  CDS (1)..(1452): transl_table=11

SEQ ID NO: 54860 - protein, 483 aa, Parachlamydia sp. UWE25; identical to SEQ ID NO: 28018

SEQ ID NO: 54861 - DNA, 1263 bp, Listeria monocytogenes str. 4b F2365; identical to SEQ ID NO: 28019
  CDS (1)..(1263): transl_table=11

SEQ ID NO: 54862 - protein, 420 aa, Listeria monocytogenes str. 4b F2365; identical to SEQ ID NO: 28020

SEQ ID NO: 54863 - DNA, 1179 bp, Picrophilus torridus DSM 9790; identical to SEQ ID NO: 28021
  CDS (1)..(1179): transl_table=11

SEQ ID NO: 54864 - protein, 392 aa, Picrophilus torridus DSM 9790; identical to SEQ ID NO: 28022

SEQ ID NO: 54865 - DNA, 1308 bp, Bacillus anthracis str. Sterne; identical to SEQ ID NO: 28023
  CDS (1)..(1308): transl_table=11

SEQ ID NO: 54866 - protein, 435 aa, Bacillus anthracis str. Sterne; identical to SEQ ID NO: 28024

SEQ ID NO: 54867 - DNA, 1311 bp, Acinetobacter sp. ADP1; identical to SEQ ID NO: 28025
  CDS (1)..(1311): transl_table=11

SEQ ID NO: 54868 - protein, 436 aa, Acinetobacter sp. ADP1; identical to SEQ ID NO: 28026

SEQ ID NO: 54869 - DNA, 1254 bp, Erwinia carotovora subsp. atroseptica SCRI1043; identical to SEQ ID NO: 28027
  CDS (1)..(1254): transl_table=11

SEQ ID NO: 54870 - protein, 417 aa, Erwinia carotovora subsp. atroseptica SCRI1043; identical to SEQ ID NO: 28028

SEQ ID NO: 54871 - DNA, 1254 bp, Yersinia pseudotuberculosis IP 32953; identical to SEQ ID NO: 28029
  CDS (1)..(1254): transl_table=11

SEQ ID NO: 54872 - protein, 417 aa, Yersinia pseudotuberculosis IP 32953; identical to SEQ ID NO: 28030

SEQ ID NO: 54873 - DNA, 1266 bp, Symbiobacterium thermophilum IAM 14863; identical to SEQ ID NO: 28031
  CDS (1)..(1266): transl_table=11

SEQ ID NO: 54874 - protein, 421 aa, Symbiobacterium thermophilum IAM 14863; identical to SEQ ID NO: 28032

SEQ ID NO: 54875 - DNA, 1317 bp, Bacillus licheniformis ATCC 14580; identical to SEQ ID NO: 28033
  CDS (1)..(1317): transl_table=11

SEQ ID NO: 54876 - protein, 438 aa, Bacillus licheniformis ATCC 14580; identical to SEQ ID NO: 28034

SEQ ID NO: 54877 - DNA, 1248 bp, Mannheimia succiniciproducens MBEL55E; identical to SEQ ID NO: 28035
  CDS (1)..(1248): transl_table=11

SEQ ID NO: 54878 - protein, 415 aa, Mannheimia succiniciproducens MBEL55E; identical to SEQ ID NO: 28036

SEQ ID NO: 54879 - DNA, 1191 bp, Bacteroides fragilis YCH46; identical to SEQ ID NO: 28037
  CDS (1)..(1191): transl_table=11

SEQ ID NO: 54880 - protein, 396 aa, Bacteroides fragilis YCH46; identical to SEQ ID NO: 28038

SEQ ID NO: 54881 - DNA, 1023 bp, Methylococcus capsulatus str. Bath; identical to SEQ ID NO: 28039
  CDS (1)..(1023): transl_table=11

SEQ ID NO: 54882 - protein, 340 aa, Methylococcus capsulatus str. Bath; identical to SEQ ID NO: 28040

SEQ ID NO: 54883 - DNA, 1257 bp, Legionella pneumophila str. Lens; identical to SEQ ID NO: 28041
  CDS (1)..(1257): transl_table=11

SEQ ID NO: 54884 - protein, 418 aa, Legionella pneumophila str. Lens; identical to SEQ ID NO: 28042

SEQ ID NO: 54885 - DNA, 1254 bp, Photobacterium profundum SS9; identical to SEQ ID NO: 28043
  CDS (1)..(1254): transl_table=11

SEQ ID NO: 54886 - protein, 417 aa, Photobacterium profundum SS9; identical to SEQ ID NO: 28044

SEQ ID NO: 54887 - DNA, 984 bp, Haloarcula marismortui ATCC 43049; identical to SEQ ID NO: 28045
  CDS (1)..(984): transl_table=11

SEQ ID NO: 54888 - protein, 327 aa, Haloarcula marismortui ATCC 43049; identical to SEQ ID NO: 28046

SEQ ID NO: 54889 - DNA, 1263 bp, Haloarcula marismortui ATCC 43049; identical to SEQ ID NO: 28047
  CDS (1)..(1263): transl_table=11

SEQ ID NO: 54890 - protein, 420 aa, Haloarcula marismortui ATCC 43049; identical to SEQ ID NO: 28048

SEQ ID NO: 54891 - DNA, 1176 bp, Streptococcus thermophilus LMG 18311; identical to SEQ ID NO: 28049
  CDS (1)..(1176): transl_table=11

SEQ ID NO: 54892 - protein, 391 aa, Streptococcus thermophilus LMG 18311; identical to SEQ ID NO: 28050

SEQ ID NO: 54893 - DNA, 1272 bp, Geobacillus kaustophilus HTA426; identical to SEQ ID NO: 28051
  CDS (1)..(1272): transl_table=11

SEQ ID NO: 54894 - protein, 423 aa, Geobacillus kaustophilus HTA426; identical to SEQ ID NO: 28052

SEQ ID NO: 54895 - DNA, 1467 bp, Anaplasma marginale str. St. Maries; identical to SEQ ID NO: 28053
  CDS (1)..(1467): transl_table=11

SEQ ID NO: 54896 - protein, 488 aa, Anaplasma marginale str. St. Maries; identical to SEQ ID NO: 28054

SEQ ID NO: 54897 - DNA, 1005 bp, Idiomarina loihiensis L2TR; identical to SEQ ID NO: 28055
  CDS (1)..(1005): transl_table=11

SEQ ID NO: 54898 - protein, 334 aa, Idiomarina loihiensis L2TR; identical to SEQ ID NO: 28056

SEQ ID NO: 54899 - DNA, 1263 bp, Zymomonas mobilis subsp. mobilis ZM4; identical to SEQ ID NO: 28057
  CDS (1)..(1263): transl_table=11

SEQ ID NO: 54900 - protein, 420 aa, Zymomonas mobilis subsp. mobilis ZM4; identical to SEQ ID NO: 28058

SEQ ID NO: 54901 - DNA, 1428 bp, Synechococcus elongatus PCC 6301; identical to SEQ ID NO: 28059
  CDS (1)..(1428): transl_table=11

SEQ ID NO: 54902 - protein, 475 aa, Synechococcus elongatus PCC 6301; identical to SEQ ID NO: 28060

SEQ ID NO: 54903 - DNA, 1266 bp, Bacillus clausii KSM-K16; identical to SEQ ID NO: 28061
  CDS (1)..(1266): transl_table=11

SEQ ID NO: 54904 - protein, 421 aa, Bacillus clausii KSM-K16; identical to SEQ ID NO: 28062

SEQ ID NO: 54905 - DNA, 1080 bp, Dehalococcoides ethenogenes 195; identical to SEQ ID NO: 28063
  CDS (1)..(1080): transl_table=11

SEQ ID NO: 54906 - protein, 359 aa, Dehalococcoides ethenogenes 195; identical to SEQ ID NO: 28064

SEQ ID NO: 54907 - DNA, 1023 bp, Gluconobacter oxydans 621H; identical to SEQ ID NO: 28065
  CDS (1)..(1023): transl_table=11

SEQ ID NO: 54908 - protein, 340 aa, Gluconobacter oxydans 621H; identical to SEQ ID NO: 28066

SEQ ID NO: 54909 - DNA, 1452 bp, Ehrlichia ruminantium str. Gardel; identical to SEQ ID NO: 28067
  CDS (1)..(1452): transl_table=11

SEQ ID NO: 54910 - protein, 483 aa, Ehrlichia ruminantium str. Gardel; identical to SEQ ID NO: 28068

SEQ ID NO: 54911 - DNA, 1428 bp, Wolbachia endosymbiont strain TRS of Brugia malayi; identical to SEQ ID NO: 28069
  CDS (1)..(1428): transl_table=11

SEQ ID NO: 54912 - protein, 475 aa, Wolbachia endosymbiont strain TRS of Brugia malayi; identical to SEQ ID NO: 28070

SEQ ID NO: 54913 - DNA, 1209 bp, Xanthomonas oryzae pv. oryzae KACC10331; identical to SEQ ID NO: 28071
  CDS (1)..(1209): transl_table=11

SEQ ID NO: 54914 - protein, 402 aa, Xanthomonas oryzae pv. oryzae KACC10331; identical to SEQ ID NO: 28072

SEQ ID NO: 54915 - DNA, 1191 bp, Bacteroides fragilis NCTC 9343; identical to SEQ ID NO: 28073
  CDS (1)..(1191): transl_table=11

SEQ ID NO: 54916 - protein, 396 aa, Bacteroides fragilis NCTC 9343; identical to SEQ ID NO: 28074

SEQ ID NO: 54917 - DNA, 1008 bp, Xanthomonas campestris pv. campestris str. 8004; identical to SEQ ID NO: 28075
  CDS (1)..(1008): transl_table=11

SEQ ID NO: 54918 - protein, 335 aa, Xanthomonas campestris pv. campestris str. 8004; identical to SEQ ID NO: 28076

SEQ ID NO: 54919 - DNA, 1476 bp, Rickettsia felis URRWXCal2; identical to SEQ ID NO: 28077
  CDS (1)..(1476): transl_table=11

SEQ ID NO: 54920 - protein, 491 aa, Rickettsia felis URRWXCal2; identical to SEQ ID NO: 28078

SEQ ID NO: 54921 - DNA, 1269 bp, Staphylococcus haemolyticus JCSC1435; identical to SEQ ID NO: 28079
  CDS (1)..(1269): transl_table=11

SEQ ID NO: 54922 - protein, 422 aa, Staphylococcus haemolyticus JCSC1435; identical to SEQ ID NO: 28080

SEQ ID NO: 54923 - DNA, 1236 bp, Sulfolobus acidocaldarius DSM 639; identical to SEQ ID NO: 28081
  CDS (1)..(1236): transl_table=11

SEQ ID NO: 54924 - protein, 411 aa, Sulfolobus acidocaldarius DSM 639; identical to SEQ ID NO: 28082

SEQ ID NO: 54925 - DNA, 1257 bp, Pseudomonas fluorescens Pf-5; identical to SEQ ID NO: 28083
  CDS (1)..(1257): transl_table=11

SEQ ID NO: 54926 - protein, 418 aa, Pseudomonas fluorescens Pf-5; identical to SEQ ID NO: 28084

SEQ ID NO: 54927 - DNA, 1251 bp, Colwellia psychrerythraea 34H; identical to SEQ ID NO: 28085
  CDS (1)..(1251): transl_table=11

SEQ ID NO: 54928 - protein, 416 aa, Colwellia psychrerythraea 34H; identical to SEQ ID NO: 28086

SEQ ID NO: 54929 - DNA, 1008 bp, Colwellia psychrerythraea 34H; identical to SEQ ID NO: 28087
  CDS (1)..(1008): transl_table=11

SEQ ID NO: 54930 - protein, 335 aa, Colwellia psychrerythraea 34H; identical to SEQ ID NO: 28088

SEQ ID NO: 54931 - DNA, 1242 bp, Dechloromonas aromatica RCB; identical to SEQ ID NO: 28089
  CDS (1)..(1242): transl_table=11

SEQ ID NO: 54932 - protein, 413 aa, Dechloromonas aromatica RCB; identical to SEQ ID NO: 28090

SEQ ID NO: 54933 - DNA, 1425 bp, Prochlorococcus marinus str. NATL2A; identical to SEQ ID NO: 28091
  CDS (1)..(1425): transl_table=11

SEQ ID NO: 54934 - protein, 474 aa, Prochlorococcus marinus str. NATL2A; identical to SEQ ID NO: 28092

SEQ ID NO: 54935 - DNA, 1251 bp, Ralstonia eutropha JMP134; identical to SEQ ID NO: 28093
  CDS (1)..(1251): transl_table=11

SEQ ID NO: 54936 - protein, 416 aa, Ralstonia eutropha JMP134; identical to SEQ ID NO: 28094

SEQ ID NO: 54937 - DNA, 1266 bp, Staphylococcus saprophyticus subsp. saprophyticus ATCC 15305; identical to SEQ ID NO: 28095
  CDS (1)..(1266): transl_table=11

SEQ ID NO: 54938 - protein, 421 aa, Staphylococcus saprophyticus subsp. saprophyticus ATCC 15305; identical to SEQ ID NO: 28096

SEQ ID NO: 54939 - DNA, 1449 bp, Ehrlichia canis str. Jake; identical to SEQ ID NO: 28097
  CDS (1)..(1449): transl_table=11

SEQ ID NO: 54940 - protein, 482 aa, Ehrlichia canis str. Jake; identical to SEQ ID NO: 28098

SEQ ID NO: 54941 - DNA, 1080 bp, Dehalococcoides sp. CBDB1; identical to SEQ ID NO: 28099
  CDS (1)..(1080): transl_table=11

SEQ ID NO: 54942 - protein, 359 aa, Dehalococcoides sp. CBDB1; identical to SEQ ID NO: 28100

SEQ ID NO: 54943 - DNA, 1242 bp, Thiobacillus denitrificans ATCC 25259; identical to SEQ ID NO: 28101
  CDS (1)..(1242): transl_table=11

SEQ ID NO: 54944 - protein, 413 aa, Thiobacillus denitrificans ATCC 25259; identical to SEQ ID NO: 28102

SEQ ID NO: 54945 - DNA, 1149 bp, Desulfovibrio desulfuricans G20; identical to SEQ ID NO: 28103
  CDS (1)..(1149)

SEQ ID NO: 54946 - protein, 382 aa, Desulfovibrio desulfuricans G20; identical to SEQ ID NO: 28104

SEQ ID NO: 54947 - DNA, 1257 bp, Burkholderia cepacia R18194; identical to SEQ ID NO: 28105
  CDS (1)..(1257)

SEQ ID NO: 54948 - protein, 418 aa, Burkholderia cepacia R18194; identical to SEQ ID NO: 28106

SEQ ID NO: 54949 - DNA, 1269 bp, Pseudomonas fluorescens PfO-1; identical to SEQ ID NO: 28107
  CDS (1)..(1269)

SEQ ID NO: 54950 - protein, 422 aa, Pseudomonas fluorescens PfO-1; identical to SEQ ID NO: 28108

SEQ ID NO: 54951 - DNA, 1257 bp, Burkholderia fungorum LB400; identical to SEQ ID NO: 28109
  CDS (1)..(1257)

SEQ ID NO: 54952 - protein, 418 aa, Burkholderia fungorum LB400; identical to SEQ ID NO: 28110

SEQ ID NO: 54953 - DNA, 1239 bp, Lactococcus lactis subsp. cremoris SK11; identical to SEQ ID NO: 28111
  CDS (1)..(1239)

SEQ ID NO: 54954 - protein, 412 aa, Lactococcus lactis subsp. cremoris SK11; identical to SEQ ID NO: 28112

SEQ ID NO: 54955 - DNA, 1176 bp, Streptococcus thermophilus LMD-9; identical to SEQ ID NO: 28113
  CDS (1)..(1176)

SEQ ID NO: 54956 - protein, 391 aa, Streptococcus thermophilus LMD-9; identical to SEQ ID NO: 28114

SEQ ID NO: 54957 - DNA, 1257 bp, Burkholderia vietnamiensis G4; identical to SEQ ID NO: 28115
  CDS (1)..(1257): transl_table=11

SEQ ID NO: 54958 - protein, 418 aa, Burkholderia vietnamiensis G4; identical to SEQ ID NO: 28116

SEQ ID NO: 54959 - DNA, 1260 bp, Burkholderia pseudomallei 668; identical to SEQ ID NO: 28117
  CDS (1)..(1260)

SEQ ID NO: 54960 - protein, 419 aa, Burkholderia pseudomallei 668; identical to SEQ ID NO: 28118

SEQ ID NO: 54961 - DNA, 1491 bp, Crocosphaera watsonii WH 8501; identical to SEQ ID NO: 28119
  CDS (1)..(1491): transl_table=11

SEQ ID NO: 54962 - protein, 496 aa, Crocosphaera watsonii WH 8501; identical to SEQ ID NO: 28120

SEQ ID NO: 54963 - DNA, 1242 bp, Methylobacillus flagellatus KT; identical to SEQ ID NO: 28121
  CDS (1)..(1242): transl_table=11

SEQ ID NO: 54964 - protein, 413 aa, Methylobacillus flagellatus KT; identical to SEQ ID NO: 28122

SEQ ID NO: 54965 - DNA, 1011 bp, Moorella thermoacetica ATCC 39073; identical to SEQ ID NO: 28123
  CDS (1)..(1011): transl_table=11

SEQ ID NO: 54966 - protein, 336 aa, Moorella thermoacetica ATCC 39073; identical to SEQ ID NO: 28124

SEQ ID NO: 54967 - DNA, 1251 bp, Ralstonia metallidurans CH34; identical to SEQ ID NO: 28125
  CDS (1)..(1251): transl_table=11

SEQ ID NO: 54968 - protein, 416 aa, Ralstonia metallidurans CH34; identical to SEQ ID NO: 28126

SEQ ID NO: 54969 - DNA, 1173 bp, Rubrobacter xylanophilus DSM 9941; identical to SEQ ID NO: 28127
  CDS (1)..(1173): transl_table=11

SEQ ID NO: 54970 - protein, 390 aa, Rubrobacter xylanophilus DSM 9941; identical to SEQ ID NO: 28128

SEQ ID NO: 54971 - DNA, 1179 bp, Ferroplasma acidarmanus Fer1; identical to SEQ ID NO: 28129
  CDS (1)..(1179): transl_table=11

SEQ ID NO: 54972 - protein, 392 aa, Ferroplasma acidarmanus Fer1; identical to SEQ ID NO: 28130

SEQ ID NO: 54973 - DNA, 1260 bp, Psychrobacter cryohalolentis K5; identical to SEQ ID NO: 28131
  CDS (1)..(1260): transl_table=11

SEQ ID NO: 54974 - protein, 419 aa, Psychrobacter cryohalolentis K5; identical to SEQ ID NO: 28132

SEQ ID NO: 54975 - DNA, 1236 bp, Syntrophobacter fumaroxidans MPOB; identical to SEQ ID NO: 28133
  CDS (1)..(1236): transl_table=11

SEQ ID NO: 54976 - protein, 411 aa, Syntrophobacter fumaroxidans MPOB; identical to SEQ ID NO: 28134

SEQ ID NO: 54977 - DNA, 1248 bp, Nitrosomonas eutropha C71; identical to SEQ ID NO: 28135
  CDS (1)..(1248): transl_table=11

SEQ ID NO: 54978 - protein, 415 aa, Nitrosomonas eutropha C71; identical to SEQ ID NO: 28136

SEQ ID NO: 54979 - DNA, 1419 bp, Trichodesmium erythraeum IMS101; identical to SEQ ID NO: 28137
  CDS (1)..(1419): transl_table=11

SEQ ID NO: 54980 - protein, 472 aa, Trichodesmium erythraeum IMS101; identical to SEQ ID NO: 28138

SEQ ID NO: 54981 - DNA, 1254 bp, Rhodoferax ferrireducens DSM 15236; identical to SEQ ID NO: 28139
  CDS (1)..(1254): transl_table=11

SEQ ID NO: 54982 - protein, 417 aa, Rhodoferax ferrireducens DSM 15236; identical to SEQ ID NO: 28140

SEQ ID NO: 54983 - DNA, 1278 bp, Bacillus israeli; identical to SEQ ID NO: 28141
  CDS (1)..(1278): transl_table=11

SEQ ID NO: 54984 - protein, 425 aa, Bacillus israeli; identical to SEQ ID NO: 28142

SEQ ID NO: 54985 - DNA, 1170 bp, Salmonella enterica I; identical to SEQ ID NO: 28143
  CDS (1)..(1170): transl_table=11

SEQ ID NO: 54986 - protein, 389 aa, Salmonella enterica I; identical to SEQ ID NO: 28144

SEQ ID NO: 54987 - DNA, 1170 bp, Salmonella enterica subsp; identical to SEQ ID NO: 28145
  CDS (1)..(1170): transl_table=11

SEQ ID NO: 54988 - protein, 389 aa, Salmonella enterica subsp; identical to SEQ ID NO: 28146

SEQ ID NO: 54989 - DNA, 1170 bp, Salmonella enterica subsp; identical to SEQ ID NO: 28147
  CDS (1)..(1170): transl_table=11

SEQ ID NO: 54990 - protein, 389 aa, Salmonella enterica subsp; identical to SEQ ID NO: 28148

SEQ ID NO: 54991 - DNA, 1170 bp, Salmonella bongori; identical to SEQ ID NO: 28149
  CDS (1)..(1170): transl_table=11

SEQ ID NO: 54992 - protein, 389 aa, Salmonella bongori; identical to SEQ ID NO: 28150

SEQ ID NO: 54993 - DNA, 1095 bp, Nicotiana tabacum; identical to SEQ ID NO: 28151
  CDS (1)..(1095)

SEQ ID NO: 54994 - protein, 364 aa, Nicotiana tabacum; identical to SEQ ID NO: 28152

SEQ ID NO: 54995 - DNA, 1104 bp, Arabidopsis thaliana; identical to SEQ ID NO: 28153
  CDS (1)..(1104)

SEQ ID NO: 54996 - protein, 367 aa, Arabidopsis thaliana; identical to SEQ ID NO: 28154

SEQ ID NO: 54997 - DNA, 1104 bp, Arabidopsis thaliana; identical to SEQ ID NO: 28155
  CDS (1)..(1104)

SEQ ID NO: 54998 - protein, 367 aa, Arabidopsis thaliana; identical to SEQ ID NO: 28156

SEQ ID NO: 54999 - DNA, 1281 bp, Thermus aquaticus; identical to SEQ ID NO: 28157
  CDS (1)..(1281): transl_table=11

SEQ ID NO: 55000 - protein, 426 aa, Thermus aquaticus; identical to SEQ ID NO: 28158

SEQ ID NO: 55001 - DNA, 1056 bp, Haemophilus parasuis; identical to SEQ ID NO: 28159
  CDS (1)..(1056): transl_table=11

SEQ ID NO: 55002 - protein, 351 aa, Haemophilus parasuis; identical to SEQ ID NO: 28160

SEQ ID NO: 55003 - DNA, 1278 bp, Leishmania major; identical to SEQ ID NO: 28161
  CDS (1)..(1278)

SEQ ID NO: 55004 - protein, 425 aa, Leishmania major; identical to SEQ ID NO: 28162

SEQ ID NO: 55005 - DNA, 1101 bp, Homo sapiens; identical to SEQ ID NO: 28163
  CDS (1)..(1101)

SEQ ID NO: 55006 - protein, 366 aa, Homo sapiens; identical to SEQ ID NO: 28164

SEQ ID NO: 55007 - DNA, 1113 bp, Gallus gallus; identical to SEQ ID NO: 28165
  CDS (1)..(1113)

SEQ ID NO: 55008 - protein, 370 aa, Gallus gallus; identical to SEQ ID NO: 28166

SEQ ID NO: 55009 - DNA, 1107 bp, Xenopus laevis; identical to SEQ ID NO: 28167
  CDS (1)..(1107)

SEQ ID NO: 55010 - protein, 368 aa, Xenopus laevis; identical to SEQ ID NO: 28168

SEQ ID NO: 55011 - DNA, 1023 bp, Thermoproteus tenax; identical to SEQ ID NO: 28169
  CDS (1)..(1023): transl_table=11

SEQ ID NO: 55012 - protein, 340 aa, Thermoproteus tenax; identical to SEQ ID NO: 28170

SEQ ID NO: 55013 - DNA, 1320 bp, Thermoproteus tenax; identical to SEQ ID NO: 28171
  CDS (1)..(1320): transl_table=11

SEQ ID NO: 55014 - protein, 439 aa, Thermoproteus tenax; identical to SEQ ID NO: 28172

SEQ ID NO: 55015 - DNA, 1266 bp, Hydrogenobacter thermophilus; identical to SEQ ID NO: 28173
  CDS (1)..(1266): transl_table=11

SEQ ID NO: 55016 - protein, 421 aa, Hydrogenobacter thermophilus; identical to SEQ ID NO: 28174

SEQ ID NO: 55017 - DNA, 975 bp, Halobacterium volcanii; identical to SEQ ID NO: 28175
  CDS (1)..(975): transl_table=11

SEQ ID NO: 55018 - protein, 324 aa, Halobacterium volcanii; identical to SEQ ID NO: 28176

SEQ ID NO: 55019 - DNA, 1098 bp, Brachydanio rerio; identical to SEQ ID NO: 28177
  CDS (1)..(1098)

SEQ ID NO: 55020 - protein, 365 aa, Brachydanio rerio; identical to SEQ ID NO: 28178

SEQ ID NO: 55021 - DNA, 1176 bp, Streptococcus thermophilus; identical to SEQ ID NO: 28179
  CDS (1)..(1176): transl_table=11

SEQ ID NO: 55022 - protein, 391 aa, Streptococcus thermophilus; identical to SEQ ID NO: 28180

SEQ ID NO: 55023 - DNA, 1299 bp, Myxococcus xanthus; identical to SEQ ID NO: 28181
  CDS (1)..(1299): n means a or g or c or t/u, s means g or c

SEQ ID NO: 55024 - protein, 432 aa, Myxococcus xanthus; identical to SEQ ID NO: 28182
  Xaa in positions 265 and 326 is unknown

SEQ ID NO: 55025 - DNA, 993 bp, Brassica napus; identical to SEQ ID NO: 28183
  CDS (1)..(993)

SEQ ID NO: 55026 - protein, 330 aa, Brassica napus; identical to SEQ ID NO: 28184

SEQ ID NO: 55027 - DNA, 1104 bp, Brassica napus; identical to SEQ ID NO: 28185
  CDS (1)..(1104)

SEQ ID NO: 55028 - protein, 367 aa, Brassica napus; identical to SEQ ID NO: 28186

SEQ ID NO: 55029 - DNA, 1104 bp, Brassica napus; identical to SEQ ID NO: 28187
  CDS (1)..(1104)

SEQ ID NO: 55030 - protein, 367 aa, Brassica napus; identical to SEQ ID NO: 28188

SEQ ID NO: 55031 - DNA, 1290 bp, Thiobacillus thiooxidans; identical to SEQ ID NO: 28189
  CDS (1)..(1290): transl_table=11

SEQ ID NO: 55032 - protein, 429 aa, Thiobacillus thiooxidans; identical to SEQ ID NO: 28190

SEQ ID NO: 55033 - DNA, 1329 bp, Alcaligenes eutrophus; identical to SEQ ID NO: 28191
  CDS (1)..(1329): transl_table=11

SEQ ID NO: 55034 - protein, 442 aa, Alcaligenes eutrophus; identical to SEQ ID NO: 28192

SEQ ID NO: 55035 - DNA, 1104 bp, Arabidopsis thaliana; identical to SEQ ID NO: 28193
  CDS (1)..(1104)

SEQ ID NO: 55036 - protein, 367 aa, Arabidopsis thaliana; identical to SEQ ID NO: 28194

SEQ ID NO: 55037 - DNA, 1125 bp, Arabidopsis thaliana; identical to SEQ ID NO: 28195
  CDS (1)..(1125)

SEQ ID NO: 55038 - protein, 374 aa, Arabidopsis thaliana; identical to SEQ ID NO: 28196

SEQ ID NO: 55039 - DNA, 1047 bp, Coccidioides immitis; identical to SEQ ID NO: 28197
  CDS (1)..(1047)

SEQ ID NO: 55040 - protein, 348 aa, Coccidioides immitis; identical to SEQ ID NO: 28198

SEQ ID NO: 55041 - DNA, 1218 bp, Thermoplasma acidophilum; identical to SEQ ID NO: 28199
  CDS (1)..(1218): transl_table=11

SEQ ID NO: 55042 - protein, 405 aa, Thermoplasma acidophilum; identical to SEQ ID NO: 28200

SEQ ID NO: 55043 - DNA, 1260 bp, Halobacterium volcanii; identical to SEQ ID NO: 28201
  CDS (1)..(1260): transl_table=11

SEQ ID NO: 55044 - protein, 419 aa, Halobacterium volcanii; identical to SEQ ID NO: 28202

SEQ ID NO: 55045 - DNA, 1182 bp, Escherichia coli; identical to SEQ ID NO: 28203
  CDS (1)..(1182): transl_table=11

SEQ ID NO: 55046 - protein, 393 aa, Escherichia coli; identical to SEQ ID NO: 28204

SEQ ID NO: 55047 - DNA, 1119 bp, Arabidopsis thaliana; identical to SEQ ID NO: 28205
  CDS (1)..(1119)

SEQ ID NO: 55048 - protein, 372 aa, Arabidopsis thaliana; identical to SEQ ID NO: 28206

SEQ ID NO: 55049 - DNA, 1284 bp, Coxiella burnetii; identical to SEQ ID NO: 28207
  CDS (1)..(1284): transl_table=11

SEQ ID NO: 55050 - protein, 427 aa, Coxiella burnetii; identical to SEQ ID NO: 28208

SEQ ID NO: 55051 - DNA, 1284 bp, Coxiella burnetii; identical to SEQ ID NO: 28209
  CDS (1)..(1284): transl_table=11

SEQ ID NO: 55052 - protein, 427 aa, Coxiella burnetii; identical to SEQ ID NO: 28210

SEQ ID NO: 55053 - DNA, 1284 bp, Coxiella burnetii; identical to SEQ ID NO: 28211
  CDS (1)..(1284): transl_table=11

SEQ ID NO: 55054 - protein, 427 aa, Coxiella burnetii; identical to SEQ ID NO: 28212

SEQ ID NO: 55055 - DNA, 1284 bp, Coxiella burnetii; identical to SEQ ID NO: 28213
  CDS (1)..(1284): transl_table=11

SEQ ID NO: 55056 - protein, 427 aa, Coxiella burnetii; identical to SEQ ID NO: 28214

SEQ ID NO: 55057 - DNA, 1074 bp, Nicotiana tabacum; identical to SEQ ID NO: 28215
  CDS (1)..(1074)

SEQ ID NO: 55058 - protein, 357 aa, Nicotiana tabacum; identical to SEQ ID NO: 28216

SEQ ID NO: 55059 - DNA, 1116 bp, Nicotiana tabacum; identical to SEQ ID NO: 28217
  CDS (1)..(1116)

SEQ ID NO: 55060 - protein, 371 aa, Nicotiana tabacum; identical to SEQ ID NO: 28218

SEQ ID NO: 55061 - DNA, 1044 bp, Methanococcus jannaschii; identical to SEQ ID NO: 28219
  CDS (1)..(1044): transl_table=11

SEQ ID NO: 55062 - protein, 347 aa, Methanococcus jannaschii; identical to SEQ ID NO: 28220

SEQ ID NO: 55063 - DNA, 1167 bp, Ajellomyces capsulata; identical to SEQ ID NO: 28221
  CDS (1)..(1167)

SEQ ID NO: 55064 - protein, 388 aa, Ajellomyces capsulata; identical to SEQ ID NO: 28222

SEQ ID NO: 55065 - DNA, 1248 bp, Colwellia maris; identical to SEQ ID NO: 28223
  CDS (1)..(1248)

SEQ ID NO: 55066 - protein, 415 aa, Colwellia maris; identical to SEQ ID NO: 28224

SEQ ID NO: 55067 - DNA, 1086 bp, Kluyveromyces lactis; identical to SEQ ID NO: 28225
  CDS (1)..(1086)

SEQ ID NO: 55068 - protein, 361 aa, Kluyveromyces lactis; identical to SEQ ID NO: 28226

SEQ ID NO: 55069 - DNA, 1071 bp, Schizosaccharomyces pombe; identical to SEQ ID NO: 28227
  CDS (1)..(1071)

SEQ ID NO: 55070 - protein, 356 aa, Schizosaccharomyces pombe; identical to SEQ ID NO: 28228

SEQ ID NO: 55071 - DNA, 1107 bp, Kluyveromyces lactis; identical to SEQ ID NO: 28229
  CDS (1)..(1107)

SEQ ID NO: 55072 - protein, 368 aa, Kluyveromyces lactis; identical to SEQ ID NO: 28230

SEQ ID NO: 55073 - DNA, 1137 bp, Schizosaccharomyces pombe; identical to SEQ ID NO: 28231
  CDS (1)..(1137)

SEQ ID NO: 55074 - protein, 378 aa, Schizosaccharomyces pombe; identical to SEQ ID NO: 28232

SEQ ID NO: 55075 - DNA, 1110 bp, Saccharomyces cerevisiae; identical to SEQ ID NO: 28233
  CDS (1)..(1110)

SEQ ID NO: 55076 - protein, 369 aa, Saccharomyces cerevisiae; identical to SEQ ID NO: 28234

SEQ ID NO: 55077 - DNA, 1101 bp, Bos taurus; identical to SEQ ID NO: 28235
  CDS (1)..(1101)

SEQ ID NO: 55078 - protein, 366 aa, Bos taurus; identical to SEQ ID NO: 28236

SEQ ID NO: 55079 - DNA, 1077 bp, Caenorhabditis elegans; identical to SEQ ID NO: 28237
  CDS (1)..(1077)

SEQ ID NO: 55080 - protein, 358 aa, Caenorhabditis elegans; identical to SEQ ID NO: 28238

SEQ ID NO: 55081 - DNA, 1134 bp, Drosophila melanogaster; identical to SEQ ID NO: 28239
  CDS (1)..(1134)

SEQ ID NO: 55082 - protein, 377 aa, Drosophila melanogaster; identical to SEQ ID NO: 28240

SEQ ID NO: 55083 - DNA, 1101 bp, Homo sapiens; identical to SEQ ID NO: 28241
  CDS (1)..(1101)

SEQ ID NO: 55084 - protein, 366 aa, Homo sapiens; identical to SEQ ID NO: 28242

SEQ ID NO: 55085 - DNA, 1101 bp, Mus musculus; identical to SEQ ID NO: 28243
  CDS (1)..(1101)

SEQ ID NO: 55086 - protein, 366 aa, Mus musculus; identical to SEQ ID NO: 28244

SEQ ID NO: 55087 - DNA, 1422 bp, Anabaena sp; identical to SEQ ID NO: 28245
  CDS (1)..(1422): transl_table=11

SEQ ID NO: 55088 - protein, 473 aa, Anabaena sp; identical to SEQ ID NO: 28246

SEQ ID NO: 55089 - DNA, 1281 bp, Aquifex aeolicus; identical to SEQ ID NO: 28247
  CDS (1)..(1281): transl_table=11

SEQ ID NO: 55090 - protein, 426 aa, Aquifex aeolicus; identical to SEQ ID NO: 28248

SEQ ID NO: 55091 - DNA, 1239 bp, Archaeoglobus fulgidus; identical to SEQ ID NO: 28249
  CDS (1)..(1239): transl_table=11

SEQ ID NO: 55092 - protein, 412 aa, Archaeoglobus fulgidus; identical to SEQ ID NO: 28250

SEQ ID NO: 55093 - DNA, 1272 bp, Bacillus subtilis; identical to SEQ ID NO: 28251
  CDS (1)..(1272): transl_table=11

SEQ ID NO: 55094 - protein, 423 aa, Bacillus subtilis; identical to SEQ ID NO: 28252

SEQ ID NO: 55095 - DNA, 1290 bp, Caldococcus noboribetus; identical to SEQ ID NO: 28253
  CDS (1)..(1290): transl_table=11

SEQ ID NO: 55096 - protein, 429 aa, Caldococcus noboribetus; identical to SEQ ID NO: 28254

SEQ ID NO: 55097 - DNA, 1278 bp, Helicobacter pylori J99; identical to SEQ ID NO: 28255
  CDS (1)..(1278): transl_table=11

SEQ ID NO: 55098 - protein, 425 aa, Helicobacter pylori J99; identical to SEQ ID NO: 28256

SEQ ID NO: 55099 - DNA, 1278 bp, Helicobacter pylori; identical to SEQ ID NO: 28257
  CDS (1)..(1278): transl_table=11

SEQ ID NO: 55100 - protein, 425 aa, Helicobacter pylori; identical to SEQ ID NO: 28258

SEQ ID NO: 55101 - DNA, 1452 bp, Rickettsia conorii; identical to SEQ ID NO: 28259
  CDS (1)..(1452): transl_table=11

SEQ ID NO: 55102 - protein, 483 aa, Rickettsia conorii; identical to SEQ ID NO: 28260

SEQ ID NO: 55103 - DNA, 1452 bp, Rickettsia prowazekii; identical to SEQ ID NO: 28261
  CDS (1)..(1452): transl_table=11

SEQ ID NO: 55104 - protein, 483 aa, Rickettsia prowazekii; identical to SEQ ID NO: 28262

SEQ ID NO: 55105 - DNA, 1452 bp, Rickettsia typhi; identical to SEQ ID NO: 28263
  CDS (1)..(1452): transl_table=11

SEQ ID NO: 55106 - protein, 483 aa, Rickettsia typhi; identical to SEQ ID NO: 28264

SEQ ID NO: 55107 - DNA, 1269 bp, Staphylococcus aureus; identical to SEQ ID NO: 28265
  CDS (1)..(1269)

SEQ ID NO: 55108 - protein, 422 aa, Staphylococcus aureus; identical to SEQ ID NO: 28266

SEQ ID NO: 55109 - DNA, 1269 bp, Staphylococcus aureus; identical to SEQ ID NO: 28267
  CDS (1)..(1269): transl_table=11

SEQ ID NO: 55110 - protein, 422 aa, Staphylococcus aureus; identical to SEQ ID NO: 28268

SEQ ID NO: 55111 - DNA, 1269 bp, Staphylococcus aureus; identical to SEQ ID NO: 28269
  CDS (1)..(1269): transl_table=11

SEQ ID NO: 55112 - protein, 422 aa, Staphylococcus aureus; identical to SEQ ID NO: 28270

SEQ ID NO: 55113 - DNA, 1269 bp, Staphylococcus epidermidis; identical to SEQ ID NO: 28271
  CDS (1)..(1269): transl_table=11

SEQ ID NO: 55114 - protein, 422 aa, Staphylococcus epidermidis; identical to SEQ ID NO: 28272

SEQ ID NO: 55115 - DNA, 1182 bp, Streptococcus mutans; identical to SEQ ID NO: 28273
  CDS (1)..(1182): transl_table=11

SEQ ID NO: 55116 - protein, 393 aa, Streptococcus mutans; identical to SEQ ID NO: 28274

SEQ ID NO: 55117 - DNA, 1176 bp, Streptococcus salivarius; identical to SEQ ID NO: 28275
  CDS (1)..(1176): transl_table=11

SEQ ID NO: 55118 - protein, 391 aa, Streptococcus salivarius; identical to SEQ ID NO: 28276

SEQ ID NO: 55119 - DNA, 1428 bp, Synechocystis sp; identical to SEQ ID NO: 28277
  CDS (1)..(1428): transl_table=11

SEQ ID NO: 55120 - protein, 475 aa, Synechocystis sp; identical to SEQ ID NO: 28278

SEQ ID NO: 55121 - DNA, 1491 bp, Thermus thermophilus; identical to SEQ ID NO: 28279
  CDS (1)..(1491): transl_table=11

SEQ ID NO: 55122 - protein, 496 aa, Thermus thermophilus; identical to SEQ ID NO: 28280

SEQ ID NO: 55123 - DNA, 981 bp, Archaeoglobus fulgidus; identical to SEQ ID NO: 28281
  CDS (1)..(981): transl_table=11

SEQ ID NO: 55124 - protein, 326 aa, Archaeoglobus fulgidus; identical to SEQ ID NO: 28282

SEQ ID NO: 55125 - DNA, 1002 bp, Methanococcus jannaschii; identical to SEQ ID NO: 28283
  CDS (1)..(1002): transl_table=11

SEQ ID NO: 55126 - protein, 333 aa, Methanococcus jannaschii; identical to SEQ ID NO: 28284

SEQ ID NO: 55127 - DNA, 990 bp, Methanobacterium thermoautotrophicum; identical to SEQ ID NO: 28285
  CDS (1)..(990): transl_table=11

SEQ ID NO: 55128 - protein, 329 aa, Methanobacterium thermoautotrophicum; identical to SEQ ID NO: 28286

SEQ ID NO: 55129 - DNA, 1074 bp, Solanum tuberosum; identical to SEQ ID NO: 28287
  CDS (1)..(1074)

SEQ ID NO: 55130 - protein, 357 aa, Solanum tuberosum; identical to SEQ ID NO: 28288

SEQ ID NO: 55131 - DNA, 25 bp, Artificial sequence
  (1)..(25): primer
atggaaagtaaagtagttgttccgg

SEQ ID NO: 55132 - DNA, 24 bp, Artificial sequence
  (1)..(24): primer
ttacatgttttcgatgatcgcgtc

SEQ ID NO: 55133 - protein, 481 aa, Artificial sequence; identical to SEQ ID NO: 28291
  Variant (2)..(3): xaa in position 2 to 3 is any amino acid
  Variant (5)..(5): xaa in position 5 is any amino acid
  Variant (11)..(11): xaa in position 11 is any amino acid
  Variant (14)..(19): xaa in position 14 to 19 is any amino acid
  Variant (21)..(23): xaa in position 21 to 23 is any amino acid
  Variant (25)..(26): xaa in position 25 to 26 is any amino acid
  Variant (27)..(34): xaa in position 27 to 34 is any or no amino acid
  Variant (36)..(36): xaa in position 36 is any or no amino acid
  Variant (38)..(38): xaa in position 38 is any amino acid
  Variant (39)..(42): xaa in position 39 to 42 is any or no amino acid
  Variant (44)..(52): xaa in position 44 to 52 is any amino acid
  Variant (53)..(62): xaa in position 53 to 62 is any or no amino acid
  Variant (65)..(65): xaa in position 65 is any amino acid
  Variant (66)..(67): xaa in position 66 to 67 is any or no amino acid
  Variant (69)..(70): xaa in position 69 to 70 is any amino acid
  Variant (72)..(75): xaa in position 72 to 75 is any amino acid
  Variant (77)..(77): xaa in position 77 is any amino acid
  Variant (83)..(83): xaa in position 83 is any amino acid
  Variant (88)..(93): xaa in position 88 to 93 is any or no amino acid
  Variant (95)..(96): xaa in position 95 to 96 is any or no amino acid
  Variant (101)..(101): xaa in position 101 is any amino acid
  Variant (104)..(107): xaa in position 104 to 107 is any amino acid
  Variant (110)..(111): xaa in position 110 to 111 is any amino acid
  Variant (115)..(118): xaa in position 115 to 118 is any amino acid
  Variant (119)..(119): xaa in position 119 is any or no amino acid
  Variant (121)..(122): xaa in position 121 to 122 is any or no amino acid
  Variant (124)..(125): xaa in position 124 to 125 is any amino acid
  Variant (126)..(139): xaa in position 126 to 139 is any or no amino acid
  Variant (143)..(143): xaa in position 143 is any amino acid
  Variant (149)..(150): xaa in position 149 to 150 is any amino acid
  Variant (152)..(152): xaa in position 152 is any amino acid
  Variant (156)..(164): xaa in position 156 to 164 is any amino acid
  Variant (165)..(193): xaa in position 165 to 193 is any or no amino acid
  Variant (196)..(196): xaa in position 196 is any or no amino acid
  Variant (199)..(200): xaa in position 199 to 200 is any amino acid
  Variant (203)..(203): xaa in position 203 is any amino acid
  Variant (206)..(208): xaa in position 206 to 208 is any amino acid
  Variant (210)..(211): xaa in position 210 to 211 is any amino acid
  Variant (214)..(216): xaa in position 214 to 216 is any amino acid
  Variant (217)..(221): xaa in position 217 to 221 is any or no amino acid
  Variant (223)..(224): xaa in position 223 to 224 is any amino acid
  Variant (227)..(227): xaa in position 227 is any amino acid
  Variant (236)..(236): xaa in position 236 is any amino acid
  Variant (240)..(240): xaa in position 240 is any amino acid
  Variant (242)..(247): xaa in position 242 to 247 is any amino acid
  Variant (250)..(251): xaa in position 250 to 251 is any amino acid
  Variant (252)..(322): xaa in position 252 to 322 is any or no amino acid
  Variant (324)..(326): xaa in position 324 to 326 is any or no amino acid
  Variant (328)..(328): xaa in position 328 is any amino acid
  Variant (330)..(330): xaa in position 330 is any amino acid
  Variant (332)..(336): xaa in position 332 to 336 is any amino acid
  Variant (339)..(340): xaa in position 339 to 340 is any amino acid
  Variant (342)..(343): xaa in position 342 to 343 is any amino acid
  Variant (345)..(345): xaa in position 345 is any amino acid
  Variant (346)..(347): xaa in position 346 to 347 is any or no amino acid
  Variant (350)..(352): xaa in position 350 to 352 is any amino acid
  Variant (355)..(355): xaa in position 355 is any amino acid
  Variant (358)..(358): xaa in position 358 is any amino acid
  Variant (362)..(363): xaa in position 362 to 363 is any amino acid
  Variant (366)..(366): xaa in position 366 is any amino acid
  Variant (367)..(367): xaa in position 367 is any or no amino acid
  Variant (374)..(374): xaa in position 374 is any amino acid
  Variant (376)..(376): xaa in position 376 is any amino acid
  Variant (380)..(383): xaa in position 380 to 383 is any amino acid
  Variant (384)..(387): xaa in position 384 to 387 is any or no amino acid
  Variant (393)..(393): xaa in position 393 is any amino acid
  Variant (399)..(400): xaa in position 399 to 400 is any amino acid
  Variant (403)..(406): xaa in position 403 to 406 is any amino acid
  Variant (409)..(409): xaa in position 409 is any amino acid
  Variant (416)..(416): xaa in position 416 is any amino acid
  Variant (420)..(420): xaa in position 420 is any amino acid
  Variant (421)..(421): xaa in position 421 is any or no amino acid
  Variant (424)..(428): xaa in position 424 to 428 is any amino acid
  Variant (430)..(431): xaa in position 430 to 431 is any amino acid
  Variant (433)..(434): xaa in position 433 to 434 is any amino acid
  Variant (437)..(439): xaa in position 437 to 439 is any amino acid
  Variant (441)..(445): xaa in position 441 to 445 is any amino acid
  Variant (446)..(447): xaa in position 446 to 447 is any or no amino acid
  Variant (449)..(449): xaa in position 449 is any amino acid
  Variant (451)..(459): xaa in position 451 to 459 is any amino acid
  Variant (460)..(472): xaa in position 460 to 472 is any or no amino acid
  Variant (474)..(476): xaa in position 474 to 476 is any amino acid
  Variant (478)..(480): xaa in position 478 to 480 is any amino acid

SEQ ID NO: 55134 - protein, 7 aa, Artificial sequence
  Variant (2)..(2): xaa in position 2 is any amino acid
  Variant (6)..(6): xaa in position 6 is any amino acid
IXGDGXG

SEQ ID NO: 55135 - protein, 30 aa, Artificial sequence; identical to SEQ ID NO: 28293
  Variant (2)..(2): xaa in position 2 is any amino acid
  Variant (3)..(3): xaa in position 3 is any or no amino acid
  Variant (5)..(5): xaa in position 5 is any or no amino acid
  Variant (7)..(7): xaa in position 7 is any amino acid
  Variant (8)..(8): xaa in position 8 is Ala, Gly or Ser
  Variant (9)..(9): xaa in position 9 is any amino acid
  Variant (11)..(12): xaa in position 11 to 12 is any amino acid
  Variant (14)..(14): xaa in position 14 is Ile, Leu, Met or Val
  Variant (16)..(16): xaa in position 16 is Leu or Val
  Variant (17)..(17): xaa in position 17 is any amino acid
  Variant (18)..(18): xaa in position 18 is Ile, Leu, Met or Val
  Variant (20)..(23): xaa in position 20 to 23 is any amino acid
  Variant (25)..(25): xaa in position 25 is Phe or Tyr
  Variant (26)..(26): xaa in position 26 is any amino acid
  Variant (27)..(27): xaa in position 27 is Cys or Asn
  Variant (28)..(28): xaa in position 28 is any amino acid

SEQ ID NO: 55136 - protein, 12 aa, Artificial sequence
  Variant (4)..(4): xaa in position 4 is Glu, Ser or Thr
  Variant (6)..(6): xaa in position 6 is Asp or Gly
  Variant (7)..(7): xaa in position 7 is any amino acid
  Variant (9)..(9): xaa in position 9 is any amino acid
  Variant (11)..(11): xaa in position 11 is Ile, Leu or Val
RENXEXXYXGXE

SEQ ID NO: 55137 - protein, 35 aa, Artificial sequence; identical to SEQ ID NO: 28295
  Variant (2)..(5): xaa in position 2 to 5 is any amino acid
  Variant (6)..(6): xaa in position 6 is any or no amino acid
  Variant (8)..(15): xaa in position 8 to 15 is any amino acid
  Variant (16)..(19): xaa in position 16 to 19 is any or no amino acid
  Variant (21)..(23): xaa in position 21 to 23 is any amino acid
  Variant (25)..(25): xaa in position 25 is Ala, Asp or Gly
  Variant (27)..(27): xaa in position 27 is Ile or Val
  Variant (28)..(28): xaa in position 28 is any amino acid
  Variant (29)..(29): xaa in position 29 is Lys or Arg
  Variant (30)..(30): xaa in position 30 is any amino acid
  Variant (31)..(31): xaa in position 31 is Ala, Ser or Thr
  Variant (32)..(32): xaa in position 32 is any amino acid
  Variant (34)..(34): xaa in position 34 is any amino acid

SEQ ID NO: 55138 - protein, 31 aa, Artificial sequence; identical to SEQ ID NO: 28296
  Variant (2)..(3): xaa in position 2 to 3 is any amino acid
  Variant (4)..(5): xaa in position 4 to 5 is any or no amino acid
  Variant (8)..(8): xaa in position 8 is any amino acid
  Variant (11)..(12): xaa in position 11 to 12 is any amino acid
  Variant (15)..(20): xaa in position 15 to 20 is any amino acid
  Variant (21)..(21): xaa in position 21 is any or no amino acid
  Variant (23)..(23): xaa in position 23 is Gly or Ser
  Variant (24)..(24): xaa in position 24 is Ile, Leu, Pro or Val
  Variant (26)..(26): xaa in position 26 is Phe, Ile, Leu, Met or Val
  Variant (27)..(27): xaa in position 27 is any amino acid
  Variant (28)..(28): xaa in position 28 is Ala, Gly or Pro
  Variant (29)..(29): xaa in position 29 is Gly or Ser
  Variant (30)..(30): xaa in position 30 is any amino acid
  Variant (31)..(31): xaa in position 31 is Asp or Asn

SEQ ID NO: 55139 - protein, 29 aa, Artificial sequence
  Variant (2)..(2): xaa in position 2 is Ala, Pro or Ser
  Variant (3)..(3): xaa in position 3 is any amino acid
  Variant (6)..(6): xaa in position 6 is Ser or Thr
  Variant (9)..(10): xaa in position 9 to 10 is any amino acid
  Variant (13)..(13): xaa in position 13 is any amino acid
  Variant (14)..(14): xaa in position 14 is Ala, Asp, Gly or Asn
  Variant (15)..(16): xaa in position 15 to 16 is any amino acid
  Variant (19)..(20): xaa in position 19 to 20 is any amino acid
  Variant (21)..(22): xaa in position 21 to 22 is any or no amino acid
  Variant (24)..(28): xaa in position 24 to 28 is any amino acid
  Variant (29)..(29): xaa in position 29 is Phe, Ile, Leu or Met
EXXHGXAPXXAGXXXXNPXXXXLXXXXXX

SEQ ID NO: 55140 - DNA, 951 bp, Escherichia coli
  CDS (1)..(951)
atgagtaaacttgatacttttatccaacatgctgtaaacgctgttccggtcagtggcacatctttgatctcctctctgtatggtgattcgctttcccatcgtggtggtgaaatctggttgggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaatcaacgctggctgatgtcaaaaagcagttgatctggcaaggttttggcgcactggcacccagcctgatggcatcgccgtcgcaaaaactggccgatgtacagacacttttgcatgaagcgggtgtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgcttttaaaagaggcggcagacgagttaaccccggagcgggcatttcatattcagcttttactgatccatttttatcgccgtgtcgtccttaaagacccattgttgccggaggagttgcttccggcacactgggcagggcatacggcgcgtcagctgtgtatcaacatttatcagcgcgtagcgcctgctgctttagcgttcgttagtgaaaaaggtgaaacctcggtcggtgaactgcctgcgccgggaagcctgtattttcaacgttttggcggcttgaatattgaacaggaggcgttatgccaatttatcagatag

SEQ ID NO: 55141 - protein, 316 aa, Escherichia coli
MSKLDTFIQHAVNAVPVSGTSLISSLYGDSLSHRGGEIWLGSLAALLEGLGFGERFVRTALFRLNKEGWLDVSRIGRRSFYSLSDKGLRLTRRAESKIYRAEQPAWDGKWLLLLSEGLDKSTLADVKKQLIWQGFGALAPSLMASPSQKLADVQTLLHEAGVADNVICFEAQIPLALSRAALRARVEECWHLTEQNAMYETFIQSFRPLVPLLKEAADELTPERAFHIQLLLIHFYRRVVLKDPLLPEELLPAHWAGHTARQLCINIYQRVAPAALAFVSEKGETSVGELPAPGSLYFQRFGGLNIEQEALCQFIR

SEQ ID NO: 55142 - DNA, 897 bp, Bacillus halodurans C-125
  CDS (1)..(897): transl_table=11
ttggagaatcaaccaaatactcgttcaatgatttttacgttatacggagattatattcgtcactatggaaatgtgatatggattggtagcttaattcgttttttgcaggagttcggccataacgagcaatccgttcgtgcagcggtttcacgaatgagcaagcaaggttggattcagtcggaaaaaaaagggaacaaaagctactattccctcaccgatcagggccgaaaacgaatggctgaagccgcacaacggatttacaaactagaagccccctcttgggacgaaaagtggcgtttgttgatttactcaatcccggaggaaaaacgaagcttacgggatgaactgcggaaagagctcgtttggagtggttttggacttttagcgaatagttgctggattaccccgaacccattggaagaacaagttgaaacactgatcgaaaaatatgagatttccccctacgtccattttttctgcgcggactacagaggcatgggtgaaccaaaaacgttgatcgaaaagtgttgggatctagatgaaattaatgaaaagtatttagcttttatccaaaagtacagccagaaatatgtgattgataagaacaaaattgaaaaaggagaaatgagtgatggggcctgctttgttgagcggacattgctcgtccacgaatatcgtaaattcctttttattgatccgggtcttccgcaagagctcttacctgaaaaatggttaggtgattcagctgcccatctgtttgccgattattatcgcacccttgccgaaccggcgagacgcttttttgaatctgtctttgcagagggcaactctctagtaaaaaaggataaggaatacaatttccttgaccatccgtttatgtccgaaagccaatcatag

SEQ ID NO: 55143 - protein, 298 aa, Bacillus halodurans C-125
MENQPNTRSMIFTLYGDYIRHYGNVIWIGSLIRFLQEFGHNEQSVRAAVSRMSKQGWIQSEKKGNKSYYSLTDQGRKRMAEAAQRIYKLEAPSWDEKWRLLIYSIPEEKRSLRDELRKELVWSGFGLLANSCWITPNPLEEQVETLIEKYEISPYVHFFCADYRGMGEPKTLIEKCWDLDEINEKYLAFIQKYSQKYVIDKNKIEKGEMSDGACFVERTLLVHEYRKFLFIDPGLPQELLPEKWLGDSAAHLFADYYRTLAEPARRFFESVFAEGNSLVKKDKEYNFLDHPFMSESQS

SEQ ID NO: 55144 - DNA, 801 bp, Sulfolobus solfataricus P2
  CDS (1)..(801): transl_table=11
atgaagatacaatcgttattctttacattgtatggagattacataaaagatgcgggaggaacgataagttccaaaagcttgattattattcttaaagaatttggtttttcagaaggtgcgattagagctggtttacacagaatgaagaaagccggtttaatagtctctgaaaggggaaaagataagaaaataagatataaattgtctgaaaaagggctgttgagattactagaaggaactaggagagtctatgaaaagactagaagaagatgggatggcaaatggaggatagtagtgtataacattccagaaaataacagggaggtaagagatagattgaggagagagctaaaatggttaggatttggaatgctagctcagtcaacatggatatcaccaaatcctattgaagatacgttaaggaaatttatcaatgatctctacaactcgaccaatagcgtgaaggtagacatttttgtggcagattatttagatcaacctaatcatttggtagaaagatgttggaatttagttgaagtcgaacaagcttacaagtcttttttagaagaatggtctccaatgcttaaaaaggtcaactccatgaaaagtaatgaagcgtttgtaactaggatagaattagtccatgaatatagaaaatttctaaatatagaccctgatttaccagaagatttattgccccagaattggataggttataaggcatatgacctcttcatgaaactgagagaggaattaacaccaaaggcaaatgagttcttttacaaggtgtatgagccataa

SEQ ID NO: 55145 - protein, 266 aa, Sulfolobus solfataricus P2
MKIQSLFFTLYGDYIKDAGGTISSKSLIIILKEFGFSEGAIRAGLHRMKKAGLIVSERGKDKKIRYKLSEKGLLRLLEGTRRVYEKTRRRWDGKWRIVVYNIPENNREVRDRLRRELKWLGFGMLAQSTWISPNPIEDTLRKFINDLYNSTNSVKVDIFVADYLDQPNHLVERCWNLVEVEQAYKSFLEEWSPMLKKVNSMKSNEAFVTRIELVHEYRKFLNIDPDLPEDLLPQNWIGYKAYDLFMKLREELTPKANEFFYKVYEP

SEQ ID NO: 55146 - DNA, 801 bp, Sulfolobus solfataricus P2
  CDS (1)..(801): transl_table=11
atgaagatacagtcattgttctttacactctatggagattatgtgaaggattctggaggaacgataagttctaaaagtctaatcgtaatctttaaggaatttggattttccgaaggagcaataagggcaggattacatagaatgaagaaagcaggacttatagtaggaataaaaggagaaaataggaaagttagctacaaattatcagaaaaaggtatgctaagattattggaaggaactaggagggtttatgaaaaagttaggagaagatgggataataagtggaggatagtagtatataatatcccagagaacaatagagaactaagagataagttaaggagagagctgaagtggcttggatttggtatgttagcgcaatcgacgtggatctcaccaaacccaattgaagataccttaaagaatttcattaacgatcactatggttcatctaatggtatacaagtagacattttcgttgcaaattatctaggagaacctaagggactagtagaaaaatgttggaatttatctgaagttgaacaagcttatagagcgttcttagaaaaatggactggagtactagaaaaggtaagtagtctaaaaagtaatgaggcgttcgtaactaggatactacttgtccacgaatatagaaaatttttaaacattgatccagatttacctgaggatttattacctccaaattggatagggtatacagcatatgatctatttatgaaattaagggaggaacttactcctaaggctaacgagttcttttataaggtttatgaaccatga

SEQ ID NO: 55147 - protein, 266 aa, Sulfolobus solfataricus P2
MKIQSLFFTLYGDYVKDSGGTISSKSLIVIFKEFGFSEGAIRAGLHRMKKAGLIVGIKGENRKVSYKLSEKGMLRLLEGTRRVYEKVRRRWDNKWRIVVYNIPENNRELRDKLRRELKWLGFGMLAQSTWISPNPIEDTLKNFINDHYGSSNGIQVDIFVANYLGEPKGLVEKCWNLSEVEQAYRAFLEKWTGVLEKVSSLKSNEAFVTRILLVHEYRKFLNIDPDLPEDLLPPNWIGYTAYDLFMKLREELTPKANEFFYKVYEP

SEQ ID NO: 55148 - DNA, 921 bp, Sinorhizobium meliloti 1021
  CDS (1)..(921): transl_table=11
atgcaggcgaatggcgaaaattcggcagagcagggctcgaggatcatccggccaattttggatgaaacgccgctcagggccgcaagctttatcgtcaccatctacggcgacgtggtggagccgcgcggcggcgcgatctggatcggcaacctgatcgagatctgcgcgggcgtcggtatcagcgagacgcttgtgagaaccgccgtgtcccgtctcgtcgccgccggccagctcgccggagagcgggagggacggcgcagcttctatcggctgacggatgccgcacgcgcggaattcgccgcggcggcgcgggtgatcttcggaccgccggaggaagcgagctggcacttcgtgcagctgatgggttcgtcggccgaggagcggatgcagatgctcgagcgctccggccatgcgcggctgggcccccggctcgcggtcggcgtgcggccgttcccgagcgcgatcatgcccgccgtggtcttccgcgcggagcctgcccagggtgcgagcgagttgaaggcctttgcctcgggctgttgggacctcggacctcacgcgcaggcataccggcggtttctcgcctgcttcggcaagctcgccgttcttccggataccgctagggcgattgctcccgccgagtgcctttctgcacgcctcctcatggtacaccagttccgcttcgttacgctccgcgagccgcgcctgccggccgagattctgcccgctgattggccaggcgacgaagcccgccgcctgtttgcccggctgtaccgcagcctgtctccccaggcggacctgcatgtcgcgcggaactgcgtcacgcttacgggtccgctgccgaaggcgaccggggcgacggagcatcggcttcgaatgctgtgcggtgaagctgcgcctgggaaatccggcaaccccgtttaa

SEQ ID NO: 55149 - protein, 306 aa, Sinorhizobium meliloti 1021
MQANGENSAEQGSRIIRPILDETPLRAASFIVTIYGDVVEPRGGAIWIGNLIEICAGVGISETLVRTAVSRLVAAGQLAGEREGRRSFYRLTDAARAEFAAAARVIFGPPEEASWHFVQLMGSSAEERMQMLERSGHARLGPRLAVGVRPFPSAIMPAVVFRAEPAQGASELKAFASGCWDLGPHAQAYRRFLACFGKLAVLPDTARAIAPAECLSARLLMVHQFRFVTLREPRLPAEILPADWPGDEARRLFARLYRSLSPQADLHVARNCVTLTGPLPKATGATEHRLRMLCGEAAPGKSGNPV

SEQ ID NO: 55150 - DNA, 846 bp, Streptomyces coelicolor A3(2)
  CDS (1)..(846): transl_table=11
atgatcaacgtgtccgacctgcacctacagcccgctccgaggtccctcatcgtcacgctctacggcgcgtacggccgctgcgcgccgggcccggtgcccgtcgccgaactgatccggctgctggccgcggtcggggtggacgcgccctccgtgcgttcgtcggtgtcccggctgaaacggcgcgggctgctgctgcccgcccgtacggccgccggcgcggcggggtacgaactctccgccgaggcccgccagttgctcgacgacggggaccggcgcgtctacgccaccgcgccccacggggacgagggctgggtgctcgccgtgttctccgtgcccgagtcggagcggcagaagcggcacgtcctgcgttcgcgcctggccggtctcggcttcggcaccgcggcgcccggtgtgtggatcgccccggcccggctgtacgcggagacccggcacaccctgggccgcctcggtctggactcctacgtggacttcttccgcggtgagcacctgggcttcacggccaccgccgaggcggtggcccgctggtgggacctggccgcgatcgccaaggagcacgaggccttcctcgaccgccacgagcgcgtcctgcacgactgggagcgccgggcggacacgccgcccgaggaggcctaccgcgactacctcctcgccctggactcctggcgccacctgccctacacggaccccgggctgcccgcccggctgctgcccgagggctggcccggcacgcgctcggcggccgtcttccgggcgctgcacgagcggctgcgcgacgcgggcgcccagtacgcggccatgggaccgactccgcctcccgggcagtga

SEQ ID NO: 55151 - protein, 281 aa, Streptomyces coelicolor A3(2)
MINVSDLHLQPAPRSLIVTLYGAYGRCAPGPVPVAELIRLLAAVGVDAPSVRSSVSRLKRRGLLLPARTAAGAAGYELSAEARQLLDDGDRRVYATAPHGDEGWVLAVFSVPESERQKRHVLRSRLAGLGFGTAAPGVWIAPARLYAETRHTLGRLGLDSYVDFFRGEHLGFTATAEAVARWWDLAAIAKEHEAFLDRHERVLHDWERRADTPPEEAYRDYLLALDSWRHLPYTDPGLPARLLPEGWPGTRSAAVFRALHERLRDAGAQYAAMGPTPPPGQ

SEQ ID NO: 55152 - DNA, 924 bp, Pseudomonas putida KT2440
  CDS (1)..(924): transl_table=11
atgagcaatctcgcaccactgaaccacttgatcacccgctttcaggagcagacgccaatccgcgccagttccctgatcatcacgttgtacggcgatgccatcgagccgcacggcggtacagtctggctcggtagcctgatcaacctgctggagccgatcggcatcaatgaacggctgatacgcacgtcgatctttcgcctgaccaaagaaggttggctcactgcagaaaaggtgggccgacgcagttattacagcctgacaggcactggccgtcggcgtttcgaaaaagccttcaagcgcgtctatagcccgagccagccagcctgggacggggcctggacactggtgttgctgtcgcaactcgaggcgggtaaacgcaaggccgtgcgtgaggagctagagtggcaggggtttggtgtcatggcgccgaacctgctgggttgcccacgggcagaccgtgccgacctggtggccacgttgcatgatcttgaggcgggcgacgacagtatcgtcttcgaaacccacacccaagaggtactcgcgtccaaggcgatgcgcgcccaggtgcgggaaagctggcgtatcgacgaactggggcagcaatacagcgagtttatccaactgttcaggccgctgtggcaaggtttgaaagagcagccgttgctggatgcccaagattgcttccttgcgcgcacgctgctgattcacgagtaccgccgcctgctgctgcgcgacccgcaactacccgacgagctgctgccaggggactgggagggaagggctgcgcgacagttgtgccgtaacctctaccgactggtgtttgccaaagccgaagaatggttgaatgcagcgctggaaacagcagatggcccattgccggacgtgagcgagagtttttacaagcgttttggcgggttggcttga

SEQ ID NO: 55153 - protein, 307 aa, Pseudomonas putida KT2440
MSNLAPLNHLITRFQEQTPIRASSLIITLYGDAIEPHGGTVWLGSLINLLEPIGINERLIRTSIFRLTKEGWLTAEKVGRRSYYSLTGTGRRRFEKAFKRVYSPSQPAWDGAWTLVLLSQLEAGKRKAVREELEWQGFGVMAPNLLGCPRADRADLVATLHDLEAGDDSIVFETHTQEVLASKAMRAQVRESWRIDELGQQYSEFIQLFRPLWQGLKEQPLLDAQDCFLARTLLIHEYRRLLLRDPQLPDELLPGDWEGRAARQLCRNLYRLVFAKAEEWLNAALETADGPLPDVSESFYKRFGGLA

SEQ ID NO: 55154 - DNA, 864 bp, Bradyrhizobium japonicum USDA 110
  CDS (1)..(864): transl_table=11
atggcgcatccgctctcccgcatcatcgaccagctcaagcgcgaaccgtcgcgcaccggctccatcgtcatcaccgtgttcggcgacgccatcgtgccgcgcgggggctcggtgtggctcggcacgctgctggaattcttcgagagcctggacatcgacagcggggtggtgcgcaccgcgatgtcgcgcctggcggctgacggctggctgacgcgtgaaaaggtcggccgcaacagtttctatcgtctcgccgacaagggccaccagaccttcgaggccgcgacgcgccacatctacgatccgccgccgtcggactggaccgggcgtttcgagctgctgctgatcaatggcgaggaccgcgacgcctcgcgcgaggcgctgcgcaatgccggcttcggcagtccgctgcccggcgtgtgggttgcgccgtcgggcgtgccggtgccggatgaggctgcgggcgctatccgtctcgaggtctccgcggaggacgacagcgggcgccgcctgctcagcgcaagctggccgctcgatcgcaccgcggatgcctatctgaagttcatgaagacgttcgagccgctgcgcaccgcgatcggccgcggaacgactctctccgacgccgacgccttcaccgcgcggatcctgctgatccaccactatcgccgcgtcgtgctgcgcgatccgctgctgcccgagagcctgctgcctgcggattggccgggcagggccgcccgcgaactctgcggcgagatctatcgcgcgctgcttgctccgtccgaacaatggcttgatggccatggaaccaatgaaaaagggccattgccggcggcgcgaaaactcctggaacggaggttcggcgcctga

SEQ ID NO: 55155 - protein, 287 aa, Bradyrhizobium japonicum USDA 110
MAHPLSRIIDQLKREPSRTGSIVITVFGDAIVPRGGSVWLGTLLEFFESLDIDSGVVRTAMSRLAADGWLTREKVGRNSFYRLADKGHQTFEAATRHIYDPPPSDWTGRFELLLINGEDRDASREALRNAGFGSPLPGVWVAPSGVPVPDEAAGAIRLEVSAEDDSGRRLLSASWPLDRTADAYLKFMKTFEPLRTAIGRGTTLSDADAFTARILLIHHYRRVVLRDPLLPESLLPADWPGRAARELCGEIYRALLAPSEQWLDGHGTNEKGPLPAARKLLERRFGA

SEQ ID NO: 55156 - DNA, 843 bp, Streptomyces avermitilis MA-4680
  CDS (1)..(843): transl_table=11
gtgatcaacgtgtccgatcagcacgctccccggtccctcatcgtcacgttctacggcgcgtacggccgcttcttccccggcccggtgccggtggcggagctgatccggctgctcgccgccgtcggcgtcgacgcgccctccgtcagatcgtcggtgtcccggctgaagcggcgcggcctgctggtgccggcccgcacggcggccggcgcggccgggtacgcgctgtcgccggacgcccgccaactgctcgacgacggcgacctgcgcgtgtacgcgaccactcccccacgggacgagggctgggtgctcgcggtgttctccgtgccggagtcggaacggcagaagcggcatgtactgcgctcgcgcctggccgggctcggcttcgggacggcggcccccggggtgtggatcgccccggcgcggctgtacgaggagacccggcacaccctggggcggctgcgcctcgacccgtacgtcgacttcttccgcggcgagcacctgggcttcgccgcgaccttcgaggccgtcgcgcgctggtgggacctggccgcgatcgccaagcagcacgaggagttcctcgaccgccacgcgcgcgtgctgcacgactgggaggcacgcgaggacaccgagcccgaggaggcgtaccgcgactatctgctcgccctggactcctggcgccacctcccgtacgccgatcccggcctgcccgccgcactgcttcccgaggactggccgggcgcccgctcggccgccgtcttccgggcactgcacgagcggctgcgcgatgcgggagcggccttcgcggctgggacggagacactcgaccccgccggtgaaacgtga

SEQ ID NO: 55157 - protein, 280 aa, Streptomyces avermitilis MA-4680
MINVSDQHAPRSLIVTFYGAYGRFFPGPVPVAELIRLLAAVGVDAPSVRSSVSRLKRRGLLVPARTAAGAAGYALSPDARQLLDDGDLRVYATTPPRDEGWVLAVFSVPESERQKRHVLRSRLAGLGFGTAAPGVWIAPARLYEETRHTLGRLRLDPYVDFFRGEHLGFAATFEAVARWWDLAAIAKQHEEFLDRHARVLHDWEAREDTEPEEAYRDYLLALDSWRHLPYADPGLPAALLPEDWPGARSAAVFRALHERLRDAGAAFAAGTETLDPAGET

SEQ ID NO: 55158 - DNA, 930 bp, Bordetella pertussis Tohama I
  CDS (1)..(930): transl_table=11
atggcaagcactccgtcaccgctggaccgctttctctcccgtctgctgaaaaacgatccgccccgcgccaaatcgctgtgcgtcagcctgctgggcgacgcgctggcgccgcacggcggcgccatctggctgggcgacctgatcgagctgctggcccctatcggcatcaacgaacgcctgctacgcaccagcgtgttcaggctggtcgcgcagggctggctgcaatccgagcgccatggacggcgcagcctgtatctgttgtcggaacacggcctgcgccacaccgcgcacgcctcgcagcgcatctatgacgggccggcgcgcgcctggaacggcgaatggacactggtggcgctgccgcgcgccggcaacaatggcctggccgagcggggcgagctgcgccgcgaactgctctgggaagggttcggcatggtggccccgggcctgttcgcccacccgcagaccgaagcgcgcgccgcgcacgatatcctcgaaaagctgggtatccccgacaaggccctggtgctgtcggcgcgcgaccaggccggcgccggcggcctgccgatcgccagcctggcgggacaatgctggaatctcgatgaggtggcggaccaataccgcctgttctcgcgcaatttcggcccggtggaaaaactgctggatccgccccccacccccgcgcaggccttcgcggtgcgggtgctgttgctgcacaactggcagcgcatcgtgctgcacgatccgcagctgcccacccccatggaaccggacggctggcccggcaacgcggcccgcgcactgtgccggcgcatctactggcaagtcttcgacgcctcggaacgccacctggatgccgtggccggccgcgagaacgcgcgctatcggccggcccaggccgacatcatgggccgcttcggcgggcggccgtag

SEQ ID NO: 55159 - protein, 309 aa, Bordetella pertussis Tohama I
MASTPSPLDRFLSRLLKNDPPRAKSLCVSLLGDALAPHGGAIWLGDLIELLAPIGINERLLRTSVFRLVAQGWLQSERHGRRSLYLLSEHGLRHTAHASQRIYDGPARAWNGEWTLVALPRAGNNGLAERGELRRELLWEGFGMVAPGLFAHPQTEARAAHDILEKLGIPDKALVLSARDQAGAGGLPIASLAGQCWNLDEVADQYRLFSRNFGPVEKLLDPPPTPAQAFAVRVLLLHNWQRIVLHDPQLPTPMEPDGWPGNAARALCRRIYWQVFDASERHLDAVAGRENARYRPAQADIMGRFGGRP

SEQ ID NO: 55160 - DNA, 930 bp, Bordetella bronchiseptica RB50
  CDS (1)..(930): transl_table=11
atggcaagcactccgtcaccgctggaccgctttctctcccgtctgctgaaaaacgatccgccccgcgccaaatcgctgtgcgtcagcctgctgggcgacgcgctggcgccgcacggcggcgccatctggctgggcgacctgatcgagctgctggcccctatcggcatcaacgaacgcctgctgcgcaccagcgtgttcaggctggtcgcgcagggctggctgcaatccgagcgccatggacggcgcagcctgtatctgttgtcggaacacggcctgcgccacaccgcgcacgcctcgcagcgcatctatgacgggccggcgcgcgcctggaacggcgaatggacactggtggcgctgccgcgcgccggcaacaatggcctggccgagcggggcgagctgcgccgcgaactgctctgggaagggttcggcatggtggccccgggcctgttcgcccacccgcagaccgaagcgcgcgccgcgcacgatatcctcgaaaagctgggtatccccgacaaggccctggtgctgtcggcgcgcgacctggccggcgccggcggcctgccgatcgccagcctggcgggacaatgctggaatctcgatgaggtggcggaccaataccgcctgttctcgcgcaatttcggcccggtggaaaaactgctggatccgccccccacccccgcgcaggccttcgcggtgcgggtgctgttgctgcacaactggcggcgcatcgtgctgcacgatccgcagctgcccacccccatggaaccggacggctggcccggcaacgcggcccgcgcactgtgccggcgcatctactggcaagtcttcgacgcctcggaacgccacctggatgccgtggccggccgcgagaacgcgcgctatcggccggcccaggccgacatcatgggccgcttcggcgggcggccgtag

SEQ ID NO: 55161 - protein, 309 aa, Bordetella bronchiseptica RB50
MASTPSPLDRFLSRLLKNDPPRAKSLCVSLLGDALAPHGGAIWLGDLIELLAPIGINERLLRTSVFRLVAQGWLQSERHGRRSLYLLSEHGLRHTAHASQRIYDGPARAWNGEWTLVALPRAGNNGLAERGELRRELLWEGFGMVAPGLFAHPQTEARAAHDILEKLGIPDKALVLSARDLAGAGGLPIASLAGQCWNLDEVADQYRLFSRNFGPVEKLLDPPPTPAQAFAVRVLLLHNWRRIVLHDPQLPTPMEPDGWPGNAARALCRRIYWQVFDASERHLDAVAGRENARYRPAQADIMGRFGGRP

SEQ ID NO: 55162 - DNA, 783 bp, Thermus thermophilus HB27
  CDS (1)..(783): transl_table=11
atgcgggccaggtccaccatcttcaccctgttcgtggagtacgtctacccggagcgggcggcccgggtgcgggacctcgtggccatgatggccgccctgggcttctcggagatggcggtgcgggcggcgctttcccggagcgccaagcggggctgggtggtgcccaagcgggaggggcgggccgcctactacgccctctccgaccgggtctactggcaggtgcgccaggtgcgccgccgcctctacggctccctccccccgtgggacgggcgcttcctcctcgtccttcccgaggggcccaaggaccggggggagagggagaggttccgtcgggagatggcccttttgggctacggggggctgcagagcggggtctatctgggggtcggggcggacctcgaggccacccgggagctcctcggcttctacggccttagcgccacctgcttccaaggggagcttctcgggggaaaggaggaggtcctcagggccttccccctggaggaggccaaggcgggctacgggcggctttccgccctcctgggtcaaagccccgaggaccccgtggaggccttccgccacctcacccggctcgtccacgaggcgaggaagctcctcttcctggaccccggcctcccccaagagcttttgggccccgactttccggggccaaaggtgcgccgcctcttcctttcggcccgggaggagctgagggcccgggcagcccccttcctcaaggacctttcccttctcctttcagacctctcacccgtttcccggtag

SEQ ID NO: 55163 - protein, 260 aa, Thermus thermophilus HB27
MRARSTIFTLFVEYVYPERAARVRDLVAMMAALGFSEMAVRAALSRSAKRGWVVPKREGRAAYYALSDRVYWQVRQVRRRLYGSLPPWDGRFLLVLPEGPKDRGERERFRREMALLGYGGLQSGVYLGVGADLEATRELLGFYGLSATCFQGELLGGKEEVLRAFPLEEAKAGYGRLSALLGQSPEDPVEAFRHLTRLVHEARKLLFLDPGLPQELLGPDFPGPKVRRLFLSAREELRARAAPFLKDLSLLLSDLSPVSR

SEQ ID NO: 55164 - DNA, 858 bp, Symbiobacterium thermophilum IAM 14863
  CDS (1)..(858): transl_table=11
atgaaggcccggtcgctgctgttcaacctgtggggcgactacatccagcatgtcggaggcgaggcctgggcgtcgaccctggccgcctgggtgcgcccgttcggcgtcagcgaggcggccctgcggcaggcgctctcgcgcatggctcgccagggatggctggaggtgcgtaaggtcggaaaccggacctgttatgcgctctccgcggcgggacgccgccgcattgccgaggcgtcgcggcgcgtgtacgacggccgggacgtggactgggacggccgctggcgggtactggtctattcggtccccgaggccctgcggaaccggcgcaacgacctgcgccgggagctgatctggacgggcttcgcccacctgtcgccgggtacctggatctcgcccaacccactcgaggactcggtgcgggagctgctccggcgctacgggctggagccctacgccacgctgttcgtcgcgccgtacgcggagccctggtcggcgcccgacctggtgcgccgctgctgggatctggaggcgatccaggcgagctacgaccggttcatcgcgcgctgggagccccgcctggaggcgtcgtcgaggctgcacagcgacgaggagcgcttcgtcgagcagatccgcctcgtccacgactaccggaagttcctgttcgtcgacccggggctgccgcgccggctcctgcccgatacctggcgggggcacgacgcgcgcaggctgttccaggcgtactatgccaggctgcggcccggggcgctccggttcctggagaggcactttgaacccacacaagcccacgatggaggaggagaggaccgtggcgtacgagaacatcctggtctttcgtga

SEQ ID NO: 55165 - protein, 285 aa, Symbiobacterium thermophilum IAM 14863
MKARSLLFNLWGDYIQHVGGEAWASTLAAWVRPFGVSEAALRQALSRMARQGWLEVRKVGNRTCYALSAAGRRRIAEASRRVYDGRDVDWDGRWRVLVYSVPEALRNRRNDLRRELIWTGFAHLSPGTWISPNPLEDSVRELLRRYGLEPYATLFVAPYAEPWSAPDLVRRCWDLEAIQASYDRFIARWEPRLEASSRLHSDEERFVEQIRLVHDYRKFLFVDPGLPRRLLPDTWRGHDARRLFQAYYARLRPGALRFLERHFEPTQAHDGGGEDRGVREHPGLS

SEQ ID NO: 55166 - DNA, 870 bp, Nocardia farcinica IFM 10152
  CDS (1)..(870): transl_table=11
atgacggctgagctcgaaccgaccggcgcgggtacggcaggcggccgggacactcgcctcgcccagttcatcatcacgatcttcggcctgtgcgcccgcgcggaaggcaactggctctccgtcgcgtcggtggtcgcgctgatggccgacctcggcgcggagggccaggccgtccgttcctccatctcccggctcaagcgccgcggtgtgctggtgagcgagcggcacgggggcgcggcgggctactcgctcgccccgcagacactggaggtgatcgccgaaggcgacatccgcatcttccaccgcacccgcgccaccgaggacgacggctgggtggtcgtggtgttctcggtgcccgaaaccgagcgcgagaagcggcattccctgcgaaccacgttgacccgcctgggtttcggcaccgcggcccccggggtgtgggtggcgcccggaaacctggtgcgcgagaccgagcagaccttgcagcgccgcggattgtcctcctacgtcgaccttttccgcggcaggcacctcggcttcggcgacccgcgggagaaggtcaccacctggtgggatctggacgagctcaccgcgctctacaccgagttcctccagcagtaccggccggtgctgtatcgggtgaccagcgaaaccgtcaccgcgcgtgaggctttccagctctacgtgccgatgctcacgcagtggcgacggctgccctaccgcgacccgggcatcccgctgtcgctgctgccgcccgcctggcagggcgaagccgcgggcacgctgttcgaccagctcaacgaggtgctcaacccgctggcccacaagcacgcgctcgcggtgatccacggcaaacgcccccaggtcagctga

SEQ ID NO: 55167 - protein, 289 aa, Nocardia farcinica IFM 10152
MTAELEPTGAGTAGGRDTRLAQFIITIFGLCARAEGNWLSVASVVALMADLGAEGQAVRSSISRLKRRGVLVSERHGGAAGYSLAPQTLEVIAEGDIRIFHRTRATEDDGWVVVVFSVPETEREKRHSLRTTLTRLGFGTAAPGVWVAPGNLVRETEQTLQRRGLSSYVDLFRGRHLGFGDPREKVTTWWDLDELTALYTEFLQQYRPVLYRVTSETVTAREAFQLYVPMLTQWRRLPYRDPGIPLSLLPPAWQGEAAGTLFDQLNEVLNPLAHKHALAVIHGKRPQVS

SEQ ID NO: 55168 - DNA, 783 bp, Thermus thermophilus HB8
  CDS (1)..(783): transl_table=11
atgcgggccaggtccaccatcttcaccctgttcgtggagtacgtctacccggaacgggcggcccgggtgcgggacctcgtggccatgatggccgccctgggcttctcggagatggcggtgcgggcggcgctttcccggagcgccaagcggggctgggtggtgcccaagcgggaggggcgggccgcctactacgccctctccgaccgggtctactggcaggtgcgccaggtgcgccgccgcctctacggctccctccccccgtgggacgggcgcttcctcctcgtccttcccgaggggcccaaggagcggggggagagggagaggttccgtcgggagatggcccttttgggctacggggggctgcagagcggggtctatctgggggtcggggcggacctcgaggccacccgggagctcctcggcttctacggccttagcgccacctgcttccaaggggagcttctcgggggaaaggaggaggtcctcagggccttccccctggaggaggccaaggcgggctacgggcggctttccgccctcctgggtcaaagccccgaggaccccgtggaggccttccgccacctcacccggctcgtccacgaggcgaggaagctcctcttcctggaccccggcctcccccaggagcttttgggccccgactttccggggccaaaggtgcgccgcctcttcctttcggcccgggaggagctgagggcccgggcggcccccttcctcaagggcctttcccttctcctttcagacctctcacccgtttcccggtag

SEQ ID NO: 55169 - protein, 260 aa, Thermus thermophilus HB8
MRARSTIFTLFVEYVYPERAARVRDLVAMMAALGFSEMAVRAALSRSAKRGWVVPKREGRAAYYALSDRVYWQVRQVRRRLYGSLPPWDGRFLLVLPEGPKERGERERFRREMALLGYGGLQSGVYLGVGADLEATRELLGFYGLSATCFQGELLGGKEEVLRAFPLEEAKAGYGRLSALLGQSPEDPVEAFRHLTRLVHEARKLLFLDPGLPQELLGPDFPGPKVRRLFLSAREELRARAAPFLKGLSLLLSDLSPVSR

SEQ ID NO: 55170 - DNA, 876 bp, Geobacillus kaustophilus HTA426
  CDS (1)..(876): transl_table=11
gtgaagccgagatcgctcatgtttacgttatttggagaatatattcaacattatgggaacgaagtatggatcggaagcttaatccaaatgatgtcccacttcggcatttccgagtcgtccatccgcggagcggcgttgcgcatggtgcagcaagggttttttgaggtgcggaaaatcggcaacaacagctattactcgctgacgccgaaagggaaacggacgatgatggacgggttcaaccgcgtctattcgcaacggaactacaaatgggacggtcaatggcgcgtgttgacgtactccgttcccgagcaaaaacgggagctgcgcaaccaaattcgcaaagaattgagcttgatggggtttggtctcatttcccacgggacgtgggcgagcccgaatccgatcgagccgcaagtgatggaatgggttaaagactatcatttggagccgtacgtcattttgtttacggcgagctccatcgtgtcgcacagcaatgagcaaatcatcgagcgcggctgggatttcccgtacatcgccaaggagtatgaccggtttattgaaacgtacgaacgaaaatacgaagagttccaacatcgggcttggaacaatgaactgaccgaccgcgaatgcttcattgaacggacgaagctcgtgcatgagtatcggagctttttctttatcgatccaggattcccgaacgacttgttgcctgatgattggagcggaacgagagcgcgggagctgtttttcaatgtccaccagttgctcgccattccggccatctgttattttgaaacattgtttgaggccgcaccggatcgtgaggtgacatttaaccgcgataaggcgattaatccatttatggaaatgatttag

SEQ ID NO: 55171 - protein, 291 aa, Geobacillus kaustophilus HTA426
MKPRSLMFTLFGEYIQHYGNEVWIGSLIQMMSHFGISESSIRGAALRMVQQGFFEVRKIGNNSYYSLTPKGKRTMMDGFNRVYSQRNYKWDGQWRVLTYSVPEQKRELRNQIRKELSLMGFGLISHGTWASPNPIEPQVMEWVKDYHLEPYVILFTASSIVSHSNEQIIERGWDFPYIAKEYDRFIETYERKYEEFQHRAWNNELTDRECFIERTKLVHEYRSFFFIDPGFPNDLLPDDWSGTRARELFFNVHQLLAIPAICYFETLFEAAPDREVTFNRDKAINPFMEMI

SEQ ID NO: 55172 - DNA, 858 bp, Geobacillus kaustophilus HTA426
  CDS (1)..(858): transl_table=11
atgaacacacgctcaatgatctttacgatttacggcgactacatccgccattacggcggtgaaatttggatcgggagcctaatccgcctcctccgcgagttcggccataacgaccaggcggtgcgggcggcggtgtcgcgcatgagcaaacaaggctggattcgcgcggaaaaacgcggcaataaaagctactattcgctcacggaacgcggcgtcaagcggatggaagaagcggcgcggcgcatttacaaaacgcgccccgagcattgggacgggaaatggcgcattctcatctatacgattcctgaggataagcggcatttgcgcgatgaactgcgaaaggagcttgtttggagcgggttcggcacgatttccaacagttgctggatttcaccgaataatttggagcaacaagtgtacgacttgatcgacaagtatgacatccgcccatatgtcgacttctttcttgccgaatacgatggaccgcatacgaataagcagcttgtggaaaagtgctggaacttagaagagatcaaccaaaaatacgagcagtttattgcggtctacagtcaaaaatatgtgattgacaaacataaaatcgagcgcggcgaaatgtcggacgcggaatgttttgtcgagcggacgaagctcgtccatgaataccgaaaatttttgttcatcgaccccggcttgccggaagagctgttgccgaatgagtggatgggaagccatgcggccgccttgttcaacgactattatcaacaactcgcggcaccggccagccgtttctttgaagcggtgtttcaagaaggggcagagcttgacaaaaaagaagaggaagagatatcggtggaatga

SEQ ID NO: 55173 - protein, 285 aa, Geobacillus kaustophilus HTA426
MNTRSMIFTIYGDYIRHYGGEIWIGSLIRLLREFGHNDQAVRAAVSRMSKQGWIRAEKRGNKSYYSLTERGVKRMEEAARRIYKTRPEHWDGKWRILIYTIPEDKRHLRDELRKELVWSGFGTISNSCWISPNNLEQQVYDLIDKYDIRPYVDFFLAEYDGPHTNKQLVEKCWNLEEINQKYEQFIAVYSQKYVIDKHKIERGEMSDAECFVERTKLVHEYRKFLFIDPGLPEELLPNEWMGSHAAALFNDYYQQLAAPASRFFEAVFQEGAELDKKEEEEISVE

SEQ ID NO: 55174 - DNA, 957 bp, Azoarcus sp. EbN1
  CDS (1)..(957): transl_table=11
atgaagagtcggttcatcacgcagtggatcaacgattacctggcggaacgccgcgtacgcgcgaactcgctgatcatcaccatctacggagatttcatcgccccgcacggcggaaccgtgtggctcggcagtttcatacggctggtcgagccgctgggcctgaacgagagaatggtccgcaccagcgtctatcgcctgtcgcaggacaagtggctggtttccgagcagatcggacgcaaaagctattacagcctcactgcctcgggacgacggcgcttcgaacacgcctatcgccggatctacgacgcacggcagctaccgtggaacggcgaatggcagctcgtgatcctgccttcgacgctgcccgccccgcagcgggacgcactgcgcaaggaactgtcatgggcgggttacggaacgatcgctccgtgcgtgctcgcacacccgtcggcagacaccgaaaccttgctggaaatcctgcaggagaccggcacccacgacaaggtcgtaccgatgaccgcgcacaatctcggcgcgctgtcgaaccgcccgctgcaggatctggcgcgtgaatgctggaatctggaggcaatcggcgcgacttaccgggagttcgcggaccggctgcggcccgtgctgcgggcgctgcgtactgctcgcgacctggacccggaacagtgcttcctcgtgcagaccctgacgatgcacgattttcgtcgcgccctgctgcacgacccgctgctgcccgatcaactgatgcctgtcgactggagcggtgcggtcgcccgcgaagtgtgccgagacatttatcgcatcacgtatcgccttgcccagcagcacctgatggcgacatgcaagacgccaaatggcccgctgccgcccgccgcgccgtatttctacgaacgtttcggcggcctcgaggacactacacaccgtgaagcagcggagcagcagtag

SEQ ID NO: 55175 - protein, 318 aa, Azoarcus sp. EbN1
MKSRFITQWINDYLAERRVRANSLIITIYGDFIAPHGGTVWLGSFIRLVEPLGLNERMVRTSVYRLSQDKWLVSEQIGRKSYYSLTASGRRRFEHAYRRIYDARQLPWNGEWQLVILPSTLPAPQRDALRKELSWAGYGTIAPCVLAHPSADTETLLEILQETGTHDKVVPMTAHNLGALSNRPLQDLARECWNLEAIGATYREFADRLRPVLRALRTARDLDPEQCFLVQTLTMHDFRRALLHDPLLPDQLMPVDWSGAVAREVCRDIYRITYRLAQQHLMATCKTPNGPLPPAAPYFYERFGGLEDTTHREAAEQQ

SEQ ID NO: 55176 - DNA, 801 bp, Silicibacter pomeroyi DSS-3
  CDS (1)..(801): transl_table=11
atgacacgacacaccccctggttcgacaccgccgtcacccggcttgccgacccgcagaaccagcgggtctggtcgatcatcgtctcgctgctgggggatctggcccggcgcaagggcgaccggatttcgggcagcgcgctgacccgcattacccagccgatgggcatcaaacccgaggcgatgcgcgtcgcgctgcaccggctgcgcaaggatggatggatcgaaagcagccgcgaggggcgcagttcggtccattacctgtccgaatatggccgcacccaatcggaccgcgtgaccccccgcatctatacccgcacacccgaattgcccgaggcctggcatatcctgatcgccgaggatggcagcagcctcaacacgctcaacgacctgctgctgaccgacacctatatcgggatcgggcgcacggtggcgctgggatccgggccggtacccggggattgcgacgatctggccgggttcgaggtgagcgcccgcgccattcccggctggctgcaaacccgcctcttccccgaggatctggggaccgcctgtcagagcctgcatcaggattgcgccgaattgcgcgcggcgggcgtgcccgggctgctgaccccgtttcaggtggcaaccctgcgcacgctgctggtgcatcgctggcgccgggtggccttgcgccatcccgacctgcccgctgccttccagccccggggctggatgggacccgcctgccgcgagcaggtctttgccctgctcgacgccctgccgctgccgcccctgcccgcgctgaacgaagccgaatga

SEQ ID NO: 55177 - protein, 266 aa, Silicibacter pomeroyi DSS-3
MTRHTPWFDTAVTRLADPQNQRVWSIIVSLLGDLARRKGDRISGSALTRITQPMGIKPEAMRVALHRLRKDGWIESSREGRSSVHYLSEYGRTQSDRVTPRIYTRTPELPEAWHILIAEDGSSLNTLNDLLLTDTYIGIGRTVALGSGPVPGDCDDLAGFEVSARAIPGWLQTRLFPEDLGTACQSLHQDCAELRAAGVPGLLTPFQVATLRTLLVHRWRRVALRHPDLPAAFQPRGWMGPACREQVFALLDALPLPPLPALNEAE

SEQ ID NO: 55178 - DNA, 789 bp, Sulfolobus acidocaldarius DSM 639
  CDS (1)..(789): transl_table=11
atgaagtttcaaacgctgttcttcacgatttatggagactacattataaactacggaaatagcataactgtgaggagtttgataaagataatgagagagttcggtttcacagagggggcaataagggcaggtctattccgtttaaggcaaaagggactggtggacatgattgacaggaggaggtgtagtttatccgaagctgggttatataggttacaggaaggtatgaaaagagtctacgagaagaggaacggagagtgggacggaaaatggagaatagtagtttacaatatacctgagtcaaataggagtgtcagagacgagatgagaaaaaccttaaagtggttgggctttggatacctggctcaatcgacatggatatcgccaaacccagttgaggagagcctaactaaattcattaatgaattaaaagatagtagaaccaatgttgacatattcttctttatttcggactttgttggaaatccccttgagatagtaaggaagtgttgggatctgaaagaggtcgaggagaaatataaggagtttgtgaaccaatggggcaaagttatggagaacatatcttctctgaaaccaaatgaggcattcataaccagaattagattggttcatgaatacaggaaatttttacacattgatccaaacttacctaaagatctactaccgccaaattgggtaggttacgaggcatatgagctatttcaaaaactgaggaataagctctcaacattgtctgaccagttctttaagtcggtatatgaaccttga

SEQ ID NO: 55179 - protein, 262 aa, Sulfolobus acidocaldarius DSM 639
MKFQTLFFTIYGDYIINYGNSITVRSLIKIMREFGFTEGAIRAGLFRLRQKGLVDMIDRRRCSLSEAGLYRLQEGMKRVYEKRNGEWDGKWRIVVYNIPESNRSVRDEMRKTLKWLGFGYLAQSTWISPNPVEESLTKFINELKDSRTNVDIFFFISDFVGNPLEIVRKCWDLKEVEEKYKEFVNQWGKVMENISSLKPNEAFITRIRLVHEYRKFLHIDPNLPKDLLPPNWVGYEAYELFQKLRNKLSTLSDQFFKSVYEP

SEQ ID NO: 55180 - DNA, 924 bp, Pseudomonas fluorescens Pf-5
  CDS (1)..(924): transl_table=11
atgtcgtccctagcgccactgaaccacctgatcaaacgtttccaggagcagactccgatccgcgccagttcgctgatcatcaccctgtacggcgatgccatcgagccccacggcggcacggtgtggctgggcagcctgattcagttgctggagcccatggggatcaacgagcgcttgatccgcacctcgatcttccgcctgagcaaagagggctggctgagcgctgaaaaggtcggccggcgcagttactacagcctgaccctgaccggacgccggcgcttcgacaaagccttcaagcgcgtgtacagcgccggagtgccggcctgggacggcgcctggtgcctggtgatgctctcgcaactgtctgtcgagttgcgcaagcaggtgcgcgaagagttggaatggcaggggttcggcgccatgtcgccggtactgctggcctgcccgcgcagtgatcgggccgatatcaacgccaccctggcggagcttggtgcccaggaagacaccatcgtcttcgagaccacgccccaggatgtcctgggttccagggccctgcgcctgcaagtgcgggaaagctggaacatcgatgaactggcagcccactacagcgagttcatccagctgttccgcccgctctggcaggccctgcgcgagcaggagcagttgcagccccaggattgcttcctggcccggctgctgctgattcatgagtaccgcaagctgctgctgcgcgatccgcaactgcccgacgaactgctgcccggggattgggaaggccgcgcggcgcgccagttgtgtcgcaacatctatcgcctgatccaggcccgggccgaagaatggctggccactgccctggagaacgccgatggcccgttgccggatgtcggcgaaagctactaccggcgttttggcgggctggtctag

SEQ ID NO: 55181 - protein, 307 aa, Pseudomonas fluorescens Pf-5
MSSLAPLNHLIKRFQEQTPIRASSLIITLYGDAIEPHGGTVWLGSLIQLLEPMGINERLIRTSIFRLSKEGWLSAEKVGRRSYYSLTLTGRRRFDKAFKRVYSAGVPAWDGAWCLVMLSQLSVELRKQVREELEWQGFGAMSPVLLACPRSDRADINATLAELGAQEDTIVFETTPQDVLGSRALRLQVRESWNIDELAAHYSEFIQLFRPLWQALREQEQLQPQDCFLARLLLIHEYRKLLLRDPQLPDELLPGDWEGRAARQLCRNIYRLIQARAEEWLATALENADGPLPDVGESYYRRFGGLV

SEQ ID NO: 55182 - DNA, 924 bp, Ralstonia eutropha JMP134
  CDS (1)..(924): transl_table=11
atggccactcgttcggcgacacaaccggtttccccgcaggtcgcgcggctcgcacgcggccttaagctcggcgccaattcgatgctcgtgacactgtttggcgatgtggtcgcgccgcggcctcaggcgctgtggctgggcagcctgatccgcctggccgagccgttcggcatcaacgaccggcttgtacgcactgcgacgttccggctgacgtccgatgactggctcaacgccacgcgcatcgggcggcgcagctactacggcttgtccgaggcggggctgcagcgctgcctgcatgccggcaagcgcatctacgccggcgacgcacccgactgggacggccgctggacgttggcgctggtgcgtggcgacgcgcgcgccaccatccgccagcgattgaagcgcgagctgctgtgggaaggcttcggcgcgatcgcgccgggcgtgtatgcgcatccgaatgccgatgcaaactcgctaggcgagatcatccgtgcagcgcatgcgcaggacttcgtcgcggtgatggacgcgaccagcctcgagacattctcgatccgaccgctgcagacgttgatgcaccagacgttcaagctcggcgacgtggcgtccgcgtggcaggcgctgctgcgccgcttctcgcccgtgctggccgacgcacatgccatgacgccggccgacgcctttttcgtacgcacgctgctgctgcacgaataccgccgcgtgctgctgcgcgacccgaacctgccggaacaactgctgcccacggactggcccggtcgcactgcgcgagacctgtgccgtgatatgtacgcggcactgctggatgccagcgaggactatctgcgcgaggttgtggaggtatccgaaggtacgctggccaacgccacccggcttctgcgcaggcgctttgccatggcgtag

SEQ ID NO: 55183 - protein, 307 aa, Ralstonia eutropha JMP134
MATRSATQPVSPQVARLARGLKLGANSMLVTLFGDVVAPRPQALWLGSLIRLAEPFGINDRLVRTATFRLTSDDWLNATRIGRRSYYGLSEAGLQRCLHAGKRIYAGDAPDWDGRWTLALVRGDARATIRQRLKRELLWEGFGAIAPGVYAHPNADANSLGEIIRAAHAQDFVAVMDATSLETFSIRPLQTLMHQTFKLGDVASAWQALLRRFSPVLADAHAMTPADAFFVRTLLLHEYRRVLLRDPNLPEQLLPTDWPGRTARDLCRDMYAALLDASEDYLREVVEVSEGTLANATRLLRRRFAMA

SEQ ID NO: 55184 - DNA, 948 bp, Dechloromonas aromatica RCB
  CDS (1)..(948)
atgagcaccgccatccaatcccgcctgaatgaattccggcaacagcgccgtgtccaggctggctcgctgatcatcaccgtctttggcgacgcgatcctgccgcgcggcggacgcatctggctaggcagcctgatccgcctgctcgaaccactcgaactcaacgaacggctgatccgcacctccgtcttccgtctggtcaaggaggaatggctgcgcaccgaaaccatcggccggcgtgccgactacgtgctgacgccatcgggccgtcggcgtttcgaggaagcttcacgccacatctacgcctcggatgcgccactctgggatcgccgctggcgcctgatcctggtcgtcggcgatctggaccccaagctgcgtgagcaggtccggcgcgccttgttctggcaggggttcggcgccttgggggccgattgcttcgtgcaccctagcgccgagttgtccagcgtgctcgacacgctgattaccgaaggcctgtcatcggccatcggcgcgctgatgcccttgttcgcggccgattcgcgttcggcccagtcggccagcgacgccgacctcgtgcaccgcgcctgggatctcgggcatctggccgaggcctacagcgccttcgtcgccacctatcagcccattctcgacgaactccggcgcgaccatctggccggggtcagcgagcaggatgccttcctgctgcgcatcctgctcatccacgattaccggcgcctgctgctgcgcgatccggaattgccggaagtcctgctgccggccaactggccaggtcagcagtcgcgactgttgtgcaaggaactgtacaagcggctggaacccctcgccagccgccacctcgaccagcagttgtgcctggccgatggacgcgtgccggaagaggacctgtcgctccccgagcgcttcccgcagaacgatccgctatcggcctga

SEQ ID NO: 55185 - protein, 315 aa, Dechloromonas aromatica RCB
MSTAIQSRLNEFRQQRRVQAGSLIITVFGDAILPRGGRIWLGSLIRLLEPLELNERLIRTSVFRLVKEEWLRTETIGRRADYVLTPSGRRRFEEASRHIYASDAPLWDRRWRLILVVGDLDPKLREQVRRALFWQGFGALGADCFVHPSAELSSVLDTLITEGLSSAIGALMPLFAADSRSAQSASDADLVHRAWDLGHLAEAYSAFVATYQPILDELRRDHLAGVSEQDAFLLRILLIHDYRRLLLRDPELPEVLLPANWPGQQSRLLCKELYKRLEPLASRHLDQQLCLADGRVPEEDLSLPERFPQNDPLSA

SEQ ID NO: 55186 - DNA, 843 bp, Ralstonia eutropha JMP134
  CDS (1)..(843)
atgctcgtgacactgtttggcgatgtggtcgcgccgcggcctcaggcgctgtggctgggcagcctgatccgcctggccgagccgttcggcatcaacgaccggcttgtacgcactgcgacgttccggctgacgtccgatgactggctcaacgccacgcgcatcgggcggcgcagctactacggcttgtccgaggcggggctgcagcgctgcctgcatgccggcaagcgcatctacgccggcgacgcacccgactgggacggccgctggacgttggcgctggtgcgtggcgacgcgcgcgccaccatccgccagcgattgaagcgcgagctgctgtgggaaggcttcggcgcgatcgcgccgggcgtgtatgcgcatccgaatgccgatgcaaactcgctaggcgagatcatccgtgcagcgcatgcgcaggacttcgtcgcggtgatggacgcgaccagcctcgagacattctcgatccgaccgctgcagacgttgatgcaccagacgttcaagctcggcgacgtggcgtccgcgtggcaggcgctgctgcgccgcttctcgcccgtgctggccgacgcacatgccatgacgccggccgacgcctttttcgtacgcacgctgctgctgcacgaataccgccgcgtgctgctgcgcgacccgaacctgccggaacaactgctgcccacggactggcccggtcgcactgcgcgagacctgtgccgtgatatgtacgcggcactgctggatgccagcgaggactatctgcgcgaggttgtggaggtatccgaaggtacgctggccaacgccacccggcttctgcgcaggcgctttgccatggcgtag

SEQ ID NO: 55187 - protein, 280 aa, Ralstonia eutropha JMP134
MLVTLFGDVVAPRPQALWLGSLIRLAEPFGINDRLVRTATFRLTSDDWLNATRIGRRSYYGLSEAGLQRCLHAGKRIYAGDAPDWDGRWTLALVRGDARATIRQRLKRELLWEGFGAIAPGVYAHPNADANSLGEIIRAAHAQDFVAVMDATSLETFSIRPLQTLMHQTFKLGDVASAWQALLRRFSPVLADAHAMTPADAFFVRTLLLHEYRRVLLRDPNLPEQLLPTDWPGRTARDLCRDMYAALLDASEDYLREVVEVSEGTLANATRLLRRRFAMA

SEQ ID NO: 55188 - DNA, 816 bp, Brevibacterium linens BL2
  CDS (1)..(816)
atgacggttcacccgcagtcactcttcttcgcgctcgccggcctgcacatgcttgatgaccccaggccgctgagcggggcctcgatcgtgttcgtcatgggcaggctgggtgtgggggagtcggcggccaggtccgtgctgcagcggatggcggcgaagaacttcatcgtgcgacacaaagagggccgcaagaccttctacacgctctccgatcgcggacgggcgattctgcgcgagggtcaggagaagatgttcgccggctggcagccccaggattgggacggccgatggacctttgtgcgcatccaggtgcccgagtcgaagaggacactgcgccaccagatggcgtcgaggctgtcgtgggctggtttcgctcaggtggatggcggcccttgggtggctcccgggccgcatgatgttgccacgatactggggccggagcagtcggtgatctctccgattgtcgtctatggcgagcctaagcccccgacgtccgaagagatgctggcaggcgctttcgacctggcggagttggccgccgactatgagtcgttcggcgagaagtggcgagctgttgatccggattcactgtcgccggttgacgcgctggtcaagcgagtcgagctccacttggattggctggctcttgcgcgtacggacccgcagctgccagcgacgttgttgccgaagggatggccgggggccgcgcagagtatttcgtttcgagagcttgatgctgagttgggcactcgggaagttcatgcagtgtcgggttttttcgcgggagatctgaatgaactctattcatttttgtga

SEQ ID NO: 55189 - protein, 271 aa, Brevibacterium linens BL2
MTVHPQSLFFALAGLHMLDDPRPLSGASIVFVMGRLGVGESAARSVLQRMAAKNFIVRHKEGRKTFYTLSDRGRAILREGQEKMFAGWQPQDWDGRWTFVRIQVPESKRTLRHQMASRLSWAGFAQVDGGPWVAPGPHDVATILGPEQSVISPIVVYGEPKPPTSEEMLAGAFDLAELAADYESFGEKWRAVDPDSLSPVDALVKRVELHLDWLALARTDPQLPATLLPKGWPGAAQSISFRELDAELGTREVHAVSGFFAGDLNELYSFL

SEQ ID NO: 55190 - DNA, 828 bp, Brevibacterium linens BL2
  CDS (1)..(828)
ttgctgcggaccttcgtcggtcttcacctgcgtgacctgggcggttggatccgagtcgctgccctgctcgatcttctcgccaccgccggggtctcgaactcctcaactcgcagcgccgtgtcgagactcaagggcaagggactgctcattccggacaagcgggaggcagtagccggatatcgtttggactcggcggccgtgtccggacttgaacgcggggatcggaggatctttacctaccgtggtcagagagatgacgagccctggtgcctggtgtcctactccctgcccgaggtggaccggtcgaagcgggtgcagctgcgtcgaacactgatggggttgggattcggagcggtcaccgacgggctgtggattgcgcccgggcatctgcgcgccgaagtcgaggacgccctggtcggccttgacgtgcgagaccgggcgacgatcttcatcacgcagacacccctgaccgctgaacccttcgctcaagcggcggcgaaatggtggcagctggacaccctggctgccaggcacaccgaattccttcgccggtacgaacacgctgcgccactgtcggagaactcagccccactgccagagaactcagcgccgaagtcgtctctcgaaccgcgtgaggcgttcgttctgtggctgcactgcgtcgacgagtggaaggcgatcccctacgtcgatccgggccttccacccagcgccctgccctcggactggcccgggatgagaagcgtggaactcttcgcacagctgcgccgcacccaggcggagcctgcccgtgcccacgtccgggagatcagctcagcagagtcgtga

SEQ ID NO: 55191 - protein, 275 aa, Brevibacterium linens BL2
MLRTFVGLHLRDLGGWIRVAALLDLLATAGVSNSSTRSAVSRLKGKGLLIPDKREAVAGYRLDSAAVSGLERGDRRIFTYRGQRDDEPWCLVSYSLPEVDRSKRVQLRRTLMGLGFGAVTDGLWIAPGHLRAEVEDALVGLDVRDRATIFITQTPLTAEPFAQAAAKWWQLDTLAARHTEFLRRYEHAAPLSENSAPLPENSAPKSSLEPREAFVLWLHCVDEWKAIPYVDPGLPPSALPSDWPGMRSVELFAQLRRTQAEPARAHVREISSAES

SEQ ID NO: 55192 - DNA, 885 bp, Exiguobacterium sp. 255-15
  CDS (1)..(885): transl_table=11
atgagtgcgaatacacaatcgatgatttttacggtctacggggattacatccgtcattacggcaatcaaatctgggtcggcagtctgattcgtctgctcaaagagtttggtcataatgaacaggcggtccgggtcgcggtttcccggatggtcaagcaaggctggctcacctcacaaaaacaaggcacgaaaagtttttattcgctgaccccgcgtggtgtcgagcggatggaagaagccgcccggcggatttataaatcgacacctcatgtctgggacggaaaatggcggacgctgatgtacacgattccggaagacaaacggcaaatccgtgatgaattgcggaaagagttgtcgtggagcggattcggaaatttatcgaacggtgtctggatttcgccgaacccactcgaaaaagaagcggaacggttgattgaagcttatgatatcaaggcgtatatcgacttttttgtcggcgaataccacggaccgcaacaggatcaatcactggtcgaacgggcctttccgctcgatgaattacaggaacgatatgaacagttcattgctgagtacagccggcgttacatcgtccatcaaagccggatccagctcggtgaaatggatgaggaacagtgttttgtcgaacggacgacactcgtccatgaataccggaagtttttatttacggatcccggactgccgcaggagctgttgccggatgagtggagcggtcatcacgcggccttgttgtttgaacaatactaccggctgctcgcagaaccggcgagccggttttttgaatccatttttcgtgaaacccacgatgtgacgcaaaaaagtgccgattatgatgcttcggaacatccgttgttcgcagaacgctaa

SEQ ID NO: 55193 - protein, 294 aa, Exiguobacterium sp. 255-15
MSANTQSMIFTVYGDYIRHYGNQIWVGSLIRLLKEFGHNEQAVRVAVSRMVKQGWLTSQKQGTKSFYSLTPRGVERMEEAARRIYKSTPHVWDGKWRTLMYTIPEDKRQIRDELRKELSWSGFGNLSNGVWISPNPLEKEAERLIEAYDIKAYIDFFVGEYHGPQQDQSLVERAFPLDELQERYEQFIAEYSRRYIVHQSRIQLGEMDEEQCFVERTTLVHEYRKFLFTDPGLPQELLPDEWSGHHAALLFEQYYRLLAEPASRFFESIFRETHDVTQKSADYDASEHPLFAER

SEQ ID NO: 55194 - DNA, 1002 bp, Frankia sp. EAN1pec
  CDS (1)..(1002): transl_table=11
gtgacagcgcccgcgcggctcgcaggtcgcgaccgtgatccgggtcgtggccggcgcccgaccgtccgccggccgcaggtcggggcccaaggagcgaatccggcacctccaacggtcgacgtcgtcgacctgcccagggtccaggcgggcgcacagccccagcacctgctcaccaccctgctcggcgattactgggccggccgccgggagcacgtcccgtcggtggtgctggtcagcctgctcgcggatttcgacgtcagcacggtcggtgcccgggcggcgctgagccggctgtcgcggcgcgggctgctggagtcgtcccggatcggccgcaacacctactacgggctgacagcggaggcctcggccgcgatcctcgcgtcggcgaaccggatcttcaccttcggcctgcggcacgacccgtgggacgggcgctggacggtggcggcgttctccatccccgaggaccagcgcgacgtgcggcacgccgtgcgtgcacggctgcgttggctgggcttcgctccgctctacgacgggatgtgggtcaccccgcggtctgccggtgaggcggcccgccgggtgttcgccgagttgggcgtcatcgcgtcgacggtgctgatcacgacgtcggaggcgcgccgcagcgacccccgcccgccgatggccgcctgggatctcaccgagctgcagcgcacctacgaggagttcgtccgcacctacacccccctgttggaacgggtccggcacggcgaggtgtgcggcgcggaggcactggccgcacgcaccgcggtgatggagtcctgggggcgcttcccgagcctcgacccggaccttccgatcgacctgctgcccggccgctggccgcggcgcgaggcccgcacggtcttcgccgagatctacgacgggctggccgtcccggctgtggcgcgggtccgggagctgctggcggaggtgtcgccggagctggccgacctcgtccggctgcgtacgacggtctcctga

SEQ ID NO: 55195 - protein, 333 aa, Frankia sp. EAN1pec
MTAPARLAGRDRDPGRGRRPTVRRPQVGAQGANPAPPTVDVVDLPRVQAGAQPQHLLTTLLGDYWAGRREHVPSVVLVSLLADFDVSTVGARAALSRLSRRGLLESSRIGRNTYYGLTAEASAAILASANRIFTFGLRHDPWDGRWTVAAFSIPEDQRDVRHAVRARLRWLGFAPLYDGMWVTPRSAGEAARRVFAELGVIASTVLITTSEARRSDPRPPMAAWDLTELQRTYEEFVRTYTPLLERVRHGEVCGAEALAARTAVMESWGRFPSLDPDLPIDLLPGRWPRREARTVFAEIYDGLAVPAVARVRELLAEVSPELADLVRLRTTVS

SEQ ID NO: 55196 - DNA, 906 bp, Silicibacter sp. TM1040
  CDS (1)..(906): transl_table=11
atggcagttgggctggcgctaacccgcgccagcccttatcgtatctgcatgacacaacacaccgacgactggtttaccactgcaatcacggcgctcactgaaccggatggcctgagggtctggtccatcatcgtgtccttcctcggagatatggcgcaagacaaaggcgccggcgtcagcagtgctgccttgacgcgggttattactccgcttggcatcaaaccagaggccattcgggttgcgctgcaccgtttgcgtaaggatggctggaccgagagccagcgacgcgggcggggctcctttcatttcctgactccctttgggcggcagcaatccgcgttggtgaccccccgtatctacgcgcgcagcacatgtgaaacagacgcctggaccttgcttgttgcgggcacgccagacgggctggagacgctggatgcgctctgcgaccagacgccactaaccagcatccgggtcaatcgccacgccgcgatcacaccgggccctgccatgcagcacgccgcagagacctcgcacatgctggttgcaaatctcgatgtggcgcatgtgcccggctggctacaggacgatctctttccagaaccattgcggcagagctgcgcggctcttgaccaggcccttgcgcccctcgggagcccaccagacctctctcccttgcaacgcgcctgcctgcgcacgctcctcgtccatcgctggcgccggattacgctccgacacccggacgtgccacgcatatttcaccccgcagattggagcggagaatcctgtcgcacgcgggtctttgccctgctcgacaagttgccgcagcccgaactggcagaaatcgaagacgctgcccctgtggccgtacaagctgcgccccaaggcacaatcgccgtaactggctga

SEQ ID NO: 55197 - protein, 301 aa, Silicibacter sp. TM1040
MAVGLALTRASPYRICMTQHTDDWFTTAITALTEPDGLRVWSIIVSFLGDMAQDKGAGVSSAALTRVITPLGIKPEAIRVALHRLRKDGWTESQRRGRGSFHFLTPFGRQQSALVTPRIYARSTCETDAWTLLVAGTPDGLETLDALCDQTPLTSIRVNRHAAITPGPAMQHAAETSHMLVANLDVAHVPGWLQDDLFPEPLRQSCAALDQALAPLGSPPDLSPLQRACLRTLLVHRWRRITLRHPDVPRIFHPADWSGESCRTRVFALLDKLPQPELAEIEDAAPVAVQAAPQGTIAVTG

SEQ ID NO: 55198 - DNA, 855 bp, Paracoccus denitrificans PD1222
  CDS (1)..(855): transl_table=11
atgcggcagggcgagatggccaagcgcgggctgatcgacgggatattggaggggatggcgctgcgttcggccgcgttcatcgtcaccgtctatggcgatgtggtcgtgccgcgcggcggcgtgttgtggaccggcacgctgatcgaggtctgcgagcgggtcggcatcagcgaatcgctggtgcgcaccgccgtctcgcgccttgtcgccgcccaccggctgcggggcgagcggctggggcggcgcagctattaccggctggacgcctcggcccagcgggagttcgaccaggcggcgcggttgctttacaaacccgaggttccggcgcgcggctggcagatcctgcacgcccccgacctcaccgaggacgaggcccgccaccagcgcatgggccatatgggcggggcggtcttcatccgtcccgaccgcggccagccggtgcccgagggcgcgctgcctttccttgcctcggacccgcccgaactgggccggatcgggcagttctgggatctctcggcgctgcatcagcgttatctcgacatgctggtgcgctttgcgccgctggccgaggcaggggcggcgctgtcggacgagatggcgctgatcgcccggctgctcttggtgcatgattatcgcggcgtcctgctgcgcgatccgcgcctgccgcagcccgccctgccgccggactggcaggggcatgaagcgcgggcgctgttccgccgcctctatcgccagctttcgccggcggcggagcgctggatcgggacgcatttcgagggcagcggcggcttcctgcccgagaaaaccgccgaaagcgaggcgaggctggccgatctgtgccaggcaacagattga

SEQ ID NO: 55199 - protein, 284 aa, Paracoccus denitrificans PD1222
MRQGEMAKRGLIDGILEGMALRSAAFIVTVYGDVVVPRGGVLWTGTLIEVCERVGISESLVRTAVSRLVAAHRLRGERLGRRSYYRLDASAQREFDQAARLLYKPEVPARGWQILHAPDLTEDEARHQRMGHMGGAVFIRPDRGQPVPEGALPFLASDPPELGRIGQFWDLSALHQRYLDMLVRFAPLAEAGAALSDEMALIARLLLVHDYRGVLLRDPRLPQPALPPDWQGHEARALFRRLYRQLSPAAERWIGTHFEGSGGFLPEKTAESEARLADLCQATD

SEQ ID NO: 55200 - DNA, 984 bp, Nocardioides sp. JS614
  CDS (1)..(984): transl_table=11
atgccgcgcccttccttggtgacctccagcggaccgtcgcctgtccgcggcttcatcgccgccatccgcgcaccttcctcttgtgatgtggcagcgggcctccgaggacccggctgcgccgtacgcacggaccattatcccctatccgacggtgacgcggagcacagcccgcccggagcccggccgggctactggcacactcctgacatgcaggcccgctcggcgctcttcgacgtgtacggcgaccacctgcgcgcgcgcggcagcgaggccccggtggccgcgttggtgcggctcctggacccggtcggcatcgcggccccggccgtgcgcacggcgatctcccggatggtgatgcagggctggctcgagccggtccagctcgacggcggccgcggctaccgcaccaccacgcgggcggaccggcgtctcgacgagaccgggcgtcgcgtctaccgccgcgacgcacccgcctgggacggccactggcacctggcgttcgtcagcccgccgccgggccgggccgcccgggcccggctgcgcgccgggctcaccttcatcgggtacgccgagctcgccgaccacgtgtgggtcaccccgttcgagcggaccgagctcggctcggtgctggaccgcgagcgcgccagcgccacgaccgcgcgggccgaccgcttcgaccccccgccgaccggcgcctgggacctggccgccctgcggctggcctacgaggggtggctgcaggccgccgacgacctggtcgaacagcacctcgccgcccacgaggaccccgacgaggccgcgttcgcggcccggttccacctcgtccacgagtggcgcaagttcctcttcaccgaccccgggctgcccgacgccctgctgccgcgcgactggccgggccacgccgcggccgagctgttcgcgggcgcggccggccggctcaagccgggggccgaccggttcgtggcccgctgcctgggcgactga

SEQ ID NO: 55201 - protein, 327 aa, Nocardioides sp. JS614
MPRPSLVTSSGPSPVRGFIAAIRAPSSCDVAAGLRGPGCAVRTDHYPLSDGDAEHSPPGARPGYWHTPDMQARSALFDVYGDHLRARGSEAPVAALVRLLDPVGIAAPAVRTAISRMVMQGWLEPVQLDGGRGYRTTTRADRRLDETGRRVYRRDAPAWDGHWHLAFVSPPPGRAARARLRAGLTFIGYAELADHVWVTPFERTELGSVLDRERASATTARADRFDPPPTGAWDLAALRLAYEGWLQAADDLVEQHLAAHEDPDEAAFAARFHLVHEWRKFLFTDPGLPDALLPRDWPGHAAAELFAGAAGRLKPGADRFVARCLGD

SEQ ID NO: 55202 - DNA, 924 bp, Pseudomonas putida
  CDS (1)..(924): transl_table=11
atgagcaatcttgccccactgaacaacctgatcactcgctttcaggagcagacgccaatccgcgccagctcactgatcatcaccttgtacggcgatgccatcgagccccatggggggaccgtctggctgggtagcctgatcaacctgctggagccgatcggcatcaacgaacgactgatccgcacgtcgatctttcgcctcaccaaagagggttggctcaccgctgaaaaagttggccgacgcagttactacagcctgacgggcactggccgccgccgtttcgaaaaagccttcaaacgtgtctacagcccgagccaaccggcctgggatggcgcctggacgctggtgttgctgtcgcagcttgaggccggcaagcgcaaggccttgcgtgaagagctggaatggcaggggtttggcgttatggcgccgaacctgcttggctgcccacgggcagaccgcgctgatctgaccgcaaccttgcgtgacctggaagccagcgacgacagtatcgtcttcgaaacccacacccaggaagtgctcgcgtccaaggccatgcgcgcccaggtgcgggagagctggcgtatcgatgagctggggcagcagtacagcgagttcatccagctgttcaggccgctgtggcagagcctgaaagagcagcaactgctcgatgcgcaagattgtttcctggcgcgcaccctgctgattcacgagtaccgccgcctgctgttgcgcgacccgcaactgccagacgagctgctgccaggggactgggagggaagggctgcgcggcagttgtgccgcaacctgtatcggctggtgtttgccaaggcagaggagtggctgaatgcagccctggagacggccgacgggcctttgccggatgtgaacgagggtttctaccagcgctttggcgggctggcctga

SEQ ID NO: 55203 - protein, 307 aa, Pseudomonas putida
MSNLAPLNNLITRFQEQTPIRASSLIITLYGDAIEPHGGTVWLGSLINLLEPIGINERLIRTSIFRLTKEGWLTAEKVGRRSYYSLTGTGRRRFEKAFKRVYSPSQPAWDGAWTLVLLSQLEAGKRKALREELEWQGFGVMAPNLLGCPRADRADLTATLRDLEASDDSIVFETHTQEVLASKAMRAQVRESWRIDELGQQYSEFIQLFRPLWQSLKEQQLLDAQDCFLARTLLIHEYRRLLLRDPQLPDELLPGDWEGRAARQLCRNLYRLVFAKAEEWLNAALETADGPLPDVNEGFYQRFGGLA

SEQ ID NO: 55204 - DNA, 927 bp, Klebsiella sp
  CDS (1)..(927): transl_table=11
atgagtaaactcgatacctttattcaacaggccacggaaacgatgcccatcagtggaacctcgcttattgcttctttatacggcgacgccttgctccaacgcggtggggaggtctggctcggcagcgtagcggcgctgctggagggactgggcttcggcgaacgattcgtgcgtactgcgctgttccgcctgaataaagaagagtggcttgacgtggtgcgcattggccgccgaagcttctaccgtctcagcgacaaaggtctgcgcttgactcgccgcgccgaacataaaatctatcgcgtcagcgccccggaatgggacggcacctggctactgctactgtcggaagggcttgagaagagcacgctggcggaggtcaaaaaacagctgctatggcagggatttggcgcgctggcgccgagcctgctggcttcaccgtcgcaaaagctggcggatgtgcaatctctgctgcacgacgcgggcgtggcggaaaatgtcatctgcttcgaagcccactccccgctggcgctctcccgggcggcgctgcgcgcccgcgttgaagagtgctggcatctcaccgaacagaacgcgatgtatgagacgtttatcaatttgtttcgtcctctgctgccgctgcttcgcgactgcgagcccgcagaactgacgcccgaacgctgctttcacattcaactactgctgattcacctctaccgccgggtggtgcttaaggatccgctgctgcccgaagaactgctccctgcacactgggccgggcaaaccgcgcgccagctgtgcatcaatatttatcaacgcgttgcgcccggcgcgctggccttcgtcggcgagaggggcgaaagctcggtgggggaacttcccgcgccggggccgctctatttccagcgtttcggcggactgtcgggcgtataa

SEQ ID NO: 55205 - protein, 308 aa, Klebsiella sp
MSKLDTFIQQATETMPISGTSLIASLYGDALLQRGGEVWLGSVAALLEGLGFGERFVRTALFRLNKEEWLDVVRIGRRSFYRLSDKGLRLTRRAEHKIYRVSAPEWDGTWLLLLSEGLEKSTLAEVKKQLLWQGFGALAPSLLASPSQKLADVQSLLHDAGVAENVICFEAHSPLALSRAALRARVEECWHLTEQNAMYETFINLFRPLLPLLRDCEPAELTPERCFHIQLLLIHLYRRVVLKDPLLPEELLPAHWAGQTARQLCINIYQRVAPGALAFVGERGESSVGELPAPGPLYFQRFGGLSGV

SEQ ID NO: 55206 - DNA, 924 bp, Pseudomonas sp
  CDS (1)..(924): transl_table=11
atgtcgtccctcacaccgctcgaccatctgatcgaccgtttccagcagcagacgccgattcgcgccagttccctgatcatcaccctctatggcgatgccatcgaaccccgtggcggcaccgtgtggctgggcagcctgatccagttgctcgaacccatgggcatcaacgagcggctgatccgcacctcgatctttcgcctgaccaaggaaaactggctgactgccgagaaggtcggccggcgcagctactacagcctgaccggcaccgggcggcggcgtttcgagaaagccttcaagcgggtctacgctgccaatccgccggcctgggatggctcctggtgcctggcggtgctgactcaattgccccaggacaagcgcaagatcgttcgcgaagaactggagtggcagggcttcggcgccatctcgccgggggtgctgggctgcccgcgctgcgaccgggccgacgtcaacgccaccctggtggaccttggcgcccaggaagacaccatcctcttcgaaaccaccgcccaggatgtgctggcctccaaggccctgcgcatgcaggtgcgcgagagctggaagatcgacgaactggcggcgcactacagcgagttcatccagttgttccgccccttgtggcagagcctcaaggaacaggacagcctcgacccgaaagcctgcttcctcgcccgcgtgctgctgattcacgagtaccgcaagctgctgctgcgtgatccgcaattgcccgacgagctgctgccgggcgactgggaaggccgtgctgcccggcagctgtgccgcaacatctaccgcctgatccatggcgctgcggagcagtggctggaagcggcgatggaaaccgccgacgggccgctgcccgaggccggggaaggtttctacaagcgctttggcgggctgggctga

SEQ ID NO: 55207 - protein, 307 aa, Pseudomonas sp
MSSLTPLDHLIDRFQQQTPIRASSLIITLYGDAIEPRGGTVWLGSLIQLLEPMGINERLIRTSIFRLTKENWLTAEKVGRRSYYSLTGTGRRRFEKAFKRVYAANPPAWDGSWCLAVLTQLPQDKRKIVREELEWQGFGAISPGVLGCPRCDRADVNATLVDLGAQEDTILFETTAQDVLASKALRMQVRESWKIDELAAHYSEFIQLFRPLWQSLKEQDSLDPKACFLARVLLIHEYRKLLLRDPQLPDELLPGDWEGRAARQLCRNIYRLIHGAAEQWLEAAMETADGPLPEAGEGFYKRFGGLG

SEQ ID NO: 55208 - DNA, 924 bp, Pseudomonas sp
  CDS (1)..(924): transl_table=11
atgacgtccctcgccccactgaaccgcctgattacccgctttcaggagcagacgccgatccgcgccagctcgctgatcattactttttacggcgacgccatcgagccccacggcggcaccgtttggctgggcagcctgatccagctgctggagccgatgggaatcaacgagcgcttgatccgcacctcgattttccgcctgaccaaggagggctggctgagcgcggaaaaggttggccggcgcagctactacagccttaccggtaccggccggcgccgcttcgagaaggccttcaagcgcgtctacagctccagcctgccggcctgggatggctcctggtgcctggcgttgctctcgcaactgccccaggacaagcgcaaacaggtgcgtgaggaactggagtggcaaggctttggtgcgatctcgcccgtcgtcctggcctgcccgcgctgcgaccgggtggatgtggccgccacgctgcaggatctcgacgccctggaagacaccatcctcttcgacacttacgctcaggacgtgctcgcgtccaaggccctgcgcatgcaggtgcgcgagagctggaagatcgacgaactggcgtcccactacagcgagttcatccagctgttccgtccgctctggcaagccttgcgcgagaaggacagcctacagcctgcggactgcttccttgcccgaatcctgctcatccatgagtaccggaagttgctgctgcgcgacccgcagttgcccgacgaactgctcccgggcgactgggaagggcgcgcggcacggcaactgtgccgcaatatctatcgtctgattcacgctgaagctgagcagtggctgaacgatactctggagaccgctgacggcccgttgccggacgtgggggaaagtttctaccaacgctttggaggattagggtaa

SEQ ID NO: 55209 - protein, 307 aa, Pseudomonas sp
MTSLAPLNRLITRFQEQTPIRASSLIITFYGDAIEPHGGTVWLGSLIQLLEPMGINERLIRTSIFRLTKEGWLSAEKVGRRSYYSLTGTGRRRFEKAFKRVYSSSLPAWDGSWCLALLSQLPQDKRKQVREELEWQGFGAISPVVLACPRCDRVDVAATLQDLDALEDTILFDTYAQDVLASKALRMQVRESWKIDELASHYSEFIQLFRPLWQALREKDSLQPADCFLARILLIHEYRKLLLRDPQLPDELLPGDWEGRAARQLCRNIYRLIHAEAEQWLNDTLETADGPLPDVGESFYQRFGGLG

SEQ ID NO: 55210 - DNA, 618 bp, Azoarcus evansii
  CDS (1)..(618): transl_table=11
atgaaaagccgttttctcgaacagtggatcaacgactacctggccgagcgccgggtgcgcgcgaactccctgatcatcaccgtctacggcgacttcatcgcgccgcacggcggcaccgtctggctcggcagcttcatccggctggtcgagcccctgggcctgaacgagcgaatggtgcgcaccagcgtgtatcgcctgtcgcaggacaactggctggaatcggaacagatcgggcgcaagagctactacagcctcacggcctcgggccgccggcgcttcgagcacgcctaccgccgcatctacgacaccccgcaggacacctggaacggcgaatggcagctggtcgtgctgccgtccacgctgggctcgcccgagcgcgacaccctgcgcaaggagctgtcgtgggcgggttacggcaacgtcgcaccgggcgtcatgggccacccatcgcccgacaccgaaacgctgcaggaaatccttcaggacaccggcacgcaggacaaggtcgtgcccatgcaggcgtcgacgatcggcgccctgtcgaccaagccgctgcaggatcttgcacgcgaatgctggaatctcgacgccatcgaggcgacctacagcgaattctag

SEQ ID NO: 55211 - protein, 205 aa, Azoarcus evansii
MKSRFLEQWINDYLAERRVRANSLIITVYGDFIAPHGGTVWLGSFIRLVEPLGLNERMVRTSVYRLSQDNWLESEQIGRKSYYSLTASGRRRFEHAYRRIYDTPQDTWNGEWQLVVLPSTLGSPERDTLRKELSWAGYGNVAPGVMGHPSPDTETLQEILQDTGTQDKVVPMQASTIGALSTKPLQDLARECWNLDAIEATYSEF

SEQ ID NO: 55212 - DNA, 27 bp, Artificial sequence
  (1)..(27): primer
atgagtaaacttgatacttttatccaa

SEQ ID NO: 55213 - DNA, 26 bp, Artificial sequence
  (1)..(26): primer
ttatctgataaattggcataacgcct

SEQ ID NO: 55214 - protein, 276 aa, Artificial sequence
  Variant (4)..(4): xaa in position 4 is any amino acid
  Variant (10)..(10): xaa in position 10 is any amino acid
  Variant (12)..(16): xaa in position 12 to 16 is any amino acid
  Variant (17)..(17): xaa in position 17 is any or no amino acid
  Variant (19)..(22): xaa in position 19 to 22 is any amino acid
  Variant (25)..(25): xaa in position 25 is any amino acid
  Variant (28)..(30): xaa in position 28 to 30 is any amino acid
  Variant (32)..(36): xaa in position 32 to 36 is any amino acid
  Variant (39)..(39): xaa in position 39 is any amino acid
  Variant (42)..(42): xaa in position 42 is any amino acid
  Variant (45)..(49): xaa in position 45 to 49 is any amino acid
  Variant (51)..(53): xaa in position 51 to 53 is any amino acid
  Variant (55)..(56): xaa in position 55 to 56 is any or no amino acid
  Variant (58)..(59): xaa in position 58 to 59 is any amino acid
  Variant (61)..(61): xaa in position 61 is any or no amino acid
  Variant (63)..(63): xaa in position 63 is any amino acid
  Variant (66)..(67): xaa in position 66 to 67 is any amino acid
  Variant (69)..(74): xaa in position 69 to 74 is any amino acid
  Variant (76)..(77): xaa in position 76 to 77 is any amino acid
  Variant (81)..(87): xaa in position 81 to 87 is any amino acid
  Variant (88)..(92): xaa in position 88 to 92 is any or no amino acid
  Variant (94)..(94): xaa in position 94 is any amino acid
  Variant (96)..(99): xaa in position 96 to 99 is any amino acid
  Variant (100)..(108): xaa in position 100 to 108 is any or no amino acid
  Variant (110)..(111): xaa in position 110 to 111 is any amino acid
  Variant (114)..(115): xaa in position 114 to 115 is any amino acid
  Variant (117)..(119): xaa in position 117 to 119 is any amino acid
  Variant (123)..(123): xaa in position 123 is any amino acid
  Variant (125)..(131): xaa in position 125 to 131 is any amino acid
  Variant (133)..(138): xaa in position 133 to 138 is any amino acid
  Variant (139)..(145): xaa in position 139 to 145 is any or no amino acid
  Variant (147)..(163): xaa in position 147 to 163 is any amino acid
  Variant (164)..(181): xaa in position 164 to 181 is any or no amino acid
  Variant (183)..(183): xaa in position 183 is any amino acid
  Variant (185)..(186): xaa in position 185 to 186 is any amino acid
  Variant (188)..(190): xaa in position 188 to 190 is any amino acid
  Variant (192)..(193): xaa in position 192 to 193 is any amino acid
  Variant (195)..(208): xaa in position 195 to 208 is any amino acid
  Variant (209)..(226): xaa in position 209 to 226 is any or no amino acid
  Variant (228)..(232): xaa in position 228 to 232 is any amino acid
  Variant (236)..(236): xaa in position 236 is any amino acid
  Variant (239)..(243): xaa in position 239 to 243 is any amino acid
  Variant (246)..(246): xaa in position 246 is any amino acid
  Variant (249)..(250): xaa in position 249 to 250 is any amino acid
  Variant (254)..(255): xaa in position 254 to 255 is any amino acid
  Variant (257)..(257): xaa in position 257 is any amino acid
  Variant (259)..(260): xaa in position 259 to 260 is any amino acid
  Variant (262)..(263): xaa in position 262 to 263 is any amino acid
  Variant (265)..(271): xaa in position 265 to 271 is any amino acid
  Variant (273)..(275): xaa in position 273 to 275 is any amino acid
SLIXTLYGDXIXXXXXXVXXXXLIXLLXXXGXXXXXVRXAVXRLXXXXXLXXXRXXGXXSXYXLSXXGXXXXXXAXXRIYXXXXXXXXXXXXWXLXXXXXXXXXXXXXRXXLRXXLXXXGFGXLXXXXXXXPXXXXXXXXXXXXXLXXXXXXXXXXXXXXXXXXXXXXXXXXXXXXXXXXXWXLXXLXXXYXXFXXXXXXXXXXXXXXXXXXXXXXXXXXXXXXXXFXXXXXLVHXYRXXXXXDPXLPXXLLPXXWXGXXAXXLXXXXXXXLXXXA

SEQ ID NO: 55215 - protein, 73 aa, Artificial sequence
  Variant (2)..(23): xaa in position 2 to 23 is any amino acid
  Variant (25)..(30): xaa in position 25 to 30 is any amino acid
  Variant (32)..(32): xaa in position 32 is Ala, Gly, Ser, Thr or Val
  Variant (33)..(33): xaa in position 33 is Ala, Gly, Ser or Val
  Variant (34)..(35): xaa in position 34 to 35 is any amino acid
  Variant (37)..(52): xaa in position 37 to 52 is any amino acid
  Variant (53)..(56): xaa in position 53 to 56 is any or no amino acid
  Variant (58)..(58): xaa in position 58 is Ala, Asp, Ser or Thr
  Variant (59)..(60): xaa in position 59 to 60 is any amino acid
  Variant (61)..(61): xaa in position 61 is Ala, Gly or Thr
  Variant (62)..(67): xaa in position 62 to 67 is any amino acid
  Variant (68)..(68): xaa in position 68 is Ala, Gly or Val
  Variant (69)..(71): xaa in position 69 to 71 is any amino acid
  Variant (72)..(72): xaa in position 72 is Ile, Leu, Met or Val
  Variant (73)..(73): xaa in position 73 is Phe or Tyr
GXXXXXXXXXXXXXXXXXXXXXXGXXXXXXRXXXXRXXXXXXXXXXXXXXXXXXXXLXXXXXXXXXXXXXXXX

SEQ ID NO: 55216 - protein, 24 aa, Artificial sequence
  Variant (2)..(3): xaa in position 2 to 3 is any amino acid
  Variant (4)..(4): xaa in position 4 is any or no amino acid
  Variant (6)..(9): xaa in position 6 to 9 is any amino acid
  Variant (10)..(11): xaa in position 10 to 11 is any or no amino acid
  Variant (13)..(13): xaa in position 13 is Phe or Tyr
  Variant (14)..(14): xaa in position 14 is Ala or Gly
  Variant (15)..(21): xaa in position 15 to 21 is any amino acid
  Variant (22)..(22): xaa in position 22 is Ala, Gly, Ile, Leu or Val
  Variant (23)..(23): xaa in position 23 is any amino acid
  Variant (24)..(24): xaa in position 24 is Pro or Val
RXXXRXXXXXXGXXXXXXXXXXXX

SEQ ID NO: 55217 - protein, 21 aa, Artificial sequence
  Variant (2)..(6): xaa in position 2 to 6 is any amino acid
  Variant (7)..(7): xaa in position 7 is Asp, Glu or His
  Variant (9)..(9): xaa in position 9 is any amino acid
  Variant (10)..(10): xaa in position 10 is Phe, Ile, Leu or Val
  Variant (12)..(15): xaa in position 12 to 15 is any amino acid
  Variant (17)..(18): xaa in position 17 to 18 is any amino acid
  Variant (20)..(20): xaa in position 20 is any amino acid
RXXXXXXPXXPXXXXPXXWXG

SEQ ID NO: 55218 - DNA, 1758 bp, Escherichia coli K12; identical to SEQ ID NO: 20139
  CDS (1)..(1758): transl_table=11

SEQ ID NO: 55219 - protein, 585 aa, Escherichia coli K12; identical to SEQ ID NO: 20140

SEQ ID NO: 55220 - DNA, 1761 bp, Pseudomonas aeruginosa PAO1; identical to SEQ ID NO: 20141
  CDS (1)..(1761): transl_table=11

SEQ ID NO: 55221 - protein, 586 aa, Pseudomonas aeruginosa PAO1; identical to SEQ ID NO: 20142

SEQ ID NO: 55222 - DNA, 1764 bp, Yersinia pestis CO92; identical to SEQ ID NO: 20143
  CDS (1)..(1764): transl_table=11

SEQ ID NO: 55223 - protein, 587 aa, Yersinia pestis CO92; identical to SEQ ID NO: 20144

SEQ ID NO: 55224 - DNA, 1701 bp, Fusobacterium nucleatum subsp. nucleatum ATCC 25586; identical to SEQ ID NO: 20145
  CDS (1)..(1701): transl_table=11

SEQ ID NO: 55225 - protein, 566 aa, Fusobacterium nucleatum subsp. nucleatum ATCC 25586; identical to SEQ ID NO: 20146

SEQ ID NO: 55226 - DNA, 1761 bp, Xanthomonas axonopodis pv. citri str. 306; identical to SEQ ID NO: 20147
  CDS (1)..(1761): transl_table=11

SEQ ID NO: 55227 - protein, 586 aa, Xanthomonas axonopodis pv. citri str. 306; identical to SEQ ID NO: 20148

SEQ ID NO: 55228 - DNA, 1764 bp, Yersinia pestis KIM; identical to SEQ ID NO: 20149
  CDS (1)..(1764): transl_table=11

SEQ ID NO: 55229 - protein, 587 aa, Yersinia pestis KIM; identical to SEQ ID NO: 20150

SEQ ID NO: 55230 - DNA, 1758 bp, Escherichia coli CFT073; identical to SEQ ID NO: 20151
  CDS (1)..(1758): transl_table=11

SEQ ID NO: 55231 - protein, 585 aa, Escherichia coli CFT073; identical to SEQ ID NO: 20152

SEQ ID NO: 55232 - DNA, 1758 bp, Pseudomonas syringae pv. tomato str. DC3000; identical to SEQ ID NO: 20153
  CDS (1)..(1758): transl_table=11

SEQ ID NO: 55233 - protein, 585 aa, Pseudomonas syringae pv. tomato str. DC3000; identical to SEQ ID NO: 20154

SEQ ID NO: 55234 - DNA, 1764 bp, Yersinia pseudotuberculosis IP 32953; identical to SEQ ID NO: 20155
  CDS (1)..(1764): transl_table=11

SEQ ID NO: 55235 - protein, 587 aa, Yersinia pseudotuberculosis IP 32953; identical to SEQ ID NO: 20156

SEQ ID NO: 55236 - DNA, 1764 bp, Xanthomonas campestris pv. campestris str. 8004; identical to SEQ ID NO: 20157
  CDS (1)..(1764): transl_table=11

SEQ ID NO: 55237 - protein, 587 aa, Xanthomonas campestris pv. campestris str. 8004; identical to SEQ ID NO: 20158

SEQ ID NO: 55238 - DNA, 1758 bp, Pseudomonas fluorescens Pf-5; identical to SEQ ID NO: 20159
  CDS (1)..(1758): transl_table=11

SEQ ID NO: 55239 - protein, 585 aa, Pseudomonas fluorescens Pf-5; identical to SEQ ID NO: 20160

SEQ ID NO: 55240 - DNA, 1776 bp, Ralstonia eutropha JMP134; identical to SEQ ID NO: 20161
  CDS (1)..(1776): transl_table=11

SEQ ID NO: 55241 - protein, 591 aa, Ralstonia eutropha JMP134; identical to SEQ ID NO: 20162

SEQ ID NO: 55242 - DNA, 1713 bp, Fusobacterium nucleatum subsp. vincentii ATCC 49256; identical to SEQ ID NO: 20163
  CDS (1)..(1713): transl_table=11

SEQ ID NO: 55243 - protein, 570 aa, Fusobacterium nucleatum subsp. vincentii ATCC 49256; identical to SEQ ID NO: 20164

SEQ ID NO: 55244 - DNA, 1791 bp, Ralstonia eutropha JMP134; identical to SEQ ID NO: 20165
  CDS (1)..(1791)

SEQ ID NO: 55245 - protein, 596 aa, Ralstonia eutropha JMP134; identical to SEQ ID NO: 20166

SEQ ID NO: 55246 - DNA, 1761 bp, Pseudomonas aeruginosa UCBPP-PA14; identical to SEQ ID NO: 20167
  CDS (1)..(1761)

SEQ ID NO: 55247 - protein, 586 aa, Pseudomonas aeruginosa UCBPP-PA14; identical to SEQ ID NO: 20168

SEQ ID NO: 55248 - DNA, 1758 bp, Burkholderia cepacia R18194; identical to SEQ ID NO: 20169
  CDS (1)..(1758)

SEQ ID NO: 55249 - protein, 585 aa, Burkholderia cepacia R18194; identical to SEQ ID NO: 20170

SEQ ID NO: 55250 - DNA, 1770 bp, Burkholderia vietnamiensis G4; identical to SEQ ID NO: 20171
  CDS (1)..(1770): transl_table=11

SEQ ID NO: 55251 - protein, 589 aa, Burkholderia vietnamiensis G4; identical to SEQ ID NO: 20172

SEQ ID NO: 55252 - DNA, 1770 bp, Burkholderia cenocepacia AU 1054; identical to SEQ ID NO: 20173
  CDS (1)..(1770): transl_table=11

SEQ ID NO: 55253 - protein, 589 aa, Burkholderia cenocepacia AU 1054; identical to SEQ ID NO: 20174

SEQ ID NO: 55254 - DNA, 1800 bp, Burkholderia ambifaria AMMD; identical to SEQ ID NO: 20175
  CDS (1)..(1800): transl_table=11

SEQ ID NO: 55255 - protein, 599 aa, Burkholderia ambifaria AMMD; identical to SEQ ID NO: 20176

SEQ ID NO: 55256 - DNA, 23 bp, Artificial sequence
  (1)..(23): primer
atggaaaattcacgcatccctgg

SEQ ID NO: 55257 - DNA, 24 bp, Artificial sequence
  (1)..(24): primer
ttagttatcacgacgcaccgccat

SEQ ID NO: 55258 - protein, 589 aa, Artificial sequence; identical to SEQ ID NO: 20179
  Variant (2)..(4): xaa in position 2 to 4 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (22)..(29): xaa in position 22 to 29 is any amino acid
  Variant (30)..(35): xaa in position 30 to 35 is any or no amino acid
  Variant (39)..(39): xaa in position 39 is any amino acid
  Variant (50)..(50): xaa in position 50 is any amino acid
  Variant (53)..(53): xaa in position 53 is any amino acid
  Variant (57)..(57): xaa in position 57 is any amino acid
  Variant (60)..(62): xaa in position 60 to 62 is any amino acid
  Variant (73)..(73): xaa in position 73 is any amino acid
  Variant (75)..(75): xaa in position 75 is any amino acid
  Variant (77)..(77): xaa in position 77 is any amino acid
  Variant (80)..(80): xaa in position 80 is any or no amino acid
  Variant (83)..(87): xaa in position 83 to 87 is any amino acid
  Variant (89)..(89): xaa in position 89 is any amino acid
  Variant (92)..(93): xaa in position 92 to 93 is any amino acid
  Variant (96)..(97): xaa in position 96 to 97 is any amino acid
  Variant (99)..(103): xaa in position 99 to 103 is any amino acid
  Variant (105)..(106): xaa in position 105 to 106 is any amino acid
  Variant (108)..(108): xaa in position 108 is any amino acid
  Variant (110)..(110): xaa in position 110 is any amino acid
  Variant (121)..(121): xaa in position 121 is any amino acid
  Variant (125)..(125): xaa in position 125 is any amino acid
  Variant (131)..(131): xaa in position 131 is any amino acid
  Variant (134)..(134): xaa in position 134 is any amino acid
  Variant (143)..(143): xaa in position 143 is any amino acid
  Variant (153)..(153): xaa in position 153 is any amino acid
  Variant (156)..(156): xaa in position 156 is any amino acid
  Variant (159)..(161): xaa in position 159 to 161 is any amino acid
  Variant (164)..(164): xaa in position 164 is any amino acid
  Variant (173)..(173): xaa in position 173 is any amino acid
  Variant (180)..(181): xaa in position 180 to 181 is any amino acid
  Variant (184)..(184): xaa in position 184 is any amino acid
  Variant (187)..(188): xaa in position 187 to 188 is any amino acid
  Variant (190)..(190): xaa in position 190 is any amino acid
  Variant (193)..(193): xaa in position 193 is any amino acid
  Variant (195)..(195): xaa in position 195 is any amino acid
  Variant (199)..(199): xaa in position 199 is any amino acid
  Variant (203)..(203): xaa in position 203 is any amino acid
  Variant (206)..(207): xaa in position 206 to 207 is any amino acid
  Variant (209)..(209): xaa in position 209 is any amino acid
  Variant (213)..(213): xaa in position 213 is any amino acid
  Variant (216)..(216): xaa in position 216 is any amino acid
  Variant (219)..(219): xaa in position 219 is any amino acid
  Variant (229)..(229): xaa in position 229 is any amino acid
  Variant (235)..(236): xaa in position 235 to 236 is any amino acid
  Variant (239)..(240): xaa in position 239 to 240 is any amino acid
  Variant (243)..(244): xaa in position 243 to 244 is any amino acid
  Variant (246)..(246): xaa in position 246 is any amino acid
  Variant (248)..(249): xaa in position 248 to 249 is any amino acid
  Variant (252)..(254): xaa in position 252 to 254 is any amino acid
  Variant (256)..(256): xaa in position 256 is any amino acid
  Variant (269)..(270): xaa in position 269 to 270 is any amino acid
  Variant (272)..(277): xaa in position 272 to 277 is any amino acid
  Variant (280)..(282): xaa in position 280 to 282 is any amino acid
  Variant (284)..(295): xaa in position 284 to 295 is any amino acid
  Variant (298)..(307): xaa in position 298 to 307 is any amino acid
  Variant (309)..(310): xaa in position 309 to 310 is any amino acid
  Variant (312)..(317): xaa in position 312 to 317 is any amino acid
  Variant (318)..(321): xaa in position 318 to 321 is any or no amino acid
  Variant (323)..(328): xaa in position 323 to 328 is any amino acid
  Variant (331)..(335): xaa in position 331 to 335 is any amino acid
  Variant (337)..(337): xaa in position 337 is any amino acid
  Variant (340)..(340): xaa in position 340 is any amino acid
  Variant (343)..(345): xaa in position 343 to 345 is any amino acid
  Variant (360)..(362): xaa in position 360 to 362 is any amino acid
  Variant (364)..(366): xaa in position 364 to 366 is any amino acid
  Variant (369)..(370): xaa in position 369 to 370 is any amino acid
  Variant (373)..(374): xaa in position 373 to 374 is any amino acid
  Variant (377)..(377): xaa in position 377 is any amino acid
  Variant (379)..(379): xaa in position 379 is any amino acid
  Variant (382)..(382): xaa in position 382 is any amino acid
  Variant (386)..(386): xaa in position 386 is any amino acid
  Variant (389)..(390): xaa in position 389 to 390 is any amino acid
  Variant (392)..(393): xaa in position 392 to 393 is any amino acid
  Variant (396)..(397): xaa in position 396 to 397 is any amino acid
  Variant (400)..(401): xaa in position 400 to 401 is any amino acid
  Variant (403)..(406): xaa in position 403 to 406 is any amino acid
  Variant (407)..(408): xaa in position 407 to 408 is any or no amino acid
  Variant (427)..(433): xaa in position 427 to 433 is any amino acid
  Variant (434)..(440): xaa in position 434 to 440 is any or no amino acid
  Variant (448)..(449): xaa in position 448 to 449 is any amino acid
  Variant (452)..(453): xaa in position 452 to 453 is any amino acid
  Variant (455)..(456): xaa in position 455 to 456 is any amino acid
  Variant (459)..(461): xaa in position 459 to 461 is any amino acid
  Variant (463)..(465): xaa in position 463 to 465 is any amino acid
  Variant (468)..(468): xaa in position 468 is any or no amino acid
  Variant (470)..(471): xaa in position 470 to 471 is any amino acid
  Variant (473)..(473): xaa in position 473 is any amino acid
  Variant (477)..(479): xaa in position 477 to 479 is any amino acid
  Variant (482)..(482): xaa in position 482 is any amino acid
  Variant (484)..(484): xaa in position 484 is any amino acid
  Variant (486)..(486): xaa in position 486 is any amino acid
  Variant (500)..(500): xaa in position 500 is any amino acid
  Variant (503)..(504): xaa in position 503 to 504 is any amino acid
  Variant (506)..(507): xaa in position 506 to 507 is any amino acid
  Variant (510)..(510): xaa in position 510 is any amino acid
  Variant (514)..(514): xaa in position 514 is any amino acid
  Variant (517)..(518): xaa in position 517 to 518 is any amino acid
  Variant (521)..(521): xaa in position 521 is any amino acid
  Variant (534)..(535): xaa in position 534 to 535 is any amino acid
  Variant (538)..(539): xaa in position 538 to 539 is any amino acid
  Variant (541)..(542): xaa in position 541 to 542 is any amino acid
  Variant (545)..(548): xaa in position 545 to 548 is any amino acid
  Variant (549)..(549): xaa in position 549 is any or no amino acid
  Variant (554)..(554): xaa in position 554 is any amino acid
  Variant (558)..(558): xaa in position 558 is any amino acid
  Variant (562)..(562): xaa in position 562 is any amino acid
  Variant (565)..(566): xaa in position 565 to 566 is any amino acid
  Variant (570)..(570): xaa in position 570 is any amino acid
  Variant (572)..(573): xaa in position 572 to 573 is any amino acid
  Variant (575)..(575): xaa in position 575 is any amino acid
  Variant (578)..(579): xaa in position 578 to 579 is any amino acid
  Variant (588)..(588): xaa in position 588 is any amino acid

SEQ ID NO: 55259 - protein, 9 aa, Artificial sequence
  Variant (8)..(8): xaa in position 8 is Ala or Gly
HRGHEHSXR

SEQ ID NO: 55260 - protein, 96 aa, Artificial sequence; identical to SEQ ID NO: 20181
  Variant (5)..(5): xaa in position 5 is any amino acid
  Variant (6)..(6): xaa in position 6 is Ile, Leu or Val
  Variant (8)..(8): xaa in position 8 is Ala, Cys, Gly or Ser
  Variant (9)..(9): xaa in position 9 is Leu or Met
  Variant (11)..(11): xaa in position 11 is Leu or Val
  Variant (17)..(17): xaa in position 17 is any amino acid
  Variant (18)..(18): xaa in position 18 is Ile or Val
  Variant (24)..(24): xaa in position 24 is Phe or Leu
  Variant (27)..(27): xaa in position 27 is any amino acid
  Variant (30)..(30): xaa in position 30 is any amino acid
  Variant (32)..(35): xaa in position 32 to 35 is any amino acid
  Variant (36)..(36): xaa in position 36 is Lys or Arg
  Variant (38)..(38): xaa in position 38 is any amino acid
  Variant (40)..(40): xaa in position 40 is Phe or Tyr
  Variant (41)..(41): xaa in position 41 is Ile or Val
  Variant (42)..(42): xaa in position 42 is Asn or Thr
  Variant (47)..(47): xaa in position 47 is Ala, Gly or Pro
  Variant (48)..(48): xaa in position 48 is any amino acid
  Variant (49)..(49): xaa in position 49 is Phe, Trp or Tyr
  Variant (51)..(51): xaa in position 51 is Ser or Thr
  Variant (54)..(54): xaa in position 54 is any amino acid
  Variant (55)..(55): xaa in position 55 is Ala, Glu or Gln
  Variant (57)..(57): xaa in position 57 is Ile or Val
  Variant (58)..(58): xaa in position 58 is any amino acid
  Variant (60)..(60): xaa in position 60 is Phe or Tyr
  Variant (61)..(61): xaa in position 61 is any amino acid
  Variant (62)..(62): xaa in position 62 is Ala, Asn, Gln, Ser or Thr
  Variant (64)..(64): xaa in position 64 is any amino acid
  Variant (66)..(66): xaa in position 66 is Ile or Val
  Variant (67)..(67): xaa in position 67 is Ala or Thr
  Variant (68)..(68): xaa in position 68 is Lys or Arg
  Variant (69)..(69): xaa in position 69 is any amino acid
  Variant (71)..(71): xaa in position 71 is Ala or Ser
  Variant (73)..(73): xaa in position 73 is Asn or Arg
  Variant (74)..(74): xaa in position 74 is Ile, Met or Val
  Variant (77)..(77): xaa in position 77 is Asp or Gly
  Variant (79)..(79): xaa in position 79 is His or Tyr
  Variant (80)..(80): xaa in position 80 is any amino acid
  Variant (81)..(81): xaa in position 81 is Ala or Thr
  Variant (82)..(82): xaa in position 82 is Ala, Gly or Ser
  Variant (83)..(83): xaa in position 83 is any amino acid
  Variant (85)..(85): xaa in position 85 is Ile or Val
  Variant (87)..(87): xaa in position 87 is Ala, Asp or Ser
  Variant (89)..(89): xaa in position 89 is Ala or Ser
  Variant (90)..(90): xaa in position 90 is Ala, Gln or Thr
  Variant (93)..(93): xaa in position 93 is Gln or Thr
  Variant (94)..(94): xaa in position 94 is Ile, Leu or Val

SEQ ID NO: 55261 - protein, 53 aa, Artificial sequence; identical to SEQ ID NO: 20182
  Variant (2)..(2): xaa in position 2 is any amino acid
  Variant (4)..(4): xaa in position 4 is any amino acid
  Variant (5)..(5): xaa in position 5 is any or no amino acid
  Variant (7)..(7): xaa in position 7 is any or no amino acid
  Variant (9)..(9): xaa in position 9 is any amino acid
  Variant (10)..(10): xaa in position 10 is Asp, Glu, Gln, Arg or Ser
  Variant (11)..(11): xaa in position 11 is any amino acid
  Variant (18)..(18): xaa in position 18 is Ser or Thr
  Variant (22)..(22): xaa in position 22 is Ile or Val
  Variant (24)..(24): xaa in position 24 is Gln or Arg
  Variant (26)..(26): xaa in position 26 is any amino acid
  Variant (27)..(27): xaa in position 27 is Ala or Pro
  Variant (28)..(28): xaa in position 28 is any amino acid
  Variant (30)..(31): xaa in position 30 to 31 is any amino acid
  Variant (32)..(32): xaa in position 32 is Ala, Gly, Ile or Pro
  Variant (33)..(33): xaa in position 33 is Phe, Ile, Leu or Val
  Variant (35)..(36): xaa in position 35 to 36 is any amino acid
  Variant (37)..(37): xaa in position 37 is Ile or Val
  Variant (39)..(39): xaa in position 39 is His, Lys or Arg
  Variant (40)..(40): xaa in position 40 is any amino acid
  Variant (43)..(43): xaa in position 43 is Asp, Asn or Gln
  Variant (44)..(44): xaa in position 44 is Ala or Ser
  Variant (45)..(45): xaa in position 45 is Ile, Pro or Val
  Variant (48)..(48): xaa in position 48 is any amino acid
  Variant (52)..(52): xaa in position 52 is any amino acid

SEQ ID NO: 55262 - protein, 93 aa, Artificial sequence; identical to SEQ ID NO: 20183
  Variant (7)..(7): xaa in position 7 is Ala, Gly, Pro or Ser
  Variant (8)..(8): xaa in position 8 is Asp, Glu or Ser
  Variant (10)..(11): xaa in position 10 to 11 is any amino acid
  Variant (12)..(12): xaa in position 12 is Ile or Val
  Variant (13)..(14): xaa in position 13 to 14 is any amino acid
  Variant (17)..(17): xaa in position 17 is any amino acid
  Variant (20)..(20): xaa in position 20 is Ala or Gly
  Variant (21)..(21): xaa in position 21 is Ala, Glu, Asn, Gln or Ser
  Variant (23)..(23): xaa in position 23 is Ile, Leu or Val
  Variant (24)..(24): xaa in position 24 is any amino acid
  Variant (25)..(25): xaa in position 25 is Glu or Pro
  Variant (27)..(27): xaa in position 27 is Ala or Gly
  Variant (28)..(28): xaa in position 28 is any amino acid
  Variant (30)..(30): xaa in position 30 is Ile, Leu or Val
  Variant (41)..(41): xaa in position 41 is Glu or Lys
  Variant (42)..(42): xaa in position 42 is any amino acid
  Variant (45)..(45): xaa in position 45 is any amino acid
  Variant (46)..(46): xaa in position 46 is Ala, Thr or Val
  Variant (48)..(48): xaa in position 48 is Asn or Thr
  Variant (49)..(49): xaa in position 49 is Asn or Ser
  Variant (51)..(51): xaa in position 51 is any amino acid
  Variant (52)..(52): xaa in position 52 is Ala, Asp, Glu, Gly, Asn or Gln
  Variant (53)..(53): xaa in position 53 is Asp, Glu or Gly
  Variant (54)..(54): xaa in position 54 is any amino acid
  Variant (55)..(55): xaa in position 55 is Ala, Pro or Thr
  Variant (57)..(57): xaa in position 57 is Met or Val
  Variant (60)..(60): xaa in position 60 is any amino acid
  Variant (62)..(62): xaa in position 62 is Ser or Thr
  Variant (64)..(64): xaa in position 64 is any amino acid
  Variant (68)..(68): xaa in position 68 is Glu, Gly, Gln, Ser or Thr
  Variant (71)..(72): xaa in position 71 to 72 is any amino acid
  Variant (76)..(76): xaa in position 76 is Asp, Glu or Arg
  Variant (78)..(81): xaa in position 78 to 81 is any amino acid
  Variant (82)..(82): xaa in position 82 is Ile or Val
  Variant (84)..(85): xaa in position 84 to 85 is any amino acid
  Variant (89)..(89): xaa in position 89 is Ser or Thr
  Variant (92)..(92): xaa in position 92 is Leu or Met

SEQ ID NO: 55263 - DNA, 291 bp, Escherichia coli K12; identical to SEQ ID NO: 18608
  CDS (1)..(291): transl_table=11

SEQ ID NO: 55264 - protein, 96 aa, Escherichia coli K12; identical to SEQ ID NO: 18609

SEQ ID NO: 55265 - DNA, 216 bp, Bacteriophage 933W; identical to SEQ ID NO: 18610
  CDS (1)..(216): transl_table=11

SEQ ID NO: 55266 - protein, 71 aa, Bacteriophage 933W; identical to SEQ ID NO: 18611

SEQ ID NO: 55267 - DNA, 291 bp, Bacteriophage VT2-Sa; identical to SEQ ID NO: 18612
  CDS (1)..(291): transl_table=11

SEQ ID NO: 55268 - protein, 96 aa, Bacteriophage VT2-Sa; identical to SEQ ID NO: 18613

SEQ ID NO: 55269 - DNA, 315 bp, Escherichia coli O157:H7 EDL933; identical to SEQ ID NO: 18614
  CDS (1)..(315): transl_table=11

SEQ ID NO: 55270 - protein, 104 aa, Escherichia coli O157:H7 EDL933; identical to SEQ ID NO: 18615

SEQ ID NO: 55271 - DNA, 315 bp, Escherichia coli O157:H7 EDL933; identical to SEQ ID NO: 18616
  CDS (1)..(315): transl_table=11

SEQ ID NO: 55272 - protein, 104 aa, Escherichia coli O157:H7 EDL933; identical to SEQ ID NO: 18617

SEQ ID NO: 55273 - DNA, 273 bp, Escherichia coli O157:H7 EDL933; identical to SEQ ID NO: 18618
  CDS (1)..(273): transl_table=11

SEQ ID NO: 55274 - protein, 90 aa, Escherichia coli O157:H7 EDL933; identical to SEQ ID NO: 18619

SEQ ID NO: 55275 - DNA, 216 bp, Escherichia coli O157:H7; identical to SEQ ID NO: 18620
  CDS (1)..(216): transl_table=11

SEQ ID NO: 55276 - protein, 71 aa, Escherichia coli O157:H7; identical to SEQ ID NO: 18621

SEQ ID NO: 55277 - DNA, 207 bp, Escherichia coli O157:H7; identical to SEQ ID NO: 18622
  CDS (1)..(207): transl_table=11

SEQ ID NO: 55278 - protein, 68 aa, Escherichia coli O157:H7; identical to SEQ ID NO: 18623

SEQ ID NO: 55279 - DNA, 216 bp, Escherichia coli O157:H7; identical to SEQ ID NO: 18624
  CDS (1)..(216): transl_table=11

SEQ ID NO: 55280 - protein, 71 aa, Escherichia coli O157:H7; identical to SEQ ID NO: 18625

SEQ ID NO: 55281 - DNA, 216 bp, Escherichia coli O157:H7; identical to SEQ ID NO: 18626
  CDS (1)..(216): transl_table=11

SEQ ID NO: 55282 - protein, 71 aa, Escherichia coli O157:H7; identical to SEQ ID NO: 18627

SEQ ID NO: 55283 - DNA, 216 bp, Escherichia coli O157:H7; identical to SEQ ID NO: 18628
  CDS (1)..(216): transl_table=11

SEQ ID NO: 55284 - protein, 71 aa, Escherichia coli O157:H7; identical to SEQ ID NO: 18629

SEQ ID NO: 55285 - DNA, 207 bp, Escherichia coli O157:H7; identical to SEQ ID NO: 18630
  CDS (1)..(207): transl_table=11

SEQ ID NO: 55286 - protein, 68 aa, Escherichia coli O157:H7; identical to SEQ ID NO: 18631

SEQ ID NO: 55287 - DNA, 207 bp, Escherichia coli O157:H7; identical to SEQ ID NO: 18632
  CDS (1)..(207): transl_table=11

SEQ ID NO: 55288 - protein, 68 aa, Escherichia coli O157:H7; identical to SEQ ID NO: 18633

SEQ ID NO: 55289 - DNA, 216 bp, Shigella flexneri 2a str. 301; identical to SEQ ID NO: 18634
  CDS (1)..(216): transl_table=11

SEQ ID NO: 55290 - protein, 71 aa, Shigella flexneri 2a str. 301; identical to SEQ ID NO: 18635

SEQ ID NO: 55291 - DNA, 216 bp, Shigella flexneri 2a str. 301; identical to SEQ ID NO: 18636
  CDS (1)..(216): transl_table=11

SEQ ID NO: 55292 - protein, 71 aa, Shigella flexneri 2a str. 301; identical to SEQ ID NO: 18637

SEQ ID NO: 55293 - DNA, 321 bp, Escherichia coli CFT073; identical to SEQ ID NO: 18638
  CDS (1)..(321): transl_table=11

SEQ ID NO: 55294 - protein, 106 aa, Escherichia coli CFT073; identical to SEQ ID NO: 18639

SEQ ID NO: 55295 - DNA, 216 bp, Escherichia coli CFT073; identical to SEQ ID NO: 18640
  CDS (1)..(216): transl_table=11

SEQ ID NO: 55296 - protein, 71 aa, Escherichia coli CFT073; identical to SEQ ID NO: 18641

SEQ ID NO: 55297 - DNA, 216 bp, Shigella flexneri 2a str. 2457T; identical to SEQ ID NO: 18642
  CDS (1)..(216): transl_table=11

SEQ ID NO: 55298 - protein, 71 aa, Shigella flexneri 2a str. 2457T; identical to SEQ ID NO: 18643

SEQ ID NO: 55299 - DNA, 180 bp, Shigella flexneri 2a str. 2457T; identical to SEQ ID NO: 18644
  CDS (1)..(180): transl_table=11

SEQ ID NO: 55300 - protein, 59 aa, Shigella flexneri 2a str. 2457T; identical to SEQ ID NO: 18645

SEQ ID NO: 55301 - DNA, 213 bp, Yersinia pseudotuberculosis IP 32953; identical to SEQ ID NO: 18646
  CDS (1)..(213): transl_table=11

SEQ ID NO: 55302 - protein, 70 aa, Yersinia pseudotuberculosis IP 32953; identical to SEQ ID NO: 18647

SEQ ID NO: 55303 - DNA, 216 bp, Shigella sonnei Ss046; identical to SEQ ID NO: 18648
  CDS (1)..(216): transl_table=11

SEQ ID NO: 55304 - protein, 71 aa, Shigella sonnei Ss046; identical to SEQ ID NO: 18649

SEQ ID NO: 55305 - DNA, 216 bp, Shigella sonnei Ss046; identical to SEQ ID NO: 18650
  CDS (1)..(216): transl_table=11

SEQ ID NO: 55306 - protein, 71 aa, Shigella sonnei Ss046; identical to SEQ ID NO: 18651

SEQ ID NO: 55307 - DNA, 207 bp, Bacteriophage H19B; identical to SEQ ID NO: 18652
  CDS (1)..(207): transl_table=11

SEQ ID NO: 55308 - protein, 68 aa, Bacteriophage H19B; identical to SEQ ID NO: 18653

SEQ ID NO: 55309 - DNA, 291 bp, Stx1; identical to SEQ ID NO: 18654
  CDS (1)..(291): transl_table=11

SEQ ID NO: 55310 - protein, 96 aa, Stx1; identical to SEQ ID NO: 18655

SEQ ID NO: 55311 - DNA, 150 bp, Escherichia coli; identical to SEQ ID NO: 18656
  CDS (1)..(150): transl_table=11

SEQ ID NO: 55312 - protein, 49 aa, Escherichia coli; identical to SEQ ID NO: 18657

SEQ ID NO: 55313 - DNA, 216 bp, Escherichia coli; identical to SEQ ID NO: 18658
  CDS (1)..(216): transl_table=11

SEQ ID NO: 55314 - protein, 71 aa, Escherichia coli; identical to SEQ ID NO: 18659

SEQ ID NO: 55315 - DNA, 216 bp, Shigella dysenteriae; identical to SEQ ID NO: 18660
  CDS (1)..(216): transl_table=11

SEQ ID NO: 55316 - protein, 71 aa, Shigella dysenteriae; identical to SEQ ID NO: 18661

SEQ ID NO: 55317 - DNA, 216 bp, Escherichia coli O6; identical to SEQ ID NO: 18662
  CDS (1)..(216): transl_table=11

SEQ ID NO: 55318 - protein, 71 aa, Escherichia coli O6; identical to SEQ ID NO: 18663

SEQ ID NO: 55319 - DNA, 216 bp, Bacteriophage P21; identical to SEQ ID NO: 18664
  CDS (1)..(216): transl_table=11

SEQ ID NO: 55320 - protein, 71 aa, Bacteriophage P21; identical to SEQ ID NO: 18665

SEQ ID NO: 55321 - DNA, 24 bp, Artificial sequence
  (1)..(24): primer
atgctgtcaaaactaccccgtaga

SEQ ID NO: 55322 - DNA, 23 bp, Artificial sequence
  (1)..(23): primer
ttactctcctctcgcagccttac

SEQ ID NO: 55323 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 55324 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 55325 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 55326 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 55327 - DNA, 1047 bp, Escherichia coli K12; identical to SEQ ID NO: 1323
  CDS (1)..(1047)

SEQ ID NO: 55328 - protein, 348 aa, Escherichia coli K12; identical to SEQ ID NO: 1324

SEQ ID NO: 55329 - DNA, 1235 bp, Salmonella typhimurium; identical to SEQ ID NO: 1325
  CDS (165)..(1235)

SEQ ID NO: 55330 - protein, 356 aa, Salmonella typhimurium; identical to SEQ ID NO: 1326

SEQ ID NO: 55331 - DNA, 1086 bp, Deinococcus radiodurans; identical to SEQ ID NO: 1327
  CDS (1)..(1086)

SEQ ID NO: 55332 - protein, 361 aa, Deinococcus radiodurans; identical to SEQ ID NO: 1328

SEQ ID NO: 55333 - DNA, 1056 bp, Neisseria meningitidis; identical to SEQ ID NO: 1329
  CDS (1)..(1056)

SEQ ID NO: 55334 - protein, 351 aa, Neisseria meningitidis; identical to SEQ ID NO: 1330

SEQ ID NO: 55335 - DNA, 1047 bp, Yersinia pestis; identical to SEQ ID NO: 1331
  CDS (1)..(1047)

SEQ ID NO: 55336 - protein, 348 aa, Yersinia pestis; identical to SEQ ID NO: 1332

SEQ ID NO: 55337 - DNA, 1071 bp, Escherichia coli; identical to SEQ ID NO: 1333
  CDS (1)..(1071)

SEQ ID NO: 55338 - protein, 356 aa, Escherichia coli; identical to SEQ ID NO: 1334

SEQ ID NO: 55339 - DNA, 1131 bp, Nostoc sp. PCC 7120; identical to SEQ ID NO: 1335
  CDS (1)..(1131)

SEQ ID NO: 55340 - protein, 376 aa, Nostoc sp. PCC 7120; identical to SEQ ID NO: 1336

SEQ ID NO: 55341 - DNA, 1053 bp, Salmonella enterica subsp. enterica serovar Typhi; identical to SEQ ID NO: 1337
  CDS (1)..(1053)

SEQ ID NO: 55342 - protein, 350 aa, Salmonella enterica subsp. enterica serovar Typhi; identical to SEQ ID NO: 1338

SEQ ID NO: 55343 - DNA, 1077 bp, Pseudomonas aeruginosa; identical to SEQ ID NO: 1339
  CDS (1)..(1077)

SEQ ID NO: 55344 - protein, 358 aa, Pseudomonas aeruginosa; identical to SEQ ID NO: 1340

SEQ ID NO: 55345 - DNA, 1047 bp, Buchnera sp; identical to SEQ ID NO: 1341
  CDS (1)..(1047)

SEQ ID NO: 55346 - protein, 348 aa, Buchnera sp; identical to SEQ ID NO: 1342

SEQ ID NO: 55347 - DNA, 1074 bp, Vibrio cholerae; identical to SEQ ID NO: 1343
  CDS (1)..(1074)

SEQ ID NO: 55348 - protein, 357 aa, Vibrio cholerae; identical to SEQ ID NO: 1344

SEQ ID NO: 55349 - DNA, 1038 bp, Lactococcus lactis subsp. lactis; identical to SEQ ID NO: 1345
  CDS (1)..(1038)

SEQ ID NO: 55350 - protein, 345 aa, Lactococcus lactis subsp. lactis; identical to SEQ ID NO: 1346

SEQ ID NO: 55351 - DNA, 1023 bp, Lactococcus lactis subsp. lactis; identical to SEQ ID NO: 1347
  CDS (1)..(1023)

SEQ ID NO: 55352 - protein, 340 aa, Lactococcus lactis subsp. lactis; identical to SEQ ID NO: 1348

SEQ ID NO: 55353 - DNA, 1032 bp, Streptococcus pneumoniae; identical to SEQ ID NO: 1349
  CDS (1)..(1032)

SEQ ID NO: 55354 - protein, 343 aa, Streptococcus pneumoniae; identical to SEQ ID NO: 1350

SEQ ID NO: 55355 - DNA, 1095 bp, Pseudomonas aeruginosa; identical to SEQ ID NO: 1351
  CDS (1)..(1095)

SEQ ID NO: 55356 - protein, 364 aa, Pseudomonas aeruginosa; identical to SEQ ID NO: 1352

SEQ ID NO: 55357 - DNA, 1110 bp, Caulobacter crescentus; identical to SEQ ID NO: 1353
  CDS (1)..(1110)

SEQ ID NO: 55358 - protein, 369 aa, Caulobacter crescentus; identical to SEQ ID NO: 1354

SEQ ID NO: 55359 - DNA, 1032 bp, Streptococcus pneumoniae; identical to SEQ ID NO: 1355
  CDS (1)..(1032)

SEQ ID NO: 55360 - protein, 343 aa, Streptococcus pneumoniae; identical to SEQ ID NO: 1356

SEQ ID NO: 55361 - DNA, 1047 bp, Buchnera aphidicola; identical to SEQ ID NO: 1357
  CDS (1)..(1047)

SEQ ID NO: 55362 - protein, 348 aa, Buchnera aphidicola; identical to SEQ ID NO: 1358

SEQ ID NO: 55363 - DNA, 1089 bp, Haemophilus influenzae; identical to SEQ ID NO: 1359
  CDS (1)..(1089)

SEQ ID NO: 55364 - protein, 362 aa, Haemophilus influenzae; identical to SEQ ID NO: 1360

SEQ ID NO: 55365 - DNA, 1502 bp, Candida albicans; identical to SEQ ID NO: 1361
  CDS (336)..(1442)

SEQ ID NO: 55366 - protein, 368 aa, Candida albicans; identical to SEQ ID NO: 1362

SEQ ID NO: 55367 - DNA, 1113 bp, Saccharomyces cerevisiae; identical to SEQ ID NO: 1363
  CDS (1)..(1113)

SEQ ID NO: 55368 - protein, 370 aa, Saccharomyces cerevisiae; identical to SEQ ID NO: 1364

SEQ ID NO: 55369 - DNA, 2048 bp, Saccharomyces cerevisiae; identical to SEQ ID NO: 1365
  CDS (619)..(1731)

SEQ ID NO: 55370 - protein, 370 aa, Saccharomyces cerevisiae; identical to SEQ ID NO: 1366

SEQ ID NO: 55371 - DNA, 1107 bp, Schizosaccharomyces pombe; identical to SEQ ID NO: 1367
  CDS (1)..(1107)

SEQ ID NO: 55372 - protein, 368 aa, Schizosaccharomyces pombe; identical to SEQ ID NO: 1368

SEQ ID NO: 55373 - DNA, 1089 bp, Amycolatopsis orientalis; identical to SEQ ID NO: 1369
  CDS (1)..(1089)

SEQ ID NO: 55374 - protein, 362 aa, Amycolatopsis orientalis; identical to SEQ ID NO: 1370

SEQ ID NO: 55375 - DNA, 1119 bp, Schizosaccharomyces pombe; identical to SEQ ID NO: 1371
  CDS (1)..(1119)

SEQ ID NO: 55376 - protein, 372 aa, Schizosaccharomyces pombe; identical to SEQ ID NO: 1372

SEQ ID NO: 55377 - DNA, 1248 bp, Corynebacterium glutamicum; identical to SEQ ID NO: 1373
  CDS (101)..(1228)

SEQ ID NO: 55378 - protein, 375 aa, Corynebacterium glutamicum; identical to SEQ ID NO: 1374

SEQ ID NO: 55379 - DNA, 1083 bp, Methylophilus methylotrophus; identical to SEQ ID NO: 1375
  CDS (1)..(1083)

SEQ ID NO: 55380 - protein, 360 aa, Methylophilus methylotrophus; identical to SEQ ID NO: 1376

SEQ ID NO: 55381 - DNA, 1107 bp, Debaryomyces hansenii; identical to SEQ ID NO: 1377
  CDS (1)..(1107)

SEQ ID NO: 55382 - protein, 368 aa, Debaryomyces hansenii; identical to SEQ ID NO: 1378

SEQ ID NO: 55383 - DNA, 1074 bp, Yarrowia lipolytica; identical to SEQ ID NO: 1379
  CDS (1)..(1074)

SEQ ID NO: 55384 - protein, 357 aa, Yarrowia lipolytica; identical to SEQ ID NO: 1380

SEQ ID NO: 55385 - DNA, 1089 bp, Yarrowia lipolytica; identical to SEQ ID NO: 1381
  CDS (1)..(1089)

SEQ ID NO: 55386 - protein, 362 aa, Yarrowia lipolytica; identical to SEQ ID NO: 1382

SEQ ID NO: 55387 - DNA, 1119 bp, Kluyveromyces lactis; identical to SEQ ID NO: 1383
  CDS (1)..(1119)

SEQ ID NO: 55388 - protein, 372 aa, Kluyveromyces lactis; identical to SEQ ID NO: 1384

SEQ ID NO: 55389 - DNA, 1095 bp, Kluyveromyces lactis; identical to SEQ ID NO: 1385
  CDS (1)..(1095)

SEQ ID NO: 55390 - protein, 364 aa, Kluyveromyces lactis; identical to SEQ ID NO: 1386

SEQ ID NO: 55391 - DNA, 1074 bp, Erwinia carotovora subsp; identical to SEQ ID NO: 1387
  CDS (1)..(1074)

SEQ ID NO: 55392 - protein, 357 aa, Erwinia carotovora subsp; identical to SEQ ID NO: 1388

SEQ ID NO: 55393 - DNA, 1047 bp, Erwinia carotovora subsp; identical to SEQ ID NO: 1389
  CDS (1)..(1047)

SEQ ID NO: 55394 - protein, 348 aa, Erwinia carotovora subsp; identical to SEQ ID NO: 1390

SEQ ID NO: 55395 - DNA, 1056 bp, Erwinia carotovora subsp; identical to SEQ ID NO: 1391
  CDS (1)..(1056)

SEQ ID NO: 55396 - protein, 351 aa, Erwinia carotovora subsp; identical to SEQ ID NO: 1392

SEQ ID NO: 55397 - DNA, 1113 bp, Acinetobacter sp; identical to SEQ ID NO: 1393
  CDS (1)..(1113)

SEQ ID NO: 55398 - protein, 370 aa, Acinetobacter sp; identical to SEQ ID NO: 1394

SEQ ID NO: 55399 - DNA, 1056 bp, Acinetobacter sp; identical to SEQ ID NO: 1395
  CDS (1)..(1056)

SEQ ID NO: 55400 - protein, 351 aa, Acinetobacter sp; identical to SEQ ID NO: 1396

SEQ ID NO: 55401 - DNA, 1119 bp, Candida glabrata; identical to SEQ ID NO: 1397
  CDS (1)..(1119)

SEQ ID NO: 55402 - protein, 372 aa, Candida glabrata; identical to SEQ ID NO: 1398

SEQ ID NO: 55403 - DNA, 1071 bp, Candida glabrata; identical to SEQ ID NO: 1399
  CDS (1)..(1071)

SEQ ID NO: 55404 - protein, 356 aa, Candida glabrata; identical to SEQ ID NO: 1400

SEQ ID NO: 55405 - DNA, 1083 bp, Photobacterium profundum; identical to SEQ ID NO: 1401
  CDS (1)..(1083)

SEQ ID NO: 55406 - protein, 360 aa, Photobacterium profundum; identical to SEQ ID NO: 1402

SEQ ID NO: 55407 - DNA, 1053 bp, Photobacterium profundum; identical to SEQ ID NO: 1403
  CDS (1)..(1053)

SEQ ID NO: 55408 - protein, 350 aa, Photobacterium profundum; identical to SEQ ID NO: 1404

SEQ ID NO: 55409 - DNA, 1113 bp, Photobacterium profundum; identical to SEQ ID NO: 1405
  CDS (1)..(1113)

SEQ ID NO: 55410 - protein, 370 aa, Photobacterium profundum; identical to SEQ ID NO: 1406

SEQ ID NO: 55411 - DNA, 1056 bp, Photobacterium profundum; identical to SEQ ID NO: 1407
  CDS (1)..(1056)

SEQ ID NO: 55412 - protein, 351 aa, Photobacterium profundum; identical to SEQ ID NO: 1408

SEQ ID NO: 55413 - DNA, 1092 bp, Parachlamydia sp; identical to SEQ ID NO: 1409
  CDS (1)..(1092)

SEQ ID NO: 55414 - protein, 363 aa, Parachlamydia sp; identical to SEQ ID NO: 1410

SEQ ID NO: 55415 - DNA, 1095 bp, Rhodopseudomonas palustris; identical to SEQ ID NO: 1411
  CDS (1)..(1095)

SEQ ID NO: 55416 - protein, 364 aa, Rhodopseudomonas palustris; identical to SEQ ID NO: 1412

SEQ ID NO: 55417 - DNA, 1100 bp, Amycolatopsis methanolica; identical to SEQ ID NO: 1413
  CDS (1)..(1086)

SEQ ID NO: 55418 - protein, 361 aa, Amycolatopsis methanolica; identical to SEQ ID NO: 1414

SEQ ID NO: 55419 - DNA, 1071 bp, Treponema denticola; identical to SEQ ID NO: 1415
  CDS (1)..(1071)

SEQ ID NO: 55420 - protein, 356 aa, Treponema denticola; identical to SEQ ID NO: 1416

SEQ ID NO: 55421 - DNA, 1068 bp, Geobacter sulfurreducens; identical to SEQ ID NO: 1417
  CDS (1)..(1068)

SEQ ID NO: 55422 - protein, 355 aa, Geobacter sulfurreducens; identical to SEQ ID NO: 1418

SEQ ID NO: 55423 - DNA, 1095 bp, Ashbya gossypii; identical to SEQ ID NO: 1419
  CDS (1)..(1095)

SEQ ID NO: 55424 - protein, 364 aa, Ashbya gossypii; identical to SEQ ID NO: 1420

SEQ ID NO: 55425 - DNA, 1122 bp, Ashbya gossypii; identical to SEQ ID NO: 1421
  CDS (1)..(1122)

SEQ ID NO: 55426 - protein, 373 aa, Ashbya gossypii; identical to SEQ ID NO: 1422

SEQ ID NO: 55427 - DNA, 1098 bp, Amycolatopsis balhimycina; identical to SEQ ID NO: 1423
  CDS (1)..(1098)

SEQ ID NO: 55428 - protein, 365 aa, Amycolatopsis balhimycina; identical to SEQ ID NO: 1424

SEQ ID NO: 55429 - DNA, 1071 bp, Vibrio vulnificus; identical to SEQ ID NO: 1425
  CDS (1)..(1071)

SEQ ID NO: 55430 - protein, 356 aa, Vibrio vulnificus; identical to SEQ ID NO: 1426

SEQ ID NO: 55431 - DNA, 1047 bp, Photorhabdus luminescens; identical to SEQ ID NO: 1427
  CDS (1)..(1047)

SEQ ID NO: 55432 - protein, 348 aa, Photorhabdus luminescens; identical to SEQ ID NO: 1428

SEQ ID NO: 55433 - DNA, 1053 bp, Photorhabdus luminescens; identical to SEQ ID NO: 1429
  CDS (1)..(1053)

SEQ ID NO: 55434 - protein, 350 aa, Photorhabdus luminescens; identical to SEQ ID NO: 1430

SEQ ID NO: 55435 - DNA, 1095 bp, Photorhabdus luminescens; identical to SEQ ID NO: 1431
  CDS (1)..(1095)

SEQ ID NO: 55436 - protein, 364 aa, Photorhabdus luminescens; identical to SEQ ID NO: 1432

SEQ ID NO: 55437 - DNA, 1119 bp, Gloeobacter violaceus; identical to SEQ ID NO: 1433
  CDS (1)..(1119)

SEQ ID NO: 55438 - protein, 372 aa, Gloeobacter violaceus; identical to SEQ ID NO: 1434

SEQ ID NO: 55439 - DNA, 1107 bp, Chromobacterium violaceum; identical to SEQ ID NO: 1435
  CDS (1)..(1107)

SEQ ID NO: 55440 - protein, 368 aa, Chromobacterium violaceum; identical to SEQ ID NO: 1436

SEQ ID NO: 55441 - DNA, 1059 bp, Chromobacterium violaceum; identical to SEQ ID NO: 1437
  CDS (1)..(1059)

SEQ ID NO: 55442 - protein, 352 aa, Chromobacterium violaceum; identical to SEQ ID NO: 1438

SEQ ID NO: 55443 - DNA, 1140 bp, Neurospora crassa; identical to SEQ ID NO: 1439
  CDS (1)..(1140)

SEQ ID NO: 55444 - protein, 379 aa, Neurospora crassa; identical to SEQ ID NO: 1440

SEQ ID NO: 55445 - DNA, 1092 bp, Neurospora crassa; identical to SEQ ID NO: 1441
  CDS (1)..(1092)

SEQ ID NO: 55446 - protein, 363 aa, Neurospora crassa; identical to SEQ ID NO: 1442

SEQ ID NO: 55447 - DNA, 1068 bp, Synechococcus sp; identical to SEQ ID NO: 1443
  CDS (1)..(1068)

SEQ ID NO: 55448 - protein, 355 aa, Synechococcus sp; identical to SEQ ID NO: 1444

SEQ ID NO: 55449 - DNA, 1053 bp, Rhodopirellula baltica; identical to SEQ ID NO: 1445
  CDS (1)..(1053)

SEQ ID NO: 55450 - protein, 350 aa, Rhodopirellula baltica; identical to SEQ ID NO: 1446

SEQ ID NO: 55451 - DNA, 1068 bp, Prochlorococcus marinus subsp; identical to SEQ ID NO: 1447
  CDS (1)..(1068)

SEQ ID NO: 55452 - protein, 355 aa, Prochlorococcus marinus subsp; identical to SEQ ID NO: 1448

SEQ ID NO: 55453 - DNA, 1083 bp, Prochlorococcus marinus; identical to SEQ ID NO: 1449
  CDS (1)..(1083)

SEQ ID NO: 55454 - protein, 360 aa, Prochlorococcus marinus; identical to SEQ ID NO: 1450

SEQ ID NO: 55455 - DNA, 1074 bp, Prochlorococcus marinus; identical to SEQ ID NO: 1451
  CDS (1)..(1074)

SEQ ID NO: 55456 - protein, 357 aa, Prochlorococcus marinus; identical to SEQ ID NO: 1452

SEQ ID NO: 55457 - DNA, 1113 bp, Haemophilus ducreyi; identical to SEQ ID NO: 1453
  CDS (1)..(1113)

SEQ ID NO: 55458 - protein, 370 aa, Haemophilus ducreyi; identical to SEQ ID NO: 1454

SEQ ID NO: 55459 - DNA, 1080 bp, Haemophilus ducreyi; identical to SEQ ID NO: 1455
  CDS (1)..(1080)

SEQ ID NO: 55460 - protein, 359 aa, Haemophilus ducreyi; identical to SEQ ID NO: 1456

SEQ ID NO: 55461 - DNA, 1086 bp, Candidatus Blochmannia floridanus; identical to SEQ ID NO: 1457
  CDS (1)..(1086)

SEQ ID NO: 55462 - protein, 361 aa, Candidatus Blochmannia floridanus; identical to SEQ ID NO: 1458

SEQ ID NO: 55463 - DNA, 1074 bp, Bordetella pertussis; identical to SEQ ID NO: 1459
  CDS (1)..(1074)

SEQ ID NO: 55464 - protein, 357 aa, Bordetella pertussis; identical to SEQ ID NO: 1460

SEQ ID NO: 55465 - DNA, 1119 bp, Bordetella bronchiseptica; identical to SEQ ID NO: 1461
  CDS (1)..(1119)

SEQ ID NO: 55466 - protein, 372 aa, Bordetella bronchiseptica; identical to SEQ ID NO: 1462

SEQ ID NO: 55467 - DNA, 1179 bp, Nitrosomonas europaea; identical to SEQ ID NO: 1463
  CDS (1)..(1179)

SEQ ID NO: 55468 - protein, 392 aa, Nitrosomonas europaea; identical to SEQ ID NO: 1464

SEQ ID NO: 55469 - DNA, 1083 bp, Coxiella burnetii; identical to SEQ ID NO: 1465
  CDS (1)..(1083)

SEQ ID NO: 55470 - protein, 360 aa, Coxiella burnetii; identical to SEQ ID NO: 1466

SEQ ID NO: 55471 - DNA, 834 bp, Vibrio anguillarum; identical to SEQ ID NO: 1467
  CDS (1)..(834)

SEQ ID NO: 55472 - protein, 277 aa, Vibrio anguillarum; identical to SEQ ID NO: 1468

SEQ ID NO: 55473 - DNA, 1143 bp, Xylella fastidiosa; identical to SEQ ID NO: 1469
  CDS (1)..(1143)

SEQ ID NO: 55474 - protein, 380 aa, Xylella fastidiosa; identical to SEQ ID NO: 1470

SEQ ID NO: 55475 - DNA, 1053 bp, Vibrio parahaemolyticus; identical to SEQ ID NO: 1471
  CDS (1)..(1053)

SEQ ID NO: 55476 - protein, 350 aa, Vibrio parahaemolyticus; identical to SEQ ID NO: 1472

SEQ ID NO: 55477 - DNA, 1053 bp, Vibrio parahaemolyticus; identical to SEQ ID NO: 1473
  CDS (1)..(1053)

SEQ ID NO: 55478 - protein, 350 aa, Vibrio parahaemolyticus; identical to SEQ ID NO: 1474

SEQ ID NO: 55479 - DNA, 1074 bp, Vibrio parahaemolyticus; identical to SEQ ID NO: 1475
  CDS (1)..(1074)

SEQ ID NO: 55480 - protein, 357 aa, Vibrio parahaemolyticus; identical to SEQ ID NO: 1476

SEQ ID NO: 55481 - DNA, 1083 bp, Pseudomonas syringae; identical to SEQ ID NO: 1477
  CDS (1)..(1083)

SEQ ID NO: 55482 - protein, 360 aa, Pseudomonas syringae; identical to SEQ ID NO: 1478

SEQ ID NO: 55483 - DNA, 1077 bp, Pseudomonas syringae; identical to SEQ ID NO: 1479
  CDS (1)..(1077)

SEQ ID NO: 55484 - protein, 358 aa, Pseudomonas syringae; identical to SEQ ID NO: 1480

SEQ ID NO: 55485 - DNA, 1062 bp, Pseudomonas putida; identical to SEQ ID NO: 1481
  CDS (1)..(1062)

SEQ ID NO: 55486 - protein, 353 aa, Pseudomonas putida; identical to SEQ ID NO: 1482

SEQ ID NO: 55487 - DNA, 1113 bp, Pseudomonas putida; identical to SEQ ID NO: 1483
  CDS (1)..(1113)

SEQ ID NO: 55488 - protein, 370 aa, Pseudomonas putida; identical to SEQ ID NO: 1484

SEQ ID NO: 55489 - DNA, 1086 bp, Bradyrhizobium japonicum; identical to SEQ ID NO: 1485
  CDS (1)..(1086)

SEQ ID NO: 55490 - protein, 361 aa, Bradyrhizobium japonicum; identical to SEQ ID NO: 1486

SEQ ID NO: 55491 - DNA, 1053 bp, Yersinia pestis; identical to SEQ ID NO: 1487
  CDS (1)..(1053)

SEQ ID NO: 55492 - protein, 350 aa, Yersinia pestis; identical to SEQ ID NO: 1488

SEQ ID NO: 55493 - DNA, 1077 bp, Yersinia pestis; identical to SEQ ID NO: 1489
  CDS (1)..(1077)

SEQ ID NO: 55494 - protein, 358 aa, Yersinia pestis; identical to SEQ ID NO: 1490

SEQ ID NO: 55495 - DNA, 1038 bp, Wigglesworthia glossinidia brevipalpis; identical to SEQ ID NO: 1491
  CDS (1)..(1038)

SEQ ID NO: 55496 - protein, 345 aa, Wigglesworthia glossinidia brevipalpis; identical to SEQ ID NO: 1492

SEQ ID NO: 55497 - DNA, 1053 bp, Vibrio vulnificus; identical to SEQ ID NO: 1493
  CDS (1)..(1053)

SEQ ID NO: 55498 - protein, 350 aa, Vibrio vulnificus; identical to SEQ ID NO: 1494

SEQ ID NO: 55499 - DNA, 1053 bp, Vibrio vulnificus; identical to SEQ ID NO: 1495
  CDS (1)..(1053)

SEQ ID NO: 55500 - protein, 350 aa, Vibrio vulnificus; identical to SEQ ID NO: 1496

SEQ ID NO: 55501 - DNA, 1071 bp, Vibrio vulnificus; identical to SEQ ID NO: 1497
  CDS (1)..(1071)

SEQ ID NO: 55502 - protein, 356 aa, Vibrio vulnificus; identical to SEQ ID NO: 1498

SEQ ID NO: 55503 - DNA, 1062 bp, Synechococcus elongatus; identical to SEQ ID NO: 1499
  CDS (1)..(1062)

SEQ ID NO: 55504 - protein, 353 aa, Synechococcus elongatus; identical to SEQ ID NO: 1500

SEQ ID NO: 55505 - DNA, 1032 bp, Streptococcus mutans; identical to SEQ ID NO: 1501
  CDS (1)..(1032)

SEQ ID NO: 55506 - protein, 343 aa, Streptococcus mutans; identical to SEQ ID NO: 1502

SEQ ID NO: 55507 - DNA, 1035 bp, Streptococcus mutans; identical to SEQ ID NO: 1503
  CDS (1)..(1035)

SEQ ID NO: 55508 - protein, 344 aa, Streptococcus mutans; identical to SEQ ID NO: 1504

SEQ ID NO: 55509 - DNA, 1008 bp, Streptococcus agalactiae; identical to SEQ ID NO: 1505
  CDS (1)..(1008)

SEQ ID NO: 55510 - protein, 335 aa, Streptococcus agalactiae; identical to SEQ ID NO: 1506

SEQ ID NO: 55511 - DNA, 1065 bp, Shewanella oneidensis; identical to SEQ ID NO: 1507
  CDS (1)..(1065)

SEQ ID NO: 55512 - protein, 354 aa, Shewanella oneidensis; identical to SEQ ID NO: 1508

SEQ ID NO: 55513 - DNA, 1092 bp, Shewanella oneidensis; identical to SEQ ID NO: 1509
  CDS (1)..(1092)

SEQ ID NO: 55514 - protein, 363 aa, Shewanella oneidensis; identical to SEQ ID NO: 1510

SEQ ID NO: 55515 - DNA, 1059 bp, Shewanella oneidensis; identical to SEQ ID NO: 1511
  CDS (1)..(1059)

SEQ ID NO: 55516 - protein, 352 aa, Shewanella oneidensis; identical to SEQ ID NO: 1512

SEQ ID NO: 55517 - DNA, 1053 bp, Escherichia coli O6; identical to SEQ ID NO: 1513
  CDS (1)..(1053)

SEQ ID NO: 55518 - protein, 350 aa, Escherichia coli O6; identical to SEQ ID NO: 1514

SEQ ID NO: 55519 - DNA, 1170 bp, Corynebacterium efficiens; identical to SEQ ID NO: 1515
  CDS (1)..(1170)

SEQ ID NO: 55520 - protein, 389 aa, Corynebacterium efficiens; identical to SEQ ID NO: 1516

SEQ ID NO: 55521 - DNA, 1134 bp, Bifidobacterium longum; identical to SEQ ID NO: 1517
  CDS (1)..(1134)

SEQ ID NO: 55522 - protein, 377 aa, Bifidobacterium longum; identical to SEQ ID NO: 1518

SEQ ID NO: 55523 - DNA, 1233 bp, Bifidobacterium longum; identical to SEQ ID NO: 1519
  CDS (1)..(1233)

SEQ ID NO: 55524 - protein, 410 aa, Bifidobacterium longum; identical to SEQ ID NO: 1520

SEQ ID NO: 55525 - DNA, 1221 bp, Phytophthora infestans; identical to SEQ ID NO: 1521
  CDS (20)..(1153)

SEQ ID NO: 55526 - protein, 377 aa, Phytophthora infestans; identical to SEQ ID NO: 1522

SEQ ID NO: 55527 - DNA, 1062 bp, Chlorobium tepidum; identical to SEQ ID NO: 1523
  CDS (1)..(1062)

SEQ ID NO: 55528 - protein, 353 aa, Chlorobium tepidum; identical to SEQ ID NO: 1524

SEQ ID NO: 55529 - DNA, 1074 bp, Xanthomonas campestris; identical to SEQ ID NO: 1525
  CDS (1)..(1074)

SEQ ID NO: 55530 - protein, 357 aa, Xanthomonas campestris; identical to SEQ ID NO: 1526

SEQ ID NO: 55531 - DNA, 1074 bp, Xanthomonas axonopodis; identical to SEQ ID NO: 1527
  CDS (1)..(1074)

SEQ ID NO: 55532 - protein, 357 aa, Xanthomonas axonopodis; identical to SEQ ID NO: 1528

SEQ ID NO: 55533 - DNA, 1080 bp, Ralstonia solanacearum; identical to SEQ ID NO: 1529
  CDS (1)..(1080)

SEQ ID NO: 55534 - protein, 359 aa, Ralstonia solanacearum; identical to SEQ ID NO: 1530

SEQ ID NO: 55535 - DNA, 1179 bp, Ralstonia solanacearum; identical to SEQ ID NO: 1531
  CDS (1)..(1179)

SEQ ID NO: 55536 - protein, 392 aa, Ralstonia solanacearum; identical to SEQ ID NO: 1532

SEQ ID NO: 55537 - DNA, 1065 bp, Synechococcus sp; identical to SEQ ID NO: 1533
  CDS (1)..(1065)

SEQ ID NO: 55538 - protein, 354 aa, Synechococcus sp; identical to SEQ ID NO: 1534

SEQ ID NO: 55539 - DNA, 1035 bp, Escherichia coli; identical to SEQ ID NO: 1535
  CDS (1)..(1035)

SEQ ID NO: 55540 - protein, 344 aa, Escherichia coli; identical to SEQ ID NO: 1536

SEQ ID NO: 55541 - DNA, 1200 bp, Stigmatella aurantiaca; identical to SEQ ID NO: 1537
  CDS (62)..(1147)

SEQ ID NO: 55542 - protein, 361 aa, Stigmatella aurantiaca; identical to SEQ ID NO: 1538

SEQ ID NO: 55543 - DNA, 1092 bp, Rhizobium loti; identical to SEQ ID NO: 1539
  CDS (1)..(1092)

SEQ ID NO: 55544 - protein, 363 aa, Rhizobium loti; identical to SEQ ID NO: 1540

SEQ ID NO: 55545 - DNA, 1083 bp, Amycolatopsis mediterranei; identical to SEQ ID NO: 1541
  CDS (1)..(1083)

SEQ ID NO: 55546 - protein, 360 aa, Amycolatopsis mediterranei; identical to SEQ ID NO: 1542

SEQ ID NO: 55547 - DNA, 1053 bp, Pasteurella multocida; identical to SEQ ID NO: 1543
  CDS (1)..(1053)

SEQ ID NO: 55548 - protein, 350 aa, Pasteurella multocida; identical to SEQ ID NO: 1544

SEQ ID NO: 55549 - DNA, 1086 bp, Pasteurella multocida; identical to SEQ ID NO: 1545
  CDS (1)..(1086)

SEQ ID NO: 55550 - protein, 361 aa, Pasteurella multocida; identical to SEQ ID NO: 1546

SEQ ID NO: 55551 - DNA, 1125 bp, Emericella nidulans; identical to SEQ ID NO: 1547
  CDS (1)..(1125)

SEQ ID NO: 55552 - protein, 374 aa, Emericella nidulans; identical to SEQ ID NO: 1548

SEQ ID NO: 55553 - DNA, 1089 bp, Emericella nidulans; identical to SEQ ID NO: 1549
  CDS (1)..(1089)

SEQ ID NO: 55554 - protein, 362 aa, Emericella nidulans; identical to SEQ ID NO: 1550

SEQ ID NO: 55555 - DNA, 1239 bp, Vibrio cholerae; identical to SEQ ID NO: 1551
  CDS (114)..(1175)

SEQ ID NO: 55556 - protein, 353 aa, Vibrio cholerae; identical to SEQ ID NO: 1552

SEQ ID NO: 55557 - DNA, 2184 bp, Candida albicans; identical to SEQ ID NO: 1553
  CDS (461)..(1573)

SEQ ID NO: 55558 - protein, 370 aa, Candida albicans; identical to SEQ ID NO: 1554

SEQ ID NO: 55559 - DNA, 1047 bp, Buchnera aphidicola; identical to SEQ ID NO: 1555
  CDS (1)..(1047)

SEQ ID NO: 55560 - protein, 348 aa, Buchnera aphidicola; identical to SEQ ID NO: 1556

SEQ ID NO: 55561 - DNA, 1047 bp, Buchnera aphidicola; identical to SEQ ID NO: 1557
  CDS (1)..(1047)

SEQ ID NO: 55562 - protein, 348 aa, Buchnera aphidicola; identical to SEQ ID NO: 1558

SEQ ID NO: 55563 - DNA, 1047 bp, Erwinia herbicola; identical to SEQ ID NO: 1559
  CDS (1)..(1047)

SEQ ID NO: 55564 - protein, 348 aa, Erwinia herbicola; identical to SEQ ID NO: 1560

SEQ ID NO: 55565 - DNA, 1047 bp, Salmonella typhimurium; identical to SEQ ID NO: 1561
  CDS (1)..(1047)

SEQ ID NO: 55566 - protein, 348 aa, Salmonella typhimurium; identical to SEQ ID NO: 1562

SEQ ID NO: 55567 - DNA, 23 bp, Artificial sequence
  (1)..(23): primer
atgaacagaactgacgaactccg

SEQ ID NO: 55568 - DNA, 24 bp, Artificial sequence
  (1)..(24): primer
ttagaagcgggtatctaccgcaga

SEQ ID NO: 55569 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 55570 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 55571 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 55572 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 55573 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 55574 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 55575 - DNA, 705 bp, Escherichia coli; identical to SEQ ID NO: 20641
  CDS (1)..(705)

SEQ ID NO: 55576 - protein, 234 aa, Escherichia coli; identical to SEQ ID NO: 20642

SEQ ID NO: 55577 - DNA, 26 bp, Artificial sequence
  (1)..(26): primer
atgtttttagcatcattgttgagacg

SEQ ID NO: 55578 - DNA, 28 bp, Artificial sequence
  (1)..(28): primer
ttaaatttttgctattagattttctgca

SEQ ID NO: 55579 - DNA, 1323 bp, Escherichia coli K12; identical to SEQ ID NO: 20861
  CDS (1)..(1323): transl_table=11

SEQ ID NO: 55580 - protein, 440 aa, Escherichia coli K12; identical to SEQ ID NO: 20862

SEQ ID NO: 55581 - DNA, 1461 bp, Archaeoglobus fulgidus DSM 4304; identical to SEQ ID NO: 20863
  CDS (1)..(1461): transl_table=11

SEQ ID NO: 55582 - protein, 486 aa, Archaeoglobus fulgidus DSM 4304; identical to SEQ ID NO: 20864

SEQ ID NO: 55583 - DNA, 1455 bp, Aeropyrum pernix K1; identical to SEQ ID NO: 20865
  CDS (1)..(1455): transl_table=11

SEQ ID NO: 55584 - protein, 484 aa, Aeropyrum pernix K1; identical to SEQ ID NO: 20866

SEQ ID NO: 55585 - DNA, 1365 bp, Helicobacter pylori J99; identical to SEQ ID NO: 20867
  CDS (1)..(1365): transl_table=11

SEQ ID NO: 55586 - protein, 454 aa, Helicobacter pylori J99; identical to SEQ ID NO: 20868

SEQ ID NO: 55587 - DNA, 1326 bp, Bacillus halodurans C-125; identical to SEQ ID NO: 20869
  CDS (1)..(1326): transl_table=11

SEQ ID NO: 55588 - protein, 441 aa, Bacillus halodurans C-125; identical to SEQ ID NO: 20870

SEQ ID NO: 55589 - DNA, 1425 bp, Pseudomonas aeruginosa PAO1; identical to SEQ ID NO: 20871
  CDS (1)..(1425): transl_table=11

SEQ ID NO: 55590 - protein, 474 aa, Pseudomonas aeruginosa PAO1; identical to SEQ ID NO: 20872

SEQ ID NO: 55591 - DNA, 1377 bp, Fusobacterium nucleatum subsp. nucleatum ATCC 25586; identical to SEQ ID NO: 20873
  CDS (1)..(1377): transl_table=11

SEQ ID NO: 55592 - protein, 458 aa, Fusobacterium nucleatum subsp. nucleatum ATCC 25586; identical to SEQ ID NO: 20874

SEQ ID NO: 55593 - DNA, 1407 bp, Streptococcus pyogenes MGAS8232; identical to SEQ ID NO: 20875
  CDS (1)..(1407): transl_table=11

SEQ ID NO: 55594 - protein, 468 aa, Streptococcus pyogenes MGAS8232; identical to SEQ ID NO: 20876

SEQ ID NO: 55595 - DNA, 1326 bp, Oceanobacillus iheyensis HTE831; identical to SEQ ID NO: 20877
  CDS (1)..(1326): transl_table=11

SEQ ID NO: 55596 - protein, 441 aa, Oceanobacillus iheyensis HTE831; identical to SEQ ID NO: 20878

SEQ ID NO: 55597 - DNA, 1332 bp, Shewanella oneidensis MR-1; identical to SEQ ID NO: 20879
  CDS (1)..(1332): transl_table=11

SEQ ID NO: 55598 - protein, 443 aa, Shewanella oneidensis MR-1; identical to SEQ ID NO: 20880

SEQ ID NO: 55599 - DNA, 1419 bp, Pseudomonas putida KT2440; identical to SEQ ID NO: 20881
  CDS (1)..(1419): transl_table=11

SEQ ID NO: 55600 - protein, 472 aa, Pseudomonas putida KT2440; identical to SEQ ID NO: 20882

SEQ ID NO: 55601 - DNA, 1419 bp, Pseudomonas syringae pv. tomato str. DC3000; identical to SEQ ID NO: 20883
  CDS (1)..(1419): transl_table=11

SEQ ID NO: 55602 - protein, 472 aa, Pseudomonas syringae pv. tomato str. DC3000; identical to SEQ ID NO: 20884

SEQ ID NO: 55603 - DNA, 1407 bp, Streptococcus pyogenes SSI-1; identical to SEQ ID NO: 20885
  CDS (1)..(1407): transl_table=11

SEQ ID NO: 55604 - protein, 468 aa, Streptococcus pyogenes SSI-1; identical to SEQ ID NO: 20886

SEQ ID NO: 55605 - DNA, 1350 bp, Bordetella pertussis Tohama I; identical to SEQ ID NO: 20887
  CDS (1)..(1350): transl_table=11

SEQ ID NO: 55606 - protein, 449 aa, Bordetella pertussis Tohama I; identical to SEQ ID NO: 20888

SEQ ID NO: 55607 - DNA, 1464 bp, Bordetella pertussis Tohama I; identical to SEQ ID NO: 20889
  CDS (1)..(1464): transl_table=11

SEQ ID NO: 55608 - protein, 487 aa, Bordetella pertussis Tohama I; identical to SEQ ID NO: 20890

SEQ ID NO: 55609 - DNA, 1434 bp, Bordetella parapertussis 12822; identical to SEQ ID NO: 20891
  CDS (1)..(1434): transl_table=11

SEQ ID NO: 55610 - protein, 477 aa, Bordetella parapertussis 12822; identical to SEQ ID NO: 20892

SEQ ID NO: 55611 - DNA, 1464 bp, Bordetella parapertussis 12822; identical to SEQ ID NO: 20893
  CDS (1)..(1464): transl_table=11

SEQ ID NO: 55612 - protein, 487 aa, Bordetella parapertussis 12822; identical to SEQ ID NO: 20894

SEQ ID NO: 55613 - DNA, 1446 bp, Bordetella parapertussis 12822; identical to SEQ ID NO: 20895
  CDS (1)..(1446): transl_table=11

SEQ ID NO: 55614 - protein, 481 aa, Bordetella parapertussis 12822; identical to SEQ ID NO: 20896

SEQ ID NO: 55615 - DNA, 1464 bp, Bordetella bronchiseptica RB50; identical to SEQ ID NO: 20897
  CDS (1)..(1464): transl_table=11

SEQ ID NO: 55616 - protein, 487 aa, Bordetella bronchiseptica RB50; identical to SEQ ID NO: 20898

SEQ ID NO: 55617 - DNA, 1314 bp, Bordetella bronchiseptica RB50; identical to SEQ ID NO: 20899
  CDS (1)..(1314): transl_table=11

SEQ ID NO: 55618 - protein, 437 aa, Bordetella bronchiseptica RB50; identical to SEQ ID NO: 20900

SEQ ID NO: 55619 - DNA, 1365 bp, Bdellovibrio bacteriovorus HD100; identical to SEQ ID NO: 20901
  CDS (1)..(1365): transl_table=11

SEQ ID NO: 55620 - protein, 454 aa, Bdellovibrio bacteriovorus HD100; identical to SEQ ID NO: 20902

SEQ ID NO: 55621 - DNA, 1347 bp, Bacillus cereus ATCC 10987; identical to SEQ ID NO: 20903
  CDS (1)..(1347): transl_table=11

SEQ ID NO: 55622 - protein, 448 aa, Bacillus cereus ATCC 10987; identical to SEQ ID NO: 20904

SEQ ID NO: 55623 - DNA, 1347 bp, Bacillus anthracis str. Sterne; identical to SEQ ID NO: 20905
  CDS (1)..(1347): transl_table=11

SEQ ID NO: 55624 - protein, 448 aa, Bacillus anthracis str. Sterne; identical to SEQ ID NO: 20906

SEQ ID NO: 55625 - DNA, 1347 bp, Bacillus thuringiensis serovar konkukian str. 97-27; identical to SEQ ID NO: 20907
  CDS (1)..(1347): transl_table=11

SEQ ID NO: 55626 - protein, 448 aa, Bacillus thuringiensis serovar konkukian str. 97-27; identical to SEQ ID NO: 20908

SEQ ID NO: 55627 - DNA, 1410 bp, Acinetobacter sp. ADP1; identical to SEQ ID NO: 20909
  CDS (1)..(1410): transl_table=11

SEQ ID NO: 55628 - protein, 469 aa, Acinetobacter sp. ADP1; identical to SEQ ID NO: 20910

SEQ ID NO: 55629 - DNA, 1347 bp, Bacillus cereus E33L; identical to SEQ ID NO: 20911
  CDS (1)..(1347): transl_table=11

SEQ ID NO: 55630 - protein, 448 aa, Bacillus cereus E33L; identical to SEQ ID NO: 20912

SEQ ID NO: 55631 - DNA, 1404 bp, Haloarcula marismortui ATCC 43049; identical to SEQ ID NO: 20913
  CDS (1)..(1404): transl_table=11

SEQ ID NO: 55632 - protein, 467 aa, Haloarcula marismortui ATCC 43049; identical to SEQ ID NO: 20914

SEQ ID NO: 55633 - DNA, 1320 bp, Bacillus clausii KSM-K16; identical to SEQ ID NO: 20915
  CDS (1)..(1320): transl_table=11

SEQ ID NO: 55634 - protein, 439 aa, Bacillus clausii KSM-K16; identical to SEQ ID NO: 20916

SEQ ID NO: 55635 - DNA, 1419 bp, Pseudomonas syringae pv. syringae B728a; identical to SEQ ID NO: 20917
  CDS (1)..(1419): transl_table=11

SEQ ID NO: 55636 - protein, 472 aa, Pseudomonas syringae pv. syringae B728a; identical to SEQ ID NO: 20918

SEQ ID NO: 55637 - DNA, 1344 bp, Haemophilus influenzae 86-028NP; identical to SEQ ID NO: 20919
  CDS (1)..(1344): transl_table=11

SEQ ID NO: 55638 - protein, 447 aa, Haemophilus influenzae 86-028NP; identical to SEQ ID NO: 20920

SEQ ID NO: 55639 - DNA, 1419 bp, Pseudomonas fluorescens Pf-5; identical to SEQ ID NO: 20921
  CDS (1)..(1419): transl_table=11

SEQ ID NO: 55640 - protein, 472 aa, Pseudomonas fluorescens Pf-5; identical to SEQ ID NO: 20922

SEQ ID NO: 55641 - DNA, 1425 bp, Pseudomonas syringae pv. phaseolicola 1448A; identical to SEQ ID NO: 20923
  CDS (1)..(1425): transl_table=11

SEQ ID NO: 55642 - protein, 474 aa, Pseudomonas syringae pv. phaseolicola 1448A; identical to SEQ ID NO: 20924

SEQ ID NO: 55643 - DNA, 1407 bp, Streptococcus pyogenes MGAS5005; identical to SEQ ID NO: 20925
  CDS (1)..(1407): transl_table=11

SEQ ID NO: 55644 - protein, 468 aa, Streptococcus pyogenes MGAS5005; identical to SEQ ID NO: 20926

SEQ ID NO: 55645 - DNA, 1449 bp, Ralstonia eutropha JMP134; identical to SEQ ID NO: 20927
  CDS (1)..(1449): transl_table=11

SEQ ID NO: 55646 - protein, 482 aa, Ralstonia eutropha JMP134; identical to SEQ ID NO: 20928

SEQ ID NO: 55647 - DNA, 1344 bp, Haemophilus somnus 2336; identical to SEQ ID NO: 20929
  CDS (1)..(1344)

SEQ ID NO: 55648 - protein, 447 aa, Haemophilus somnus 2336; identical to SEQ ID NO: 20930

SEQ ID NO: 55649 - DNA, 1326 bp, Fusobacterium nucleatum subsp. vincentii ATCC 49256; identical to SEQ ID NO: 20931
  CDS (1)..(1326): transl_table=11

SEQ ID NO: 55650 - protein, 441 aa, Fusobacterium nucleatum subsp. vincentii ATCC 49256; identical to SEQ ID NO: 20932

SEQ ID NO: 55651 - DNA, 1344 bp, Haemophilus influenzae R2866; identical to SEQ ID NO: 20933
  CDS (1)..(1344)

SEQ ID NO: 55652 - protein, 447 aa, Haemophilus influenzae R2866; identical to SEQ ID NO: 20934

SEQ ID NO: 55653 - DNA, 1452 bp, Burkholderia cepacia R18194; identical to SEQ ID NO: 20935
  CDS (1)..(1452)

SEQ ID NO: 55654 - protein, 483 aa, Burkholderia cepacia R18194; identical to SEQ ID NO: 20936

SEQ ID NO: 55655 - DNA, 1290 bp, Burkholderia cepacia R18194; identical to SEQ ID NO: 20937
  CDS (1)..(1290)

SEQ ID NO: 55656 - protein, 429 aa, Burkholderia cepacia R18194; identical to SEQ ID NO: 20938

SEQ ID NO: 55657 - DNA, 1347 bp, Bacillus cereus G9241; identical to SEQ ID NO: 20939
  CDS (1)..(1347): transl_table=11

SEQ ID NO: 55658 - protein, 448 aa, Bacillus cereus G9241; identical to SEQ ID NO: 20940

SEQ ID NO: 55659 - DNA, 1332 bp, Pseudomonas fluorescens PfO-1; identical to SEQ ID NO: 20941
  CDS (1)..(1332)

SEQ ID NO: 55660 - protein, 443 aa, Pseudomonas fluorescens PfO-1; identical to SEQ ID NO: 20942

SEQ ID NO: 55661 - DNA, 1434 bp, Rhodospirillum rubrum; identical to SEQ ID NO: 20943
  CDS (1)..(1434)

SEQ ID NO: 55662 - protein, 477 aa, Rhodospirillum rubrum; identical to SEQ ID NO: 20944

SEQ ID NO: 55663 - DNA, 1035 bp, Haemophilus influenzae 86-028NP; identical to SEQ ID NO: 20945
  CDS (1)..(1035)

SEQ ID NO: 55664 - protein, 344 aa, Haemophilus influenzae 86-028NP; identical to SEQ ID NO: 20946

SEQ ID NO: 55665 - DNA, 1431 bp, Ralstonia eutropha JMP134; identical to SEQ ID NO: 20947
  CDS (1)..(1431)

SEQ ID NO: 55666 - protein, 476 aa, Ralstonia eutropha JMP134; identical to SEQ ID NO: 20948

SEQ ID NO: 55667 - DNA, 1380 bp, Brevibacterium linens BL2; identical to SEQ ID NO: 20949
  CDS (1)..(1380)

SEQ ID NO: 55668 - protein, 459 aa, Brevibacterium linens BL2; identical to SEQ ID NO: 20950

SEQ ID NO: 55669 - DNA, 1242 bp, Bacillus anthracis str. A2012; identical to SEQ ID NO: 20951
  CDS (1)..(1242): n means a or g or c or t/u, s means g or c

SEQ ID NO: 55670 - protein, 413 aa, Bacillus anthracis str. A2012; identical to SEQ ID NO: 20952
  Xaa in positions 43 and 129 is unknown

SEQ ID NO: 55671 - DNA, 1440 bp, Azotobacter vinelandii AvOP; identical to SEQ ID NO: 20953
  CDS (1)..(1440): transl_table=11

SEQ ID NO: 55672 - protein, 479 aa, Azotobacter vinelandii AvOP; identical to SEQ ID NO: 20954

SEQ ID NO: 55673 - DNA, 1311 bp, Chromohalobacter salexigens DSM 3043; identical to SEQ ID NO: 20955
  CDS (1)..(1311): transl_table=11

SEQ ID NO: 55674 - protein, 436 aa, Chromohalobacter salexigens DSM 3043; identical to SEQ ID NO: 20956

SEQ ID NO: 55675 - DNA, 1356 bp, Shewanella baltica OS155; identical to SEQ ID NO: 20957
  CDS (1)..(1356): transl_table=11

SEQ ID NO: 55676 - protein, 451 aa, Shewanella baltica OS155; identical to SEQ ID NO: 20958

SEQ ID NO: 55677 - DNA, 1338 bp, Ralstonia metallidurans CH34; identical to SEQ ID NO: 20959
  CDS (1)..(1338): transl_table=11

SEQ ID NO: 55678 - protein, 445 aa, Ralstonia metallidurans CH34; identical to SEQ ID NO: 20960

SEQ ID NO: 55679 - DNA, 1395 bp, Rubrobacter xylanophilus DSM 9941; identical to SEQ ID NO: 20961
  CDS (1)..(1395): transl_table=11

SEQ ID NO: 55680 - protein, 464 aa, Rubrobacter xylanophilus DSM 9941; identical to SEQ ID NO: 20962

SEQ ID NO: 55681 - DNA, 1320 bp, Psychrobacter cryohalolentis K5; identical to SEQ ID NO: 20963
  CDS (1)..(1320): transl_table=11

SEQ ID NO: 55682 - protein, 439 aa, Psychrobacter cryohalolentis K5; identical to SEQ ID NO: 20964

SEQ ID NO: 55683 - DNA, 1353 bp, Burkholderia ambifaria AMMD; identical to SEQ ID NO: 20965
  CDS (1)..(1353): transl_table=11

SEQ ID NO: 55684 - protein, 450 aa, Burkholderia ambifaria AMMD; identical to SEQ ID NO: 20966

SEQ ID NO: 55685 - DNA, 1344 bp, Bacillus cereus; identical to SEQ ID NO: 20967
  CDS (1)..(1344): transl_table=11

SEQ ID NO: 55686 - protein, 447 aa, Bacillus cereus; identical to SEQ ID NO: 20968

SEQ ID NO: 55687 - DNA, 1341 bp, Alcaligenes eutrophus; identical to SEQ ID NO: 20969
  CDS (1)..(1341): transl_table=11

SEQ ID NO: 55688 - protein, 446 aa, Alcaligenes eutrophus; identical to SEQ ID NO: 20970

SEQ ID NO: 55689 - DNA, 1239 bp, Aeropyrum pernix; identical to SEQ ID NO: 20971
  CDS (1)..(1239): transl_table=11

SEQ ID NO: 55690 - protein, 412 aa, Aeropyrum pernix; identical to SEQ ID NO: 20972

SEQ ID NO: 55691 - DNA, 1344 bp, Haemophilus influenzae; identical to SEQ ID NO: 20973
  CDS (1)..(1344): transl_table=11

SEQ ID NO: 55692 - protein, 447 aa, Haemophilus influenzae; identical to SEQ ID NO: 20974

SEQ ID NO: 55693 - DNA, 24 bp, Artificial sequence
  (1)..(24): primer
atgattggtcgcatatcgcgtttt

SEQ ID NO: 55694 - DNA, 26 bp, Artificial sequence
  (1)..(26): primer
ttagaacagcgttaaaccaatgacga

SEQ ID NO: 55695 - protein, 465 aa, Artificial sequence; identical to SEQ ID NO: 20977
  Variant (3)..(3): xaa in position 3 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (17)..(34): xaa in position 17 to 34 is any amino acid
  Variant (35)..(44): xaa in position 35 to 44 is any or no amino acid
  Variant (47)..(47): xaa in position 47 is any amino acid
  Variant (51)..(51): xaa in position 51 is any amino acid
  Variant (54)..(54): xaa in position 54 is any amino acid
  Variant (56)..(56): xaa in position 56 is any amino acid
  Variant (60)..(60): xaa in position 60 is any amino acid
  Variant (65)..(65): xaa in position 65 is any amino acid
  Variant (67)..(68): xaa in position 67 to 68 is any amino acid
  Variant (71)..(71): xaa in position 71 is any amino acid
  Variant (74)..(76): xaa in position 74 to 76 is any amino acid
  Variant (78)..(78): xaa in position 78 is any amino acid
  Variant (80)..(81): xaa in position 80 to 81 is any amino acid
  Variant (84)..(91): xaa in position 84 to 91 is any amino acid
  Variant (94)..(95): xaa in position 94 to 95 is any amino acid
  Variant (97)..(98): xaa in position 97 to 98 is any amino acid
  Variant (100)..(101): xaa in position 100 to 101 is any amino acid
  Variant (103)..(105): xaa in position 103 to 105 is any amino acid
  Variant (110)..(111): xaa in position 110 to 111 is any amino acid
  Variant (114)..(115): xaa in position 114 to 115 is any amino acid
  Variant (118)..(119): xaa in position 118 to 119 is any amino acid
  Variant (121)..(121): xaa in position 121 is any amino acid
  Variant (125)..(127): xaa in position 125 to 127 is any amino acid
  Variant (128)..(132): xaa in position 128 to 132 is any or no amino acid
  Variant (134)..(134): xaa in position 134 is any amino acid
  Variant (136)..(139): xaa in position 136 to 139 is any amino acid
  Variant (144)..(144): xaa in position 144 is any amino acid
  Variant (146)..(148): xaa in position 146 to 148 is any amino acid
  Variant (149)..(149): xaa in position 149 is any or no amino acid
  Variant (151)..(152): xaa in position 151 to 152 is any amino acid
  Variant (156)..(156): xaa in position 156 is any amino acid
  Variant (158)..(162): xaa in position 158 to 162 is any amino acid
  Variant (164)..(175): xaa in position 164 to 175 is any amino acid
  Variant (176)..(183): xaa in position 176 to 183 is any or no amino acid
  Variant (186)..(188): xaa in position 186 to 188 is any amino acid
  Variant (192)..(195): xaa in position 192 to 195 is any amino acid
  Variant (197)..(203): xaa in position 197 to 203 is any amino acid
  Variant (205)..(208): xaa in position 205 to 208 is any amino acid
  Variant (210)..(214): xaa in position 210 to 214 is any amino acid
  Variant (216)..(241): xaa in position 216 to 241 is any amino acid
  Variant (242)..(256): xaa in position 242 to 256 is any or no amino acid
  Variant (259)..(259): xaa in position 259 is any amino acid
  Variant (262)..(262): xaa in position 262 is any amino acid
  Variant (264)..(265): xaa in position 264 to 265 is any amino acid
  Variant (267)..(269): xaa in position 267 to 269 is any amino acid
  Variant (271)..(273): xaa in position 271 to 273 is any amino acid
  Variant (275)..(276): xaa in position 275 to 276 is any amino acid
  Variant (279)..(281): xaa in position 279 to 281 is any amino acid
  Variant (283)..(289): xaa in position 283 to 289 is any amino acid
  Variant (290)..(293): xaa in position 290 to 293 is any or no amino acid
  Variant (295)..(297): xaa in position 295 to 297 is any amino acid
  Variant (299)..(299): xaa in position 299 is any amino acid
  Variant (303)..(304): xaa in position 303 to 304 is any amino acid
  Variant (310)..(311): xaa in position 310 to 311 is any amino acid
  Variant (312)..(313): xaa in position 312 to 313 is any or no amino acid
  Variant (315)..(316): xaa in position 315 to 316 is any amino acid
  Variant (319)..(319): xaa in position 319 is any amino acid
  Variant (321)..(323): xaa in position 321 to 323 is any amino acid
  Variant (325)..(329): xaa in position 325 to 329 is any amino acid
  Variant (337)..(337): xaa in position 337 is any amino acid
  Variant (342)..(343): xaa in position 342 to 343 is any amino acid
  Variant (346)..(349): xaa in position 346 to 349 is any amino acid
  Variant (350)..(356): xaa in position 350 to 356 is any or no amino acid
  Variant (358)..(360): xaa in position 358 to 360 is any amino acid
  Variant (363)..(364): xaa in position 363 to 364 is any amino acid
  Variant (367)..(367): xaa in position 367 is any amino acid
  Variant (370)..(372): xaa in position 370 to 372 is any amino acid
  Variant (373)..(373): xaa in position 373 is any or no amino acid
  Variant (375)..(380): xaa in position 375 to 380 is any amino acid
  Variant (382)..(382): xaa in position 382 is any amino acid
  Variant (387)..(389): xaa in position 387 to 389 is any amino acid
  Variant (396)..(396): xaa in position 396 is any amino acid
  Variant (398)..(398): xaa in position 398 is any amino acid
  Variant (400)..(400): xaa in position 400 is any amino acid
  Variant (403)..(403): xaa in position 403 is any amino acid
  Variant (406)..(406): xaa in position 406 is any amino acid
  Variant (409)..(410): xaa in position 409 to 410 is any amino acid
  Variant (412)..(415): xaa in position 412 to 415 is any amino acid
  Variant (417)..(424): xaa in position 417 to 424 is any amino acid
  Variant (427)..(429): xaa in position 427 to 429 is any amino acid
  Variant (437)..(437): xaa in position 437 is any amino acid
  Variant (440)..(440): xaa in position 440 is any amino acid
  Variant (444)..(445): xaa in position 444 to 445 is any amino acid
  Variant (447)..(448): xaa in position 447 to 448 is any amino acid
  Variant (455)..(458): xaa in position 455 to 458 is any amino acid
  Variant (461)..(464): xaa in position 461 to 464 is any amino acid

SEQ ID NO: 55696 - protein, 36 aa, Artificial sequence; identical to SEQ ID NO: 20978
  Variant (2)..(2): xaa in position 2 is any amino acid
  Variant (3)..(3): xaa in position 3 is any or no amino acid
  Variant (5)..(5): xaa in position 5 is any amino acid
  Variant (7)..(7): xaa in position 7 is Ile or Leu
  Variant (8)..(8): xaa in position 8 is any amino acid
  Variant (10)..(10): xaa in position 10 is Ala, Gly, Ser or Thr
  Variant (14)..(14): xaa in position 14 is any amino acid
  Variant (15)..(15): xaa in position 15 is Phe, Ile, Leu, Met or Val
  Variant (16)..(16): xaa in position 16 is Ile, Leu or Val
  Variant (17)..(17): xaa in position 17 is Ala, Ile, Leu or Val
  Variant (18)..(18): xaa in position 18 is Ala, Ile or Val
  Variant (19)..(19): xaa in position 19 is any amino acid
  Variant (21)..(22): xaa in position 21 to 22 is any amino acid
  Variant (23)..(23): xaa in position 23 is Ile, Leu or Val
  Variant (25)..(32): xaa in position 25 to 32 is any amino acid
  Variant (33)..(35): xaa in position 33 to 35 is any or no amino acid

SEQ ID NO: 55697 - protein, 29 aa, Artificial sequence
  Variant (2)..(2): xaa in position 2 is any amino acid
  Variant (3)..(3): xaa in position 3 is Ala, Leu or Val
  Variant (4)..(4): xaa in position 4 is Ala, Ile, Leu or Val
  Variant (5)..(5): xaa in position 5 is any amino acid
  Variant (6)..(6): xaa in position 6 is Ala or Val
  Variant (7)..(7): xaa in position 7 is Ala, Cys or Ser
  Variant (8)..(8): xaa in position 8 is Ala, Gly or Ser
  Variant (10)..(10): xaa in position 10 is any amino acid
  Variant (12)..(15): xaa in position 12 to 15 is any amino acid
  Variant (16)..(18): xaa in position 16 to 18 is any or no amino acid
  Variant (20)..(20): xaa in position 20 is Phe, Leu or Met
  Variant (21)..(21): xaa in position 21 is Ala, Gly, Ser or Thr
  Variant (22)..(22): xaa in position 22 is Ala, Gly or Ser
  Variant (24)..(24): xaa in position 24 is any amino acid
  Variant (25)..(25): xaa in position 25 is Ala, Pro or Ser
  Variant (26)..(28): xaa in position 26 to 28 is any amino acid
  Variant (29)..(29): xaa in position 29 is Ala, Asn, Ser or Thr
YXXXXXXXYXGXXXXXXXGXXXSXXXXXX

SEQ ID NO: 55698 - protein, 48 aa, Artificial sequence; identical to SEQ ID NO: 20980
  Variant (2)..(2): xaa in position 2 is Phe or Leu
  Variant (3)..(3): xaa in position 3 is any amino acid
  Variant (4)..(4): xaa in position 4 is Phe, Ile or Leu
  Variant (5)..(7): xaa in position 5 to 7 is any amino acid
  Variant (8)..(8): xaa in position 8 is Ala, Gly or Ile
  Variant (9)..(10): xaa in position 9 to 10 is any amino acid
  Variant (12)..(14): xaa in position 12 to 14 is any amino acid
  Variant (15)..(21): xaa in position 15 to 21 is any or no amino acid
  Variant (23)..(28): xaa in position 23 to 28 is any amino acid
  Variant (29)..(29): xaa in position 29 is Phe, Ile, Leu or Val
  Variant (30)..(31): xaa in position 30 to 31 is any amino acid
  Variant (32)..(32): xaa in position 32 is Ala, Gly or Ser
  Variant (33)..(34): xaa in position 33 to 34 is any amino acid
  Variant (35)..(35): xaa in position 35 is Ala, Gly, Ser or Thr
  Variant (36)..(37): xaa in position 36 to 37 is any amino acid
  Variant (39)..(39): xaa in position 39 is Ile, Leu or Val
  Variant (40)..(40): xaa in position 40 is Ile, Leu, Met or Val
  Variant (41)..(41): xaa in position 41 is Ile, Leu or Val
  Variant (43)..(43): xaa in position 43 is Phe or Tyr
  Variant (45)..(45): xaa in position 45 is Phe or Leu
  Variant (47)..(47): xaa in position 47 is Ala or Gly
  Variant (48)..(48): xaa in position 48 is Gly or Ser

SEQ ID NO: 55699 - protein, 52 aa, Artificial sequence; identical to SEQ ID NO: 20981
  Variant (5)..(5): xaa in position 5 is Gly or Ser
  Variant (6)..(6): xaa in position 6 is any amino acid
  Variant (7)..(7): xaa in position 7 is Phe or Trp
  Variant (8)..(8): xaa in position 8 is Ala, Ile or Val
  Variant (9)..(9): xaa in position 9 is Ile or Val
  Variant (10)..(10): xaa in position 10 is any amino acid
  Variant (11)..(11): xaa in position 11 is Ala, Gly or Ser
  Variant (13)..(16): xaa in position 13 to 16 is any amino acid
  Variant (17)..(17): xaa in position 17 is any or no amino acid
  Variant (19)..(39): xaa in position 19 to 39 is any amino acid
  Variant (40)..(40): xaa in position 40 is any or no amino acid
  Variant (42)..(42): xaa in position 42 is Leu or Met
  Variant (43)..(43): xaa in position 43 is Ala, Ile, Leu or Val
  Variant (44)..(44): xaa in position 44 is any amino acid
  Variant (47)..(47): xaa in position 47 is Phe, Trp or Tyr
  Variant (48)..(48): xaa in position 48 is any amino acid
  Variant (50)..(50): xaa in position 50 is Pro or Ser
  Variant (51)..(51): xaa in position 51 is any amino acid

SEQ ID NO: 55700 - DNA, 1359 bp, Escherichia coli
  CDS (1)..(1359)
atgttgagtatttttaaaccagcgccacacaaagcgcgcttacctgccgcggagatcgatccgacttatcgtcgattgcgctggcaaattttcctggggatattctttggctatgcggcttactatttggttcgtaagaactttgcgcttgctatgccttatctggttgagcagggattctcacgcggtgatttaggttttgccctttcggggatctcgattgcttatggattttcgaaattcatcatgggttcggtatcggatcgctcgaatccgcgcgttttcctgcccgcaggtttgattctggcggcggcagtgatgttgtttatgggctttgtgccatgggcgacgtcgagcattgcggtgatgtttgtactgttgttcctctgcggttggttccaggggatggggtggccgccgtgtggtcgtactatggtgcactggtggtcgcagaaagaacgtggcggcattgtgtcagtgtggaactgtgcgcacaacgtcggtggtggtattccgccgctgctgttcctgctggggatggcctggttcaatgactggcatgcggcgctctatatgcctgctttctgcgccattctggtggcattattcgcctttgcgatgatgcgcgataccccgcaatcctgtggcttgccgccgatcgaagagtacaaaaatgattatccggacgactataacgaaaaagcggaacaggagctgacggcgaagcaaatcttcatgcagtacgtactgccgaacaaactgctgtggtatatcgccatcgccaacgtgttcgtttatctgctgcgttacggcatcctcgactggtcaccgacttatctgaaagaggttaagcatttcgcgctagataaatcctcctgggcctacttcctttatgaatatgcaggtattccgggcactctgctgtgcggctggatgtcggataaagtcttccgtggcaaccgtggggcaaccggcgttttctttatgacactggtgaccatcgcgactatcgtttactggatgaacccggcaggtaacccaaccgtcgatatgatttgtatgattgttatcggcttcctgatctacggtcctgtgatgctgatcggtctgcatgcgctggaactggcaccgaaaaaagcggcaggtacggcagcgggctttaccgggctgtttggttacctgggcggttcggtggcggcgagcgcgattgttggctacaccgtggacttcttcggctgggatggcggctttatggtaatgattggcggcagcattctggcggttatcttgttgattgttgtgatgattggcgaaaaacgtcgccatgaacaattactgcaagaacgcaacggaggctaa

SEQ ID NO: 55701 - protein, 452 aa, Escherichia coli
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQERNGG

SEQ ID NO: 55702 - DNA, 1299 bp, Xenopus tropicalis
  CDS (1)..(1299)
atggcagcgcagggacagggttatggctactaccgtacagttattttttccgcaatgtttgtgggatacacactgtattacttcaatcggaagaccttttcctttgtcatgccatctgtaatgcaggagataaaactggataaagatgatctaggtctgatcaccagcagccagtctgcagcatatgccatcagtaagtttattagtggagttctgtctgatcagatgagcgctcgctggctgttttcctctggcttttgcttggtgggtctggtaaacgtggtattttcctggagttccagtgtgtcagtttttgccattctttggttttttaatggactagctcaaggactcggctggccaccatgtggaaaagtcctgcgcaagtggtttgaaccttcccagttcggcacttggtgggcagtgctctccactagtatgaacttggcaggcagtcttggccccatcatagctactctggtagctgccagttacagttggagatccacattatccctttctggtctgatctgtgtgggagcctctgtcctttgccttatacttataaagaatgagccttctgatgtggggctgaaaaacatagaacctgggcccaaaaaaggaaaacaagcttcccagtctggtgatgaaacaactctaaaggagttcttgctttccccgtacctttggctactgtgtgctggatacctagtggtatttggagtaaaaacctgctgtacagactggggacagctttttctcattcaggacaaaggacagtctgccctgataggcagctcatacatgagcgccctggaggttggtggcttggtgggcagtattgcagctggtttgttgtctgatcgagctgtggctaagatgggattgagaaatcatggtaatcctcgccatggcctgctcctctctatgatggctggaatggctgtgtccttgtacttgttccgtgttactgtcactgcaggatcttcaaaggtctggatcttgattctgggagctgtatttggattttcttcgtatggacctattgcactttttggagtcattgccaatgagagcgccccttccaatttctgtgggacatcacatgctattgtggccctctctgcaaatgtgggtggtttcctcgccggactcccatttagcactattgccaaacactatggttggaacacagcatttcaagcagctgagattacctgcttagctgttacaatcatatttttccttctaaggaatattcaaaccaagatgggccgtctgccgaagaaagcggactga

SEQ ID NO: 55703 - protein, 432 aa, Xenopus tropicalis
MAAQGQGYGYYRTVIFSAMFVGYTLYYFNRKTFSFVMPSVMQEIKLDKDDLGLITSSQSAAYAISKFISGVLSDQMSARWLFSSGFCLVGLVNVVFSWSSSVSVFAILWFFNGLAQGLGWPPCGKVLRKWFEPSQFGTWWAVLSTSMNLAGSLGPIIATLVAASYSWRSTLSLSGLICVGASVLCLILIKNEPSDVGLKNIEPGPKKGKQASQSGDETTLKEFLLSPYLWLLCAGYLVVFGVKTCCTDWGQLFLIQDKGQSALIGSSYMSALEVGGLVGSIAAGLLSDRAVAKMGLRNHGNPRHGLLLSMMAGMAVSLYLFRVTVTAGSSKVWILILGAVFGFSSYGPIALFGVIANESAPSNFCGTSHAIVALSANVGGFLAGLPFSTIAKHYGWNTAFQAAEITCLAVTIIFFLLRNIQTKMGRLPKKAD

SEQ ID NO: 55704 - DNA, 1290 bp, Mus musculus
  CDS (1)..(1290)
atggcagcccaaggctacggctactatcgcactgtcatatttgcggccatgtttggaggctacagcctgtactatttcaaccgcaaaaccttctcctttgtcatgccctccttggtggatgagatcgctctggacaaggacgatttggggctcatcacaagcagccagtcggcagcctacgccatcagcaagtttgtgagcggggttctgtcagatcagatgagcgcccgctggctcttctcctctgggctgctcctggttggtctggtcaacgtagtcttctcatggagctccacagtgtcagcctttgctgctctttggtttcttaatggtctggcacaggggctgggctggcccccctgtgggaagatcctgaggaagtggtttgagccatcccagtttggcacttggtgggctgtgttgtcaaccagcatgaacctggctggaagtttgggacctatcttggcaacgatcctcgcccagagctacagctggcgcagcacactggccctgtctggggcactgtgtgtggttgtctccttcttctgtctgctgcttatccacaatgaacctgctgatgttggactccgaaatctggaccctgccccctccaagggcaaaaagggctcatcaaaggaggagagcaccctacaggatctgctgctgtccccctatctctgggtgctgtccactggctacctcgtggtcttcggagtaaagacttgctgtacagactggggccagttcttccttatccaggagcgagggcagtccgcccttgtgggtagctcctacatcagtgccctcgaggtcggaggccttgtaggaagcattgcagctggttacctgtcagacagggccatggcgaaggcagggctgtctctgtatgggaaccctcgtcacggcctattgctactcatgatggctgggatggcagcatccatgttcctcttccgagtaacggtgaccagtgactcacccaagatctggatcctggttttaggagccgtgtttggtttctcttcttatggtcccattgccttgtttggagtcatagccaatgagagtgcacctcccaacttgtgtggaacctctcatgctattgtgggacttatggccaatgtgggtggatttctggctggcttacccttcagcaccattgccaagcactatagctggagcacagccttctgggtggcagaagtggtttgtggagccagcacagttgtcttcttcttgcttcgaaatatccgcaccaagatgggccgagtatccaagaagggagagtga

SEQ ID NO: 55705 - protein, 429 aa, Mus musculus
MAAQGYGYYRTVIFAAMFGGYSLYYFNRKTFSFVMPSLVDEIALDKDDLGLITSSQSAAYAISKFVSGVLSDQMSARWLFSSGLLLVGLVNVVFSWSSTVSAFAALWFLNGLAQGLGWPPCGKILRKWFEPSQFGTWWAVLSTSMNLAGSLGPILATILAQSYSWRSTLALSGALCVVVSFFCLLLIHNEPADVGLRNLDPAPSKGKKGSSKEESTLQDLLLSPYLWVLSTGYLVVFGVKTCCTDWGQFFLIQERGQSALVGSSYISALEVGGLVGSIAAGYLSDRAMAKAGLSLYGNPRHGLLLLMMAGMAASMFLFRVTVTSDSPKIWILVLGAVFGFSSYGPIALFGVIANESAPPNLCGTSHAIVGLMANVGGFLAGLPFSTIAKHYSWSTAFWVAEVVCGASTVVFFLLRNIRTKMGRVSKKGE

SEQ ID NO: 55706 - DNA, 1506 bp, Mus musculus
  CDS (1)..(1506)
atgcggtcctccctggctcctggtgtctggttccttcgcgccttctctagggacagctggttccgtggcttcatcctgctgctcaccttcctcatttatgcctgttatcacatgtccagaaagcccatcagcatcgtcaagagccgcctgcaccagaactgctcagagatggtcagacctgttaatgacacccacgatctcaatgataccacctggtgcagctggagtccattcgacaaagatgactacaaggagttactaggagctgtggacaatgccttcctagtggcttatgccattggcatgtttattagtggaatctttggggagcggctgcccctgcgttactacctctcggctggaatggtgctaagtggcctattcacctccctctttggcctggggtacttctggaatatccacatgctctggtactttgtgctcatccagatctgcaacgggcttgtgcagactacaggctggccatctgtggtgacctgtgttggcaactggtttgggaagggaaagcggggattcatcatgggcatctggaactctcacacatctgtgggcaacattctgggctctctgattgctggagtctgggtgaaccagcactggggcctgtcattcatcgtgcctggcattatcactgctatcatgggtgtcatcaccttcctctttcttattgaatatccagaagatgtggactgtacccctcctcggcatcatgatgacccggagaaggaacaggacaaccctgaggatcctgtgaatagtccctacagcagcagggagagtaatgtggacattgcagccagctcctccaaggagcagggccctgagcctgaagccatcagtttcctgggggcactcagaattccgggagtgatcgagttctctttatgtctgctctttgccaagttggtcagctatacctttctctactggctgcccttgtacatcttcaatgtggctcactttagtgccaaggaggctggggacctatccacggtttttgatgttggtggcatcataggtggcatcatggcagggctcatcagcgactacaccaatagcagggccaccacttgctgcatcatgctgatcttggctgctcccatgatgttcctgtacaactacattggccagaatgggataaccagttccatagtgatgttaattatctgtggggtcctggtcaatggcccttacgcactcatcacgacagcggtctctgctgacctgggcacacatgagagcctgaagggtaacgccaaggccctctccactgtcacggccattatcgacggcactggttccataggtgcggctctggggcccctactggccgggctcatttccccgacaggctggaacaatgtgttctacatgctcatctctgccgacgtcttggcttgcttgctcctctgcaggttggtgtacaaagagatcctggcctggaagacggcctgcggcagaagcagtgggtacaaacaaatttga

SEQ ID NO: 55707 - protein, 501 aa, Mus musculus
MRSSLAPGVWFLRAFSRDSWFRGFILLLTFLIYACYHMSRKPISIVKSRLHQNCSEMVRPVNDTHDLNDTTWCSWSPFDKDDYKELLGAVDNAFLVAYAIGMFISGIFGERLPLRYYLSAGMVLSGLFTSLFGLGYFWNIHMLWYFVLIQICNGLVQTTGWPSVVTCVGNWFGKGKRGFIMGIWNSHTSVGNILGSLIAGVWVNQHWGLSFIVPGIITAIMGVITFLFLIEYPEDVDCTPPRHHDDPEKEQDNPEDPVNSPYSSRESNVDIAASSSKEQGPEPEAISFLGALRIPGVIEFSLCLLFAKLVSYTFLYWLPLYIFNVAHFSAKEAGDLSTVFDVGGIIGGIMAGLISDYTNSRATTCCIMLILAAPMMFLYNYIGQNGITSSIVMLIICGVLVNGPYALITTAVSADLGTHESLKGNAKALSTVTAIIDGTGSIGAALGPLLAGLISPTGWNNVFYMLISADVLACLLLCRLVYKEILAWKTACGRSSGYKQI

SEQ ID NO: 55708 - DNA, 1290 bp, Rattus norvegicus
  CDS (1)..(1290)
atggcggcccaaggctatggctattaccgcactgtcatattcacagccatgttcggaggctacagcctttactacttcaaccgcaaaaccttctcttttgtcatgccctccttggtggatgagatcgctctggacaaggacgatttggggctcatcacgagcagccagtcggcagcctacgccatcagcaagtttgtgagcggggtgctgtctgatcagatgagtgcccgttggctcttctcctctgggctgctcctggttggtctggtcaacgtagtcttctcgtggagctctacagtgacggcttttgctgctctctggtttcttaatggtctggcacaggggctaggctggcccccctgtgggaagatcctgaggaagtggtttgagccatcccagtttggcacttggtgggctgtgttgtcaaccagcatgaacctggctggaagcctgggacctatcttggcgacaatccttgctcagagctacagctggcgcagcaccctggccctgtctgggtcactgtgtgtggttgtctccttcttctgtctgctgctcatccacaacgaacctgctgatgttggactccgaaatctggaccctgccccctccaagggcaaaaagggctcgtcaaaggaggagagcaccctacaggacctgctgctgtccccctatctctgggtgctctccactggctacctcgtggtctttggggtaaagacttgctgtacagactggggccagttcttccttatccaggagagagggcagtcggccctcgtgggtagttcctacatcagtgccctagaggttggaggccttgtaggcagcattgcagctggctatctgtcagacagggctatggcaaaggcagggctgtctgtgtatgggaaccctcgccacagcctgttgctgctcatgatggctggcatggcagcatccatgttcctcttccgggtaacggtgaccagcgactcgcccaagatctggatcctggtgttgggagccgtgtttggtttctcttcttatggtcccattgccttgtttggagtcatagctaatgagagtgcacctcccaacttgtgtggtacctctcatgctattgtggggctcatggccaatgtgggtggatttctggctgggttacccttcagtaccatcgccaagcactatagctggagcacagccttctgggtggcagaagtgatctgtatagccagcacagttgtcttcttcttgcttcgaaatatccgcaccaagatgggccgagtatccaagaaggcagagtga

SEQ ID NO: 55709 - protein, 429 aa, Rattus norvegicus
MAAQGYGYYRTVIFTAMFGGYSLYYFNRKTFSFVMPSLVDEIALDKDDLGLITSSQSAAYAISKFVSGVLSDQMSARWLFSSGLLLVGLVNVVFSWSSTVTAFAALWFLNGLAQGLGWPPCGKILRKWFEPSQFGTWWAVLSTSMNLAGSLGPILATILAQSYSWRSTLALSGSLCVVVSFFCLLLIHNEPADVGLRNLDPAPSKGKKGSSKEESTLQDLLLSPYLWVLSTGYLVVFGVKTCCTDWGQFFLIQERGQSALVGSSYISALEVGGLVGSIAAGYLSDRAMAKAGLSVYGNPRHSLLLLMMAGMAASMFLFRVTVTSDSPKIWILVLGAVFGFSSYGPIALFGVIANESAPPNLCGTSHAIVGLMANVGGFLAGLPFSTIAKHYSWSTAFWVAEVICIASTVVFFLLRNIRTKMGRVSKKAE

SEQ ID NO: 55710 - DNA, 1533 bp, Arabidopsis thaliana
  CDS (1)..(1533)
atggcgtcgtggacttcatctgaattcctctatgaagaagtaaaaccaccaggtattcatttcctagaacgtttcaggcgttcaggaaaactctctttcaagcaatatcaagcaatggtctttgtcttgaccttcattgcttatattgccttccacgcaacacgaaagcctaacagcatcgtcaaaggaacactctctgaacaaccaaccggacatttcaagggtgcagataaaggtggatgggctcctttcgatggtccagatggaacagctctgcttggacaaatcgatttggctttcctctctgtttacgcggttggaatgtttgtggctggtcatttgggtgatcgtttggacctcaggacgtttctaacaataggtatggtcgggacaggagtgtgtactgctctgtttggagtcgctttttgggccaatatccatgctttctactatttccttgcgattcagacattggcagggtggtttcagtctattggatggccttgcgtggttgcggttttgggaaactggtttgataagaagaggagaggagtcattatgggtgtttggagtgctcatacatcattagggaatatcattgggactttaatcgctacggggcttttgaagtttggttggggatggtcttttgttggtccggctttgctcattacgtttcttggcattgtggtttacctattcttgcctgtgaaccctcatgctgttgaagctgagagagatgggagtgaagttgattccacaatgagactcggtgacaccattacagagagtttcttaagctctaggacgagtactggattcgatagaagagctgtcgggttcttagcggcttggaaaatccccggtgttgctcctttcgccttctgtctcttcttcaccaaactggtctcttacacattcctctattggcttcctttctacgtaagccagactgagataggaggagaacaattgtcacaggagacatcgggaaacttatcgacactcttcgatgttggaggcgttgttggaggaatcttagccggatatttctctgaccagctcgacgggagagcaattacagccggaggattcatctacttaacaatcccagctctgttcctctacagaatatacggtcatgtctcaatgacaatcaatatcatcctcatgttcgtagctggattatttgttaatggaccttacgctctcatcacaaccgcggttgcagctgatctcggtactcacaagtcgcttaaaggcaatgcaagggctttggctacagtgactgctattatagatggaacaggatcagttggtgcagccattggacctgttcttacaggttatatcgctgcgattagttgggatgctgtgttttacatgttgatgactgcagctttgatctctggattgttgctcactacgcttattatagaagaagtgaaaactttgttgtatggatcttctgaagaagatcatgaagtcgctgctgcttctacatcaagacctcccattgatgtcctcatatga

SEQ ID NO: 55711 - protein, 510 aa, Arabidopsis thaliana
MASWTSSEFLYEEVKPPGIHFLERFRRSGKLSFKQYQAMVFVLTFIAYIAFHATRKPNSIVKGTLSEQPTGHFKGADKGGWAPFDGPDGTALLGQIDLAFLSVYAVGMFVAGHLGDRLDLRTFLTIGMVGTGVCTALFGVAFWANIHAFYYFLAIQTLAGWFQSIGWPCVVAVLGNWFDKKRRGVIMGVWSAHTSLGNIIGTLIATGLLKFGWGWSFVGPALLITFLGIVVYLFLPVNPHAVEAERDGSEVDSTMRLGDTITESFLSSRTSTGFDRRAVGFLAAWKIPGVAPFAFCLFFTKLVSYTFLYWLPFYVSQTEIGGEQLSQETSGNLSTLFDVGGVVGGILAGYFSDQLDGRAITAGGFIYLTIPALFLYRIYGHVSMTINIILMFVAGLFVNGPYALITTAVAADLGTHKSLKGNARALATVTAIIDGTGSVGAAIGPVLTGYIAAISWDAVFYMLMTAALISGLLLTTLIIEEVKTLLYGSSEEDHEVAAASTSRPPIDVLI

SEQ ID NO: 55712 - DNA, 1635 bp, Arabidopsis thaliana
  CDS (1)..(1635)
atggcgatgaattcgaagaggaaaacaccacctgggattgcgcttctgaggagagtcagaggaagaaattggagtccaaagacgtttcggtacgcgattttgtttattactttcatcgcatatgcttgttaccatgcttctcgtaaaccaagcagcatagtgaagagcgttttacacccagactcaagcactaagccacctcaagaacataacagcgacaaaatttatccttggcctatgggtaacgtgtttgtgaagagagaaattggtgatatagatgaggttttgttgcatcgtaagtctaaaggatgggaaccgtttaatgggaaagatgggacgtctaggttgggagagattgatgtggcgtttcttgcttgttactctataggaatgtatgttgctggtcatttgggtgatagtttggatctgagattgtttctgacttggggaatgattgggagtgggttctttgttgggttgtttggtatgggttatttctggaacattcatgcgttttggttctttttggttatgcaaatggcggctgggttgtttcaggcgacaggatggccatctgttgtggctgttgttgggaattggtttgggaaaaggaagagaggtcttataatggggatttggaatgctcatacttctgttgggaacatttgtggttctttaattgctgctggtgttcttgaatatggttggggatggtcttttatagctcctggttttgtcatgtctttaggaggagttcttgtttatttgttcttggctgcgtatcctgaggatgttgggtttccagatatcaattctaattcagggaagtttattaagaggaagagagatgttgaagaggaagaagaggaagtagaagaagatttagggacagatgttgaaggggatggggagggatcatcagggtcaggttcagggtatgagaataaaagaagtgttggacttttgcaagcttgtatgatccctggtgttataccgtttgcgttgtgtctctttttctcgaagctggtcgcgtacacgttcttgtactggttaccgttttacttgagccaaacaactattggtggagagtacgtgtctgtgaaaacagcagggaatctctccacactatttgatgttggaggcattgtaggagggattctttgtggttacatttcagacaaattcaaagcaagggctacaactgcagctgcattcatgtacgctgcgattccggcaatgcttgtgtaccattcctatggaggtgtctctcagacagtcaacatcctcctcatgatggttgctggtttgtttgtcaatggtccttatgcactcatcacaaccgcagtctctgcggatctgggaacgcacaagtctttacaaggcgattcaagggcgcttgcgactgttactgctatcattgacgggactggatctgccggtgcggctttaggtccgcttttgacagggtttctttctactctgggttggcaagctgtgttctatatgttggtcgttggagctctctgtgctggtttgcttttgacccgtctggttattgctgaaattagagagaaacttggatatgttgatgaagaagttcctgcttctgaaccactgttaaccgatagaagatga

SEQ ID NO: 55713 - protein, 544 aa, Arabidopsis thaliana
MAMNSKRKTPPGIALLRRVRGRNWSPKTFRYAILFITFIAYACYHASRKPSSIVKSVLHPDSSTKPPQEHNSDKIYPWPMGNVFVKREIGDIDEVLLHRKSKGWEPFNGKDGTSRLGEIDVAFLACYSIGMYVAGHLGDSLDLRLFLTWGMIGSGFFVGLFGMGYFWNIHAFWFFLVMQMAAGLFQATGWPSVVAVVGNWFGKRKRGLIMGIWNAHTSVGNICGSLIAAGVLEYGWGWSFIAPGFVMSLGGVLVYLFLAAYPEDVGFPDINSNSGKFIKRKRDVEEEEEEVEEDLGTDVEGDGEGSSGSGSGYENKRSVGLLQACMIPGVIPFALCLFFSKLVAYTFLYWLPFYLSQTTIGGEYVSVKTAGNLSTLFDVGGIVGGILCGYISDKFKARATTAAAFMYAAIPAMLVYHSYGGVSQTVNILLMMVAGLFVNGPYALITTAVSADLGTHKSLQGDSRALATVTAIIDGTGSAGAALGPLLTGFLSTLGWQAVFYMLVVGALCAGLLLTRLVIAEIREKLGYVDEEVPASEPLLTDRR

SEQ ID NO: 55714 - DNA, 1515 bp, Arabidopsis thaliana
  CDS (1)..(1515)
atggcgtcatggacttcatcccagttcctgtatgaagaaaccaagccatggggtattcagttcttggaaaagtttaagcgttcaggaagactctccttcaagcaataccaagcccttgtcttcattttgacctttgtcgcctacatcgccttccatgctgcccgaaagcccaatagcattgtcaagggaacactttctgcatcaacaatcgaaggcggttgggctccttttgatggacctgatggaacagccttgcttgggcagatcgacttggctttcctctctgtctatgcggttgggatgtttgtggcaggtcacttgggcgatcgtttggatctcaggacgtttctgaccatcggtatgatcgggaccggccttttcacagctctcttcggggtcgcattctgggcgaatttccacagcttctactatttcttggcggttcaggttatggcggggttgtttcagtcgataggttggccttgtatcgtggctgtgctcgggaattggttcgacaagaagagaagaggaatgattatgggtgtttggagcgctcacacttccctcggtaacattgcagggtctctgatcgcgtctgggctgcttagatatgggtggggttggtcatttcttggcccggcttttctcatgacttttcttgggatcgttgtttaccttttcttgccggtgaatcctccaaccgttgaggcagagagagatggaactgaaattgactctaccatgaggctcggtgacaccattacagagagcttattggaatctagaatgagtactggattcgatagaaaggcagtcgggttcatggccgcttggaaaatccccggtgttgctcctttcgccttctgcctcttcttcacaaagttggtctcatacactttcctctactggcttcctttctacgtcagccacaacatgatcggaggagagtacctgtcagaggagacatcaggaaacttgtcgacaatcttcgatgttggaggcgttgttggtggagtcttagccggatacatatctgatcaactcaacggcagagccatcacagcagcaggattcatgtacttggccatcccagctcttttcctctacagagtctttggacacatctcattgaccatcaatgtcatcctcatgttcacatcaggagtcttcatcattggaccatttgctctcatcacaacagctgtctcagctgatctcggaacccacaaatctctcaaaggcaatgcaagggctttggctacagtctcagctatcatagacggcacaggatccgtcggtgctgcgattggaccagtcctcactggttacatctctgccataagctgggacgcagtgttttacatgttgatgactgcagcattgatctctggattgttgctcactaaactaatcatagcagaagtcaaagcgttattgtttggatcagaagatgaagtagctgcatcatcatcatcaccaccagcatccagacctcccattgatgtcctcgtttga

SEQ ID NO: 55715 - protein, 504 aa, Arabidopsis thaliana
MASWTSSQFLYEETKPWGIQFLEKFKRSGRLSFKQYQALVFILTFVAYIAFHAARKPNSIVKGTLSASTIEGGWAPFDGPDGTALLGQIDLAFLSVYAVGMFVAGHLGDRLDLRTFLTIGMIGTGLFTALFGVAFWANFHSFYYFLAVQVMAGLFQSIGWPCIVAVLGNWFDKKRRGMIMGVWSAHTSLGNIAGSLIASGLLRYGWGWSFLGPAFLMTFLGIVVYLFLPVNPPTVEAERDGTEIDSTMRLGDTITESLLESRMSTGFDRKAVGFMAAWKIPGVAPFAFCLFFTKLVSYTFLYWLPFYVSHNMIGGEYLSEETSGNLSTIFDVGGVVGGVLAGYISDQLNGRAITAAGFMYLAIPALFLYRVFGHISLTINVILMFTSGVFIIGPFALITTAVSADLGTHKSLKGNARALATVSAIIDGTGSVGAAIGPVLTGYISAISWDAVFYMLMTAALISGLLLTKLIIAEVKALLFGSEDEVAASSSSPPASRPPIDVLV

SEQ ID NO: 55716 - DNA, 1290 bp, Rickettsia prowazekii str. Madrid E
  CDS (1)..(1290): transl_table=11
atgacaaatatagagtctaaaattaaaatgccaaggtcgccatatgtaaaaaaatataatagttggcgaataaggattttatattctattgttataggttatgcgactttttatttttgtcgtcagaattttaatatagctacccctgctataagagaatattttggtgttactaaaacacaaattggttggatcttaactgctgcatctattatgtatggagttagtaaagcttgtaatgggtttattagcgataaagttaatgcgcgaatatttatggttttagggcttttatttgttgggattattactattctaataggtttttcagattttttatggcttataggaattttatggatagccagtaactggtttcaatcaatgggatggcctcctgcaacaaaaatgctcactcactggtttgctgcaaaagaacttggaactaaatgggctattggtgcgacttctaatcaaataggtggtgctctcgctatgataagttgcggttatttaattgataaatttgattggagagctgctttttttgttccaggtttagttgcgtgtgtagcatcactttttttatataataggttacgtaattctccaaaagaagttgggttatctacagtagaagaatataaagaatatccacctgaagctataggaaattatgagcgattattaactaaacaattacttaagatggtcttttgtaataagctaatatggtatgtttgtttagcaaacatgtttgtttatatcatccgttctggagtaatttattgggctccaacatttttaaaagatttacgtaatataagctttgtaaatgcaggtttacaaattggtttatatgagatgataggtattccaggagcattaatagcaggtattttatctgataagctatttcaaggtcgtagaggtcctattgcatctatatgtatgatattgcttaccttattgttagttttgttttggaaagtccctattcaaagtgaattattaagtatattaattcttgcgttaataggcttttttgttgcaggacctcagctccttgtaggtatagcagctgctgattttagtactcgtcaagctgttggtactgctaatggattatcaggattatttggttatttaggcgctgcgattgcgggagtaggagtaggatggattagtgataattacgggtggaatggagtatttatattttttagtatttctgctcttttagggggagtattatttgctttgacatggaaccattcagctgaaaaatag

SEQ ID NO: 55717 - protein, 429 aa, Rickettsia prowazekii str. Madrid E
MTNIESKIKMPRSPYVKKYNSWRIRILYSIVIGYATFYFCRQNFNIATPAIREYFGVTKTQIGWILTAASIMYGVSKACNGFISDKVNARIFMVLGLLFVGIITILIGFSDFLWLIGILWIASNWFQSMGWPPATKMLTHWFAAKELGTKWAIGATSNQIGGALAMISCGYLIDKFDWRAAFFVPGLVACVASLFLYNRLRNSPKEVGLSTVEEYKEYPPEAIGNYERLLTKQLLKMVFCNKLIWYVCLANMFVYIIRSGVIYWAPTFLKDLRNISFVNAGLQIGLYEMIGIPGALIAGILSDKLFQGRRGPIASICMILLTLLLVLFWKVPIQSELLSILILALIGFFVAGPQLLVGIAAADFSTRQAVGTANGLSGLFGYLGAAIAGVGVGWISDNYGWNGVFIFFSISALLGGVLFALTWNHSAEK

SEQ ID NO: 55718 - DNA, 1410 bp, Vibrio cholerae O1 biovar eltor str. N16961
  CDS (1)..(1410): transl_table=11
gtgagttccgatagtagaggtttataccatcgcaaaaacaatgaggtcactatgttcgagctcttcaaaccggctgcgcatacgcagcggctgccatccgataaggtggacagcgtctattcacgccttcgttggcaacttttcatcggtatttttgttggctatgcaggctactatttgggtcgtaagaactttagtttggcaatgccttacctgattgaacaaggctttagtcgtggcgatctgggtgtggctctcggtgcggtttcaatcgcgtatggtctgtctaaatttttgatggggaacgtctctgaccgttctaacccacgctactttctgagtgcaggtctactcctttcggcactagtgatgttctgcttcggctttatgccatgggcaacgggcagcattactgccatgtttattctgctgttcttaaacggctggttccaaggcatgggttggcctgcttgtggccgtactatggtgcactggtggtcacgcaaagagcgtggtgagattgtttcagtctggaacgtcgctcacaacgtcggtggtggtttgattggccccattttcctgctcggcctatggatgtttaacgatgattggcgcacggccttctatgtccccgctttctttgcggtgctggtggccgtatttacttggctagtcatgcgcgataccccccaatcttgtggtttaccaccgattgaagagtacaaaaacgactatcccgatgattacgataagtcgcatgaaaatgagatgactgcgaaagagatcttctttaagtatgtcttcaacaacaaactgctttggtcgattgcgattgctaacgccttcgtttacctgatccgctacggtgtacttgactgggctccggtttacctcaaagaagccaaacacttcacggttgataaatcttcttgggcttacttcctgtacgagtgggcgggcatcccgggtactttgttgtgtggttggatttccgacaaagtgtttaaaggccgccgcgcgccagcaggcatcctgttcatggttttagtaactctggcagttctggtttactggttcaacccagctggtaacccagcggtagatatggctgctctggtcgcgatcggctttttgatctacggccctgtgatgttgattggcctttacgctctggaactggctccgaagaaagccgccggtaccgcagcaggtctgactggtctctttggctacttaggtggtgctgtggcagctaacgcgatattgggctataccgttgaccacttcggttgggatggcggcttcatggtcttggttgcctcttgtgtactctcagtgctctgcttgatttacgctttcgttggcgaacgcgctcaccataacgataagcttaaacaagcgaccatttaa

SEQ ID NO: 55719 - protein, 469 aa, Vibrio cholerae O1 biovar eltor str. N16961
MSSDSRGLYHRKNNEVTMFELFKPAAHTQRLPSDKVDSVYSRLRWQLFIGIFVGYAGYYLGRKNFSLAMPYLIEQGFSRGDLGVALGAVSIAYGLSKFLMGNVSDRSNPRYFLSAGLLLSALVMFCFGFMPWATGSITAMFILLFLNGWFQGMGWPACGRTMVHWWSRKERGEIVSVWNVAHNVGGGLIGPIFLLGLWMFNDDWRTAFYVPAFFAVLVAVFTWLVMRDTPQSCGLPPIEEYKNDYPDDYDKSHENEMTAKEIFFKYVFNNKLLWSIAIANAFVYLIRYGVLDWAPVYLKEAKHFTVDKSSWAYFLYEWAGIPGTLLCGWISDKVFKGRRAPAGILFMVLVTLAVLVYWFNPAGNPAVDMAALVAIGFLIYGPVMLIGLYALELAPKKAAGTAAGLTGLFGYLGGAVAANAILGYTVDHFGWDGGFMVLVASCVLSVLCLIYAFVGERAHHNDKLKQATI

SEQ ID NO: 55720 - DNA, 1311 bp, Vibrio cholerae O1 biovar eltor str. N16961
  CDS (1)..(1311): transl_table=11
atgaagattgtacctatggtgcaacccattcaggcaatggaaatcgatcaggcttatcgccactggcgcattcatttaatgatttccatgtatgtcggttatggcgtgttctatctcacacgtaaaagcttcaattttgcgatgccgcaaatgctcagtgagttaggactcgattactccgatttgggttttctcagtacgctgttctacctcacttacggggtgtctaaatttgtttctggtttgatgatcgaccgctcccgctcgccctatttcatggggttgggattgatggccaccggcatcatcaacatcgcttttggttttagttcgtccttgttggcttttaccttgttatggacggcgaatgctttttttcaaggctggggctggcctgcgtgtgccaaggtgctcacccactggtattcacgtagcgaacggggcttttggtggtcaatttggaatacttgccacaacttaagtggcgcattgatccccatcgtgattggttttatcagcttaacctttggctggcgttacggattcttgtttgccggcggagttgcgattttcgttgggctttggctctgttatcgcatccaagagaagccaagcgaaatggggttgccttcggtcggcgaatggcgcggtgatgcccttgaactggaacacgaaaaagaaggccaaggtctcgccttccgcgttgcggtttatcgctatgtactgactaatcgctacatttggctgttgtgtggatcttacttgctggtgtacgtggtcagaattggcattaacgactggggatcgctttatctggttgagcggcacgcatacaacattctcagtgccaatagcgcagtagccatgtttgaagtgggcggatttttgggctcgttgcttggtggctggggttccgactattactttcgcggcaaccgtgccccgatgaatttgatttttgcgttaggcatttttgcctccgttgcggccttatggctgacacctatcgatcatttatggtttttggctggctgcttcttctgtatcggattttttgtcttcggcccgcaaatgatgattggtatggctgccgcagaatgcgcaaggaaagatttggcaggcaccgcgaccgggttcgttggcttatttagctatctcggtgcagctttagccagctaccccatgtcactggctattgaagcatggggctgggaaggcttcttctgcctaattactgcggcagcagccgtgatcagtttacaactgctgccctttataaaagctcagcaaccggtgacggaagatgagtga

SEQ ID NO: 55721 - protein, 436 aa, Vibrio cholerae O1 biovar eltor str. N16961
MKIVPMVQPIQAMEIDQAYRHWRIHLMISMYVGYGVFYLTRKSFNFAMPQMLSELGLDYSDLGFLSTLFYLTYGVSKFVSGLMIDRSRSPYFMGLGLMATGIINIAFGFSSSLLAFTLLWTANAFFQGWGWPACAKVLTHWYSRSERGFWWSIWNTCHNLSGALIPIVIGFISLTFGWRYGFLFAGGVAIFVGLWLCYRIQEKPSEMGLPSVGEWRGDALELEHEKEGQGLAFRVAVYRYVLTNRYIWLLCGSYLLVYVVRIGINDWGSLYLVERHAYNILSANSAVAMFEVGGFLGSLLGGWGSDYYFRGNRAPMNLIFALGIFASVAALWLTPIDHLWFLAGCFFCIGFFVFGPQMMIGMAAAECARKDLAGTATGFVGLFSYLGAALASYPMSLAIEAWGWEGFFCLITAAAAVISLQLLPFIKAQQPVTEDE

SEQ ID NO: 55722 - DNA, 1380 bp, Vibrio cholerae O1 biovar eltor str. N16961
  CDS (1)..(1380): transl_table=11
atgcttaatttctttaaaacccgccccgatctgcctttactcagcagctcaaaagcggaaatgttaaaacgctacaaaagctatcaatggcaagtctttattggcctgattttcggttatgccatgttctacgtggtacgtatggcgctcggcgtagtgaaaaaaccgatgctggatgctggcatcgtcaccctcgaagaactcggcatcatgggttcggccttcttctttacttatgcctttggtaagttcctgaacggctttctatctgactacgccaacattggccgctttatgtcgttctcgctgctgctgtcgggcgttgcttcgatcttcatggggatgaacacggtcgcgttcttcttcgttctgctgtggggcttgaacggttggttccagtcggtcggttctgcaccatcttgcgtctctatctaccaatggttctctccaaagcaacgtggtagccgttactccatctggggcggctcacgtaacatcggtgaaggtatcacttggatcctaaccgcaagcttggtgagctactttggctggcgtgcaggtttcatcggtgcgggtatcgcgggtgtcgtggcttctctcatcatgtttaagctactgaaagaccgcccacaaacttatggtatgcctgatccaggcacagcgtttgaggaaggcacggaaatcaaaaaagccaacgatccaaaagaaacacgccgtgcgcaaatgttcatcctgaagcaacctgtggtatggcttatcgctctggcttgtgcggcgatgtacatctctcgctacgccatgtcttcttgggcagtgctgttcctgcaagagcaaaaaggctactcactgattgacgctggttttgccatgtccatgtacccaactgcgggtctggctggtgcgattctgtcaggtatcttgtctgacaaagtgttcaaaggtaaccgtaacatccctaacctgctgtacggattgaccaacatcgctggtatgtgtctgatgttcttcggcccagataaccgtatcgttgatgctgtagcactgagcatgatcggcttctcgatcggtggtctagtcgtgttccttgccggccttatcgcttgtgacctaatgccgaaaaacgcagtcggcgccgtgaaaggcctgatcggtctctgttcttacatcgctgcttctgctcaagaacttatctctgcatcactgatcacagtgactgaagtcgaaggcgtaaaacattacgacttcggtaacgctcagtacttctggttggctgctggggtggtttcagtactactcgccctaaccgtgtggaatgccaagaaagtcgtcgatatcgacgaagcagaaggcaagccgttgaaaacccaaaccgcttcttaa

SEQ ID NO: 55723 - protein, 459 aa, Vibrio cholerae O1 biovar eltor str. N16961
MLNFFKTRPDLPLLSSSKAEMLKRYKSYQWQVFIGLIFGYAMFYVVRMALGVVKKPMLDAGIVTLEELGIMGSAFFFTYAFGKFLNGFLSDYANIGRFMSFSLLLSGVASIFMGMNTVAFFFVLLWGLNGWFQSVGSAPSCVSIYQWFSPKQRGSRYSIWGGSRNIGEGITWILTASLVSYFGWRAGFIGAGIAGVVASLIMFKLLKDRPQTYGMPDPGTAFEEGTEIKKANDPKETRRAQMFILKQPVVWLIALACAAMYISRYAMSSWAVLFLQEQKGYSLIDAGFAMSMYPTAGLAGAILSGILSDKVFKGNRNIPNLLYGLTNIAGMCLMFFGPDNRIVDAVALSMIGFSIGGLVVFLAGLIACDLMPKNAVGAVKGLIGLCSYIAASAQELISASLITVTEVEGVKHYDFGNAQYFWLAAGVVSVLLALTVWNAKKVVDIDEAEGKPLKTQTAS

SEQ ID NO: 55724 - DNA, 1293 bp, Pasteurella multocida subsp. multocida str. Pm70
  CDS (1)..(1293): transl_table=11
atgatgccaatacaaaacttttcgcaaattgaccgcacttatcgctactggcgcattcacttaatgattgccatgtacgtaggctatgccggtttttacctcagccgtaaaagcttgaattatgccatgcccgccttaatcagcgatttggctatggataaaaatgccattggactcatggcaactttgttttatctcacctatggtttatccaaatttttctctggacttttttctgatcaagccaacccccgttacattatggctatcggcttgatgatgacagggatcacgaatattttattcggtttatccagttccgtgtttctgttcacttgcctatgggtcatcaatgcgtggtttcaggggtggggctggcctgcgtgttctaaatatctcactacgtggtattcccgtagcgagcgaggtttatggtggtctatttggaatactgcgcacaatgtgggaggcgccttaattccgctaattgttggctatctcactttacattacagctggcgacacggctttattgtagcaggcataatcgtcatactcatcagtgtatttttactgtggcgtttacctagcacgccagatgcaatggggttgcctagtattggacaatggcgtcatgatcctttggaattagcacaagaaaaggaaggacaagatttaccatggcggcaaatcttgcgtgattatgtgttctacaataaatatctttggctactcgcaatgagctatgcattggtctatctcgtgcggaccgccattaatgactggggtaatctctatctaagtgaacgttatcactatgacttagtcagtgcgaacagcgcactctctttatttgaaatcggtggttttatgggatcactagtcgccggttggggatcagataaactgttttctagcaatcgaggacctatggcattggtgtttgccattggcattttcttttcgattaccgcgctttggctgatgccaaaagaaaacatgctattacagtctggcttatttttctgtgtcggcttttttgtgtttggtccgcaaatgttaatcggcatggctgctgcggaatgtgcccacaaaaaaaccgcaggcaccgccacgggttttgttggcttgtttgcttatctgggggcagccctcgctggctacccactggcactcatcacacaaacgtttcattggaccggtttttttgtcgtaatttcttgctgtgcatttgctattgcgttactgctactgccttttttaaaagtacagccaaatcaatcgtcttgttga

SEQ ID NO: 55725 - protein, 430 aa, Pasteurella multocida subsp. multocida str. Pm70
MMPIQNFSQIDRTYRYWRIHLMIAMYVGYAGFYLSRKSLNYAMPALISDLAMDKNAIGLMATLFYLTYGLSKFFSGLFSDQANPRYIMAIGLMMTGITNILFGLSSSVFLFTCLWVINAWFQGWGWPACSKYLTTWYSRSERGLWWSIWNTAHNVGGALIPLIVGYLTLHYSWRHGFIVAGIIVILISVFLLWRLPSTPDAMGLPSIGQWRHDPLELAQEKEGQDLPWRQILRDYVFYNKYLWLLAMSYALVYLVRTAINDWGNLYLSERYHYDLVSANSALSLFEIGGFMGSLVAGWGSDKLFSSNRGPMALVFAIGIFFSITALWLMPKENMLLQSGLFFCVGFFVFGPQMLIGMAAAECAHKKTAGTATGFVGLFAYLGAALAGYPLALITQTFHWTGFFVVISCCAFAIALLLLPFLKVQPNQSSC

SEQ ID NO: 55726 - DNA, 1446 bp, Pasteurella multocida subsp. multocida str. Pm70
  CDS (1)..(1446): transl_table=11
atgattggtccatttaaacccgcaccgcatattgcggaacttcccgcggataaaattgatgcacgctatcgtttcttacgttggcaagtgtttgctggcatcttttttggttacgccgcttattatttcgtccgtgcaaacttcgatttagcacaaaaaggcttgattgaagctggtatgtataacaaagctgaacttgggattatcggtacaggggcgggtttggcatacggcttatcgaaattctttatggcatccatttccgatcgctcaaacccaaaagtctttttacctttcggtttgctcttatctggtttgtgtatgacgatgatgggtctcatgccatgggcaacctcagggattgctgtgatgttcatcatgattttcttaaacggttggttccaaggtatgggttggccaccatgtggtcgtacaatggtgcattggtggtctaaatctgaacgtggttcgatcgtgtcaatttggaataccgcgcataacttagggggaatggtaccaggggcgatggtgttactcgccagtgccgtttacttcagcacacatggtgttgaagcgaccgcaaaagacgtttggcaacaagctctttattatccaggtattgcagccatgattgcggcgattccaatttattttatgatgaaagacacaccacaatcttgtggtttacctcctatcgaaaaatggcgtaatgattacccagacgattacaacgaaaaaacctatgagcatgatttaagcacaaaagatattttcgtgacttacgtcttaaaaaatcgcctactttggtatatcgcgattgctaacgtattcgtgtatttaatccgctacggtgtcttaaaatggtcgccagtgtaccttggcgaagtgaaacacttcaacatcaaagggactgcttgggcgtacactatttatgaattagccgcggttccagggactttattatgtggttgggtctctgataaagtgttcaaaggtaaacgtggtttaacaggtttcattttcatgattttaaccactgccgccgtcgtagcattatggttaaacccagcaacaccagaagctgaattagctaaatatgcaggtcatgcatggtatgaaaacccatatcagttaatggacttcattctcatgacaaccattggtttcttaatctacggtcctgtgatgcttatcggtttacatgcgcttgagcttgcgccgaaaaaagcggcagggacatctgcaggtttcaccggtttatttggttacttaggtggtactgtatctgcatcagccgtagtgggttgggctgccgaatattatggctgggacggtggtttctacgtcatgatcgcaggtggggtactcgctatcttattaatgttcatcactatgattgaagaaagtaaacataaagcccgtttagaagatcattacggcaaataa

SEQ ID NO: 55727 - protein, 481 aa, Pasteurella multocida subsp. multocida str. Pm70
MIGPFKPAPHIAELPADKIDARYRFLRWQVFAGIFFGYAAYYFVRANFDLAQKGLIEAGMYNKAELGIIGTGAGLAYGLSKFFMASISDRSNPKVFLPFGLLLSGLCMTMMGLMPWATSGIAVMFIMIFLNGWFQGMGWPPCGRTMVHWWSKSERGSIVSIWNTAHNLGGMVPGAMVLLASAVYFSTHGVEATAKDVWQQALYYPGIAAMIAAIPIYFMMKDTPQSCGLPPIEKWRNDYPDDYNEKTYEHDLSTKDIFVTYVLKNRLLWYIAIANVFVYLIRYGVLKWSPVYLGEVKHFNIKGTAWAYTIYELAAVPGTLLCGWVSDKVFKGKRGLTGFIFMILTTAAVVALWLNPATPEAELAKYAGHAWYENPYQLMDFILMTTIGFLIYGPVMLIGLHALELAPKKAAGTSAGFTGLFGYLGGTVSASAVVGWAAEYYGWDGGFYVMIAGGVLAILLMFITMIEESKHKARLEDHYGK

SEQ ID NO: 55728 - DNA, 1335 bp, Pseudomonas aeruginosa PAO1
  CDS (1)..(1335): transl_table=11
atgaacaaccacaacggtaccctgcaccgtggctggcaatcgctccagcgctggcgcatccagatcttcgtcatcacctggctggcctacgccgccttctacttcacccgcaaggccttctcggtggccaagctcggcatcgccgaagacccctccttcgagctcgacaagagcgccatggccgatctcgatgccctctacctggccgcctacgccgtgggccagttcatgtggggggtgttcgccgaccgcttcggcacccgcgtggtggtgctcggcggtttgctcacctcggcgctggcggcgctgatgatgggtaccttcgccaccctgccgatcttcgccgcctgcatggtggtccagggcctggcgcagtccaccggctggtcggggctgtgcaagaacatcggcgccttcttcgccacctacgagcgaggccgcgtgctcggcctgtggagtacctgctacgccttcggcgggctggtggcgacgccgttcgccggctggtgcgcctaccggttgacgcatgactggcgcatggccttcctgtcctcggcgggagtggtgctggcggtggccgtgctgttcttcttcctccagcgcaaccgtccgcaggacgtcggcctgccgcccgtggaggccgaggccgcgccccccgccaacgcgccccggccgagccattccggcgccctgctgaaggcgctcaggaatccccacgtgctggtcctcggcatcgcctacttcctgctcaagccggcgcgctacgcgatcctgctctggggcccggtgatcatctacgaacgcatgccggagatcggcaaggtcgcctcggccatcgtgccttcggccttcgaggtcgccgggctggccgggccgatcctcatcggcctggcctcggacaagctgttcggcgcccgccgcatgccggcctgcgtgctcagcctggcggcgctgaccctgagcctggcgctgttcgtcccggcgatgcagagcggcagcctgtacctggtggtcagcctgctgttcatgatgggcgtcaccctctacgggccggactcgatgatcagcggcgccgccgccatcgacttcggtaccagcgaagcagccggtaccgccaccggcttcgtcaacggctgcggctcggtcggggcgatcctcggcggcctgctgccgggctacttcgacaccctcacggtgttcttcgtgttcaccgccaccgcgctgctcgccagcctgctgctggtgccgttctggaacagccggccaggcgcgtgccgcgtcgaaccgaaggcgcatgccagcgggccgctgctggcggccggcaagccgcgttga

SEQ ID NO: 55729 - protein, 444 aa, Pseudomonas aeruginosa PAO1
MNNHNGTLHRGWQSLQRWRIQIFVITWLAYAAFYFTRKAFSVAKLGIAEDPSFELDKSAMADLDALYLAAYAVGQFMWGVFADRFGTRVVVLGGLLTSALAALMMGTFATLPIFAACMVVQGLAQSTGWSGLCKNIGAFFATYERGRVLGLWSTCYAFGGLVATPFAGWCAYRLTHDWRMAFLSSAGVVLAVAVLFFFLQRNRPQDVGLPPVEAEAAPPANAPRPSHSGALLKALRNPHVLVLGIAYFLLKPARYAILLWGPVIIYERMPEIGKVASAIVPSAFEVAGLAGPILIGLASDKLFGARRMPACVLSLAALTLSLALFVPAMQSGSLYLVVSLLFMMGVTLYGPDSMISGAAAIDFGTSEAAGTATGFVNGCGSVGAILGGLLPGYFDTLTVFFVFTATALLASLLLVPFWNSRPGACRVEPKAHASGPLLAAGKPR

SEQ ID NO: 55730 - DNA, 1371 bp, Pseudomonas aeruginosa PAO1
  CDS (1)..(1371): transl_table=11
atgaatcaacgtcccgggacggcgctgccgtcctctcccgtgtccagcttccagcgctggcgcctgcagatattcgcgatcacctggctggcctacgccgccttctatttcacccgcaaggccttttccgtcgccaagctcggcatcgccgaagatccgggcttccagttggacaagatggcgatggccgatctcgacgccatctacctcgccgcctatgccgtcggccagttcacctggggcgtgctggccgaccgcttcggcccgcgcatcgtggtgttcggcggcctgctgatctccgcactggccgcgctggtcatgggcaccttcgccaccctgccgatcttcgccacttgcatggtggtccagggactggcgcagtccaccggctggtcggggctgtgcaagaacatcggcagtttcttcgccacccacgaacgcggtcgggtgctcggcctgtggagcacctgctacgccttcggcggcctggtcgcctcgccgttcgccggctggtgggcgtacagcgtgttcggtacctggcacgcggcgttctacttcagcgccgcggtggtcggcggcgtggccctgctgttcctgttgttgcagcgcaaccgcccggaagacgtcggccatcctcccgtcgaaccgcaggccgcgagcgaagccgtgcgctatgccggcttcaggccggaaggcggcaacggcggcaacggcggcagcctgcaggtgctcgccaaggtggtgcgcaaccgcacggtgctctgcctcggcctggcctacttcctgctcaagccggcgcgctacgcgatcctcctgtggggaccggtgatcgtctacgaacgcatgccggcgctcggcaaggtcggcgcggcgatcgttcccaccgccttcgaggtagccggcctgctcggcccgatcctgatcggcttcgcctcggacaagctgttcggcgcacggcgcatgccggcctgcgtgatcagcctgctggcgctgaccgtctgcctggcgctgttcgtcccggcgatgaccaccggcagcattccgatagtggtcggcctgctgttcatgatgggactgaccctgtacggcccggactcgatgatctgcggctccgccgccatcgacttcggcaccagcgaggccgccggcaccgcctccggcttcgtcaatggctgcggttcggtgggcgcgatcctcggcggtctgttgcccggctatttcgacacctacacggtgttcatcggcttcaccatcgcagccctgatcgccaccgcggtgctcctcccgcactggaacagccggcccggcggcgcacgggaaagcctgcggaatatccccagcctggcggacttccgtcccatccgctcctga

SEQ ID NO: 55731 - protein, 456 aa, Pseudomonas aeruginosa PAO1
MNQRPGTALPSSPVSSFQRWRLQIFAITWLAYAAFYFTRKAFSVAKLGIAEDPGFQLDKMAMADLDAIYLAAYAVGQFTWGVLADRFGPRIVVFGGLLISALAALVMGTFATLPIFATCMVVQGLAQSTGWSGLCKNIGSFFATHERGRVLGLWSTCYAFGGLVASPFAGWWAYSVFGTWHAAFYFSAAVVGGVALLFLLLQRNRPEDVGHPPVEPQAASEAVRYAGFRPEGGNGGNGGSLQVLAKVVRNRTVLCLGLAYFLLKPARYAILLWGPVIVYERMPALGKVGAAIVPTAFEVAGLLGPILIGFASDKLFGARRMPACVISLLALTVCLALFVPAMTTGSIPIVVGLLFMMGLTLYGPDSMICGSAAIDFGTSEAAGTASGFVNGCGSVGAILGGLLPGYFDTYTVFIGFTIAALIATAVLLPHWNSRPGGARESLRNIPSLADFRPIRS

SEQ ID NO: 55732 - DNA, 1347 bp, Pseudomonas aeruginosa PAO1
  CDS (1)..(1347): transl_table=11
atgttcggaatctttcgtcccgcgccacaccaggcgccactgcccgatgccgaggtggacagcacctaccggcgcctgcgctggcagatcttcgccggtatcttcatcggctacgcgggttactacctgctgcgcaagaacttctccctggccatgccctacctcatcgaggacggctacagccgcggtcaactgggcgtcgcgatgtcggccatcgccatcgcctacggcctgtcgaaattcatcatgggcctggtctcggaccgttccaacccacgggtcttcctgccgttcggcctgttggtgtcggcggcggtgatgttcattttcggattcgcgcactgggctacctccagcgtcgccatcatgttcgtcctgctcttcatcaacggctgggcccagggcatgggctggccgccgagcggacggaccatggtccactggtggtcgcagaaggagcgcggcagcgtggtctcagtgtggaacgtcgcccacaatgtcggcggcggcctgatcggcccgctgttcctgctcggcctggcgctgttcggcgactggcgctcggccttctacgtgccggccatcgtcgccgtgggcgtagccgtgttcgcctatttcgccatgcgcgacaccccgcaatcctgcggcctgccgccgatcgagaagcataaggacgactaccccgaaggctacgacgaacaccacgagcgcgagctgtcgaccaaggagatcttcgtcacctacgtgctgcgcaacaagctgctctggtacatcgccctggccaacgtgttcgtctacctgctgcgctacggtgtgctcgactgggcgccgacctacctcaaggaggccaagcacttcaacgtcgacaagtcgtcctgggcgtacttcttctacgaatgggcggggattcccggcaccctgctctgcggctggctgtcggacaagctgttcaagggcaatcgcggcgccaccggcgtggtgttcatgatcctggtgaccgtcggcaccctgatctactggctgaacccggccggcaacccggcgatcgacatggccgcgctgatcatgatcggcttcctgatctacggcccggtgatgctgatcggcttgcaggccctggagctggcgccgaagaaagcggccggcaccgccgccggcttcaccggtctgttcggctacctcggcggctcggtggcggccaacgccctggtcggctacacggtggatcacttcggctgggacggtggcttcaagctgctgatcggcgcctgcctgctggccatcctgttcctctgcctgaccctgcgcaaacccgcggtccaggccgcgccgcagcaagccggctga

SEQ ID NO: 55733 - protein, 448 aa, Pseudomonas aeruginosa PAO1
MFGIFRPAPHQAPLPDAEVDSTYRRLRWQIFAGIFIGYAGYYLLRKNFSLAMPYLIEDGYSRGQLGVAMSAIAIAYGLSKFIMGLVSDRSNPRVFLPFGLLVSAAVMFIFGFAHWATSSVAIMFVLLFINGWAQGMGWPPSGRTMVHWWSQKERGSVVSVWNVAHNVGGGLIGPLFLLGLALFGDWRSAFYVPAIVAVGVAVFAYFAMRDTPQSCGLPPIEKHKDDYPEGYDEHHERELSTKEIFVTYVLRNKLLWYIALANVFVYLLRYGVLDWAPTYLKEAKHFNVDKSSWAYFFYEWAGIPGTLLCGWLSDKLFKGNRGATGVVFMILVTVGTLIYWLNPAGNPAIDMAALIMIGFLIYGPVMLIGLQALELAPKKAAGTAAGFTGLFGYLGGSVAANALVGYTVDHFGWDGGFKLLIGACLLAILFLCLTLRKPAVQAAPQQAG

SEQ ID NO: 55734 - DNA, 1302 bp, Lactococcus lactis subsp. lactis Il1403
  CDS (1)..(1302): transl_table=11
ttgtataaaatgtggcaaactcgagttttaatttcgacggcattcgtttatattggttattatattattcgattgatctttaccgttcaacaaaatgatatttccaaggcttatggtttttcgatgggacaaattgggacaattctctccatgtttgggattggctatggaatttcaaagcttattatgggaacattagctgaccgggccaatccaaaccgttatgtggcaacaggattgattgtgtcagcgattatcaatgcgctttatggaacaacccaaagttttgggatgatagtctttctgatgttgcttaactcggttatgcaaggtatgggagctgcggcttgtcagcgtttagtcggtttatggtttggccgaaaagcaaaaggttcgattatggcgcgtgggacagcattttcaatctggtcatcagctcataatgctggagctttcatgtgtgtggctgtcattaatttatctgctttctttttcggcgcttcgcttcaatggagtttttggacagcatcaattgtttcgattgtcattgctattatcgttttatttctgggttctgaccgtccaacgacgaaaggattaccgacaattgaagaatattctggcgacaaagtggtcattaaagacggagaaattgttgaaggcgatgtttctaatgacaatgtttttaaaatattttttgaatacattgtcaaaaataaactcgtgtgggcggtcattttgacctcattgtcaatctatgtcgttcgttatggaattatgagttggattccaaactatctggttaatatcaaaggatttgataattcaacagcaaaatggctgacaggaatttttgaacttgcagctgtacctggggttattatcatcggatttatcactgatttacttaaaggtcgtcgggccattatggttttggtttcattgattgcaatgcttgcctgtctgattacttattttgcagcgaccaatcatactttgattattattgtgttattaattatgggaactttcatttatgctccagcaacaattgtcgggctgatggtcaatgaagctgtcccaaaatttgccaatggaatgtcaacgggtacgatggggttctgtcagtacattattggtgaagtgacagcaactctggttattggttggcttgttcaagcatacggctggtcagcaggaaatatcattgtttatatttttgccggcattgccattcttgcttcaatttatatcttggttcatcaaaatcgattatataagaaaattgatgatgcaggctaa

SEQ ID NO: 55735 - protein, 433 aa, Lactococcus lactis subsp. lactis Il1403
MYKMWQTRVLISTAFVYIGYYIIRLIFTVQQNDISKAYGFSMGQIGTILSMFGIGYGISKLIMGTLADRANPNRYVATGLIVSAIINALYGTTQSFGMIVFLMLLNSVMQGMGAAACQRLVGLWFGRKAKGSIMARGTAFSIWSSAHNAGAFMCVAVINLSAFFFGASLQWSFWTASIVSIVIAIIVLFLGSDRPTTKGLPTIEEYSGDKVVIKDGEIVEGDVSNDNVFKIFFEYIVKNKLVWAVILTSLSIYVVRYGIMSWIPNYLVNIKGFDNSTAKWLTGIFELAAVPGVIIIGFITDLLKGRRAIMVLVSLIAMLACLITYFAATNHTLIIIVLLIMGTFIYAPATIVGLMVNEAVPKFANGMSTGTMGFCQYIIGEVTATLVIGWLVQAYGWSAGNIIVYIFAGIAILASIYILVHQNRLYKKIDDAG

SEQ ID NO: 55736 - DNA, 1392 bp, Escherichia coli O157:H7 EDL933
  CDS (1)..(1392): n means a or g or c or t/u, s means g or c
atgctggctttcttaaaccaggtccgcaagccgaccctggaccttccgctcgaagtgcggcgcaaaatgtggttcaaaccgttcatgcaatcctacctggtggtctttatcggctacctgacgatgtacctgattcgcaagaactttaacatcgcgcagaacgatatgatttcgacctacgggttgagcatgacgcagctggggatgatcggcctgggtttctccatcacttatggcgtgggtaaaacgctggtttcctactacgccgacggcaaaaacaccaaacaattcctgccgttcatgctgatcctgtctgccatttgtatgctgggctttagcgccagtatgggcagcggctcggttagcctgttcctgatgattgccttctacgccttaagtggctttttccagagtaccgggggttcgtgcagttactccaccatcaccaaatggacgccgcgtsgtaaacgcgggacgttcctcggtttctggaacatttctcacaaccttggcggtgcaggcgcagctggtgtggcactgttcggcgcaaattacctgttcgatggccatgtcatcggcatgtttatcttcccgtcgattatcgcgctgattgtcggttttatcggcctgcgttacggcagcgactccccggaatcttatggcctcggcaaagctgaagagctgttcggcgaggagatcagcgaagaggacaaagagacagaatctaccgatatgaccaagtggcagatctttgttgagtatgtgctgaaaaacaaagtgatctggctgctgtgcttcgccaacattttcctctatgtggtgcgtattggtatcgaccagtggtcaactgtgtacgcgttccaggaactgaaactctctaaagcggtggcgattcagggctttacgctgtttgaagctggtgcgctggtcggtacgctgctgtggggctggctctctgacctagcgaacggtcgccgtggcctggtggcctgcatcgcgctggcgctgattatcgccacgctcggtgtgtaccaacatgccagcaacgaatatatctatctggcttctctctttgcgttgggtttcctggtctttggcccgcaattgttgattggtgtggctgctgttggctttgtacctaaaaaagcgattggcgctgccgatggtattaaaggcaccttcgcttacctgattggtgacagctttgccaagttaggtctgggaatgattgccgatgggacgccagtattcggccttaccggctgggcaggcaccttcgctgcgctggatatcgccgcgattggttgtatctgcctgatggcgatagtggcggtgatggaagaacgcaaaatccgccgcgagaaaaaaattcagcagttgacagtggcataa

SEQ ID NO: 55737 - protein, 463 aa, Escherichia coli O157:H7 EDL933
  Xaa in position 155 is unknown
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRXKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 55738 - DNA, 1296 bp, Rickettsia conorii str. Malish 7
  CDS (1)..(1296): transl_table=11
atgacaaatacaagatccaaaattaaaactccaagatcgccatatgtaaaaaaatataatagttggcgagtaaggattttgtattctattattataggttacgcaactttttatttttgtcgtcagaattttaatatagcaactcctgctataagagaatattttggggttactaaaacgcaaattggctggatattaactgcttcatctattatgtatggagttagtaaagcgtgtaacgggtttattagcgataaagttaatgctcggatatttatggttttgggtcttttatttgtcgggatcattactatgctaataggtttttcagattctttatggcttataggaattttatggatagccagtaactggtttcaatctatgggctggcctcctgcaacaaagatgcttactcactggttcgcttcaaaagaacttggaactaaatgggctatgggtgcaacttctaatcaaataggtggtgcccttgctatgataagctgcggttatttaatcgataaatttgattggagagctgccttttttgttccaggtgtagttgcttgtgtagtatcgctttttttatataataggcttcgtaattctccaaaagaagtaggtttatctaccgtagaggaatataaagaatatccgcttgaagctataggagattatgaaaagctattaactccacaattacttaaaatggtcttttgtaataagctaatatggtatgtttgtttagcaaacatgtttgtttatataatacgttccggagtaatttattgggctccaacatttttaaaagatttacgtaatataagtcttgcaaatgcaggcttacaaatcggtttatatgaaatgataggtatcccaggggcattaatagcaggtgtgttatctgataaactatttcaaggtcgtcgaggtcctgttgcatccatatgtatggtattgcttagcttattgttagtcttgttttggaaacttcctattcacagtgaattattaagtatagtaattctttctttaataggcttttttgtttcaggacctcagctccttgtaggtatagcagctgctgattttagtacccgtcaggctgtcggtacggctaatggattatcagggttatttggttatttaggagcggctattgcgggagtcggcgtaggatggattagcgataattatggttggaatggggtatttatatttttcagtatttctgctcttttaggaggaggattatttgctttaatatggaatcgttcagctaaaaaatacatttaa

SEQ ID NO: 55739 - protein, 431 aa, Rickettsia conorii str. Malish 7
MTNTRSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWLIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLLKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 55740 - DNA, 657 bp, Staphylococcus aureus subsp. aureus Mu50
  CDS (1)..(657): transl_table=11
atgacgaaatgggagatctttaaaaaatatatcctgggaaatcctgttatatggattctatgtgtttcaaacgtctttgtatacattgtacgaatcggtattgataactgggcaccgttatatgtgtcagagcatttacactttagtaaaggcgatgcagttaatacgatattctactttgaaattggtgcattagttgcaagtttattatggggctacgtatcagacttattaaaaggtcgtcgtgcaattgtagctattggctgtatgtttatgattacatttgttgtcttattctacacaaatgctacaagtgtcatgatggttaacatttcattgtttgcattaggtgcgttaatctttggtccgcaattattaattggtgtatcattgactggttttgttcctaaaaatgccatcagtgtagcaaacggaatgacaggttcattcgcgtatctattcggtgactcaatggcgaaagttggtttggcggctattgctgatccaacacgtaacggtttaaacatctttggatatacattaagtggatggacagatgttttcatcgtcttctatgttgcattattcctaggcatgattctattaggaatcgttgctttctatgaagaaaagaaaattagaagtttaaaaatttaa

SEQ ID NO: 55741 - protein, 218 aa, Staphylococcus aureus subsp. aureus Mu50
MTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSLKI

SEQ ID NO: 55742 - DNA, 1065 bp, Staphylococcus aureus subsp. aureus Mu50
  CDS (1)..(1065): transl_table=11
atgaattttcttaaacctgcaaagcatattaagcctttgccagaaaatcagatagatgatacctataaacgattacgtctccaagtatttcttggtattttcatcggttacgctgggtactatttattacgtaaaaacttttcattagcgatgccagcattgcaagagcaaggttttacaaaagcggaactaggttttgcactttctgctgtttccatcgcatatggatttagtaagttctttatgggtactgtaagtgatcggagcaatgctcggatattcttagttcttggattagcactcactgctatcgtcaatttgttaatgggatttgtaccgttctttacatcaggtatcggtattatgtttgtcctattattcttaaatggatggtttcaaggtatgggctggccaccttcaggccgtgttctcgttcactggtttagtgtaagtgaacgcggaagtaagactgccctttggaacgttgcgcataatgttggtggaggtattatggcacctattgctgcttggggtattacaacaacagcatttatcaactttggttatttaaaaggtttcgaaggtgtattcatttaccctgcactcttagcacttatcattgccgcaatttcatacgtattgattagagacacacctcaatctcaaggtttacctccaatcgaaatttataaaaacgactttgctacaagcgataagaaaacattagaaacagaattaactacaaaagaaattttatttaaatatgtactgaacaataaatgggtatgggcaattgcctttgcaaatatatttgtttatttcgtgcgttatggtgtacttgattgggcgccagtctacttaagtgaagaaaaacatttcgacttaaaagcatcaggttgggcatacttcttatacgaatgggctggaattcctggtacattattatgtggttacatttctgataaattattcaaaggtcgtcgtggacctgcaggtttcttctttatgttaggtgtcacagtatttgtattaatttattggttaaatcctccaggcaatgcttag

SEQ ID NO: 55743 - protein, 354 aa, Staphylococcus aureus subsp. aureus Mu50
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLALTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYVLIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNA

SEQ ID NO: 55744 - DNA, 1332 bp, Yersinia pestis CO92
  CDS (1)..(1332): transl_table=11
atgtggtttttcctcaaaagtcgcgataacgtaccgctagtaacggatcaaacacaaattgattcatcctataagtattggcgtatccaattaatgtggacgatgtatatcggctacgctgcgttttatttcactcgtaaaagtttcaattttattatgcctgctatgctcacggatctagggctgagcatgtctgatgtcgggattttaggcacgctgttttacatcacttacggctgctctaaatttgtctctgggatgatcagcgatcgctcaaatccgcgttattttatggggatcgggttggtcatgacggggattattaatatcctgtttggcatgagctcatcacttttggtccttggcgccttgtggatcctcaatgcgttcttccaaggttggggctggccaccatgttctaaaatattgaccagttggtactcgcgttctgaacgtggtggctggtgggctatctggaacacctcacataactttggcggggcgctgatccccttgctcgtcggggtgattactctgcactttagctggcgctacgggatgatcatccccggaattataggtgtggtgattggtttgctgatgtgttggcgtctgcgagataagccaagcaccatgggcctaccaagtgtgggtaaatggcgcaatgatgcgatggagctgatccaggaatccgaaggccaggggctgtctaataaagaaattgtgaagcgttatgtcttaaccaataaatatatttggttgttagccgtttcctatgtgctggtttatatcgttcgaaccgcgattaacgactggggtaacctctatctgacccaagagaaaggttattcgttgctgaccgctaactctgcaatttcattatttgaagtgggtggatttattggttcattggtcgcgggttggggttctgataagtggttccgtggcaatcgtgggccgatgaacctgatttttgctattggtatcttcctctcagttgcatcactgtggacgttgccaagcatcagttttgtcttacaggcaggctgcttctttgcgattggtttctttattttcgggccacaaatgctgattggtatggctgctgctgagtgctctcataaggatgccgctggcgctgcaaccggctttgttgggctatttgcctatttaggggcggctttatcgggttaccctatcgctcgcgtcatggaaatctggcattggaatggtttctttgtggttatctctgtggcggcatgtttatctgctttcttcttattgccattcctgcgggcgcaatcgccgcagttaaagcaagcgacaacctga

SEQ ID NO: 55745 - protein, 443 aa, Yersinia pestis CO92
MWFFLKSRDNVPLVTDQTQIDSSYKYWRIQLMWTMYIGYAAFYFTRKSFNFIMPAMLTDLGLSMSDVGILGTLFYITYGCSKFVSGMISDRSNPRYFMGIGLVMTGIINILFGMSSSLLVLGALWILNAFFQGWGWPPCSKILTSWYSRSERGGWWAIWNTSHNFGGALIPLLVGVITLHFSWRYGMIIPGIIGVVIGLLMCWRLRDKPSTMGLPSVGKWRNDAMELIQESEGQGLSNKEIVKRYVLTNKYIWLLAVSYVLVYIVRTAINDWGNLYLTQEKGYSLLTANSAISLFEVGGFIGSLVAGWGSDKWFRGNRGPMNLIFAIGIFLSVASLWTLPSISFVLQAGCFFAIGFFIFGPQMLIGMAAAECSHKDAAGAATGFVGLFAYLGAALSGYPIARVMEIWHWNGFFVVISVAACLSAFFLLPFLRAQSPQLKQATT

SEQ ID NO: 55746 - DNA, 1323 bp, Escherichia coli K12
  CDS (1)..(1323): transl_table=11
atgatgttgccgtttctgaaagcgcctgccgatgcgccattaatgactgataaatatgaaattgatgcccgctatcgctactggcgtcggcatattctgctgaccatctggctgggttacgcgctgttttacttcacgcggaaaagttttaacgccgccgtaccagaaatccttgctaacggcgtgctcagccgtagcgatatcggcctgttagcgaccctgttttacattacctatggcgtgtcgaagtttgtctccggcattgtcagcgatcgctcaaatgcccgttattttatggggatagggcttatcgccacgggcattatcaacattctgtttggcttctcgacgtcgctatgggcgtttgccgtgctctgggtgctgaacgcctttttccagggctggggttcaccggtgtgtgcgcgtctgttaacggcctggtattcacgtaccgagcgcggcggttggtgggcattatggaacacggcgcataacgtcggcggcgcactcattcccattgtgatggcagcggctgcgctgcattacggctggcgtgccgggatgatgattgctggttgtatggcgatagtcgtggggatttttctctgctggcggctacgcgatcgcccgcaggcgttaggtttaccggcggtcggtgaatggcgacacgacgcgctggaaattgctcaacaacaagaaggggcagggttgacgcgtaaagagatcctcaccaaatatgtgttgctgaatccgtatatctggctgctttcgttttgctatgtgctggtctatgtggtccgggcggcgatcaacgactggggcaatttgtatatgtccgagacactgggcgtcgatctggtcacggcgaatacggcagtgacgatgtttgaactgggcggatttatcggtgcgctggtagccggttggggctcggacaaattgtttaacggcaaccgagggccgatgaatttgattttcgccgccggaattttgctttcagtcggctccctgtggctgatgccatttgccagctacgtgatgcaggcaacctgcttcttcaccattggtttttttgtctttggcccacagatgttaatcggtatggcggcggcagagtgttcccacaaagaggcggcaggggcggcgacggggtttgtcggcttgtttgcttatctgggggcgtcgcttgctggttggccgctggcgaaagtactcgatacctggcactggagcggattttttgtggttatctctatcgccgccgggatttccgcactgctgttactgccctttttgaacgcccagacaccgcgcgaagcgtga

SEQ ID NO: 55747 - protein, 440 aa, Escherichia coli K12
MMLPFLKAPADAPLMTDKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 55748 - DNA, 1323 bp, Salmonella typhimurium LT2
  CDS (1)..(1323): transl_table=11
atgagtataaaaacatttattttcagccagcccgataagccgattgtaaaagagaaaaaagagatagaccagacctataaaaaatttcgttttgagattatcgcctcggtctttatctcttatgccgtcttttatcttacccgtaaaaacttctccgccgcgatgccggccatgctgacggaaacgtcgctgaccgcagaagacttcgccattatgtcttctattttttacattctttatggcgcgatgaagtttgtcggcgggatgctggtcgataaaattaacccgaaagccatgaccggcccggtgctgattggcgtggggattgtaaatattctgttcggcttttccgacagcgtggcggcattctacgtgctgtacagtctcaacgcgatattacagggcaccagctttccgccgatggcgaaaattatggcctcgtggttttcgaaaaacgaacggggacgctggtgggctatcgttgaagcggcgcacaatatcggcggcagcctcgcgccgctgctgaccagttttgctatcgcctttagcggtagctggaaaatgggattttatgttcccggcgccatttcgctgctgatggggatagtggcgctatttaccattaaagatcgtcccggtacgttaggtttgcccaacgtggggcagtggcgtaacgacccgacggaactggcccaggtcaaggccagcccggtcaacctgagcttctggcagatttttgtgaaatatatcctgaccaatccactggtatggatcattattatcggtgatatgtcggtttatattgcgcgcactatccttaacgactggccgcagatttactattcgcaggttcacggctggagcctgataaaagcgaactcgattatttcctggtttgaggcgggcggactggcaggtgggttgctggcaggctacttgtctgactttatgttcaaaagtaaccgctggatgaccggattaatcttcgcgttagcgctgtgcatatgcatcgtgctggtgccgctggttcaggatacctcttacaccctcaccgcgattctgttcaccatcatgggcttcgccttatacggaccgcatatgctttttgccgtcggctgtctggatgtgacccataaggatgcggcgggatcgattaccggctttcggggattgttcagctatgtcggcgcggcaatggccggtgtgccggtaattatggtgaaaaatagctgggcgtggtcgggcgtttatatctatgcggtgatcgccattctgctaacgactctgtcgctggcgctgctctccaggctgcatcggttataa

SEQ ID NO: 55749 - protein, 440 aa, Salmonella typhimurium LT2
MSIKTFIFSQPDKPIVKEKKEIDQTYKKFRFEIIASVFISYAVFYLTRKNFSAAMPAMLTETSLTAEDFAIMSSIFYILYGAMKFVGGMLVDKINPKAMTGPVLIGVGIVNILFGFSDSVAAFYVLYSLNAILQGTSFPPMAKIMASWFSKNERGRWWAIVEAAHNIGGSLAPLLTSFAIAFSGSWKMGFYVPGAISLLMGIVALFTIKDRPGTLGLPNVGQWRNDPTELAQVKASPVNLSFWQIFVKYILTNPLVWIIIIGDMSVYIARTILNDWPQIYYSQVHGWSLIKANSIISWFEAGGLAGGLLAGYLSDFMFKSNRWMTGLIFALALCICIVLVPLVQDTSYTLTAILFTIMGFALYGPHMLFAVGCLDVTHKDAAGSITGFRGLFSYVGAAMAGVPVIMVKNSWAWSGVYIYAVIAILLTTLSLALLSRLHRL

SEQ ID NO: 55750 - DNA, 1386 bp, Listeria monocytogenes EGD-e
  CDS (1)..(1386): transl_table=11
atgtcattattcagtttgaaaaaaaagaaccattttgttccactagaaattcaaagacaacaatggttcaaacactttatcgttgcatttatgtctgtatttatttgttatctaacggtctatcttctaaggaataactttaaagcagctcagacattgttaattgagcagaaccatttcagcaccacagaactaggaatgattggtttagctttttcggttatgtacggaattggaaaaacgattttaggatatgtcgtggatggaagaaatgctaaaaaaataatgagttttttattagggatttccgccattatatcaattattattggaatacttttagttgcaaagcaagcaacagtgggtatattgtttatcctttggggagcaaatggatttgtgcaatcaccaggtggaccggcttcctattcaactatcacacggtggacgccaaaattgaaaagaggaagatggttaggtttttggaatgcctcgcataatataggtggtgctttagcgggaattgttgctttttggggtgcgactactttctttaatggcggcgcagggggaatgtttatcgttccaggtatcattgcaatcatcattgcaattatttgcttctcggtggggcatgatgaaccagaagaattaggctggaactctgccgctgaaatttttgaagagcgggaagaacaaggagaatcggagacaaaagacctttctagatttcaaattttgtgtcgatttgttattaataatccttgggtatggactttatgtgtcataaatatattcatctatattgttagaattggtattgataattgggcgcccgtttattgtattcaagcgctaggatggagcacaaaagatgctattatgactatttctttttttgaaattggagcattgctaggttcattatcgtggggctggctctcagatattatgaaaggtcgccgtatgctttgctcgattattgcagttgttattgaatttttcatgttaattagctattcgcaagttacaagtgtttatagcatgtatacggtattatttattttaggattcttagtatttggcccccaacttttaattggagtgtcggtgatagagtttgttcctagaaatgctttagctgtaacaaatggcttaactggaacgtttgcgtacttattcggagattcttttgctaaagtctttctaggatatattgcagacccaacaaaagcgggtatgcaaatatttggctataatttacatggctggggcgcaacttttactattatgtttacagctttaattattgcaggcttaatgatgattccagttgcattaaaacaagagaaaattatacgacaagcaaaagttttacatctataa

SEQ ID NO: 55751 - protein, 461 aa, Listeria monocytogenes EGD-e
MSLFSLKKKNHFVPLEIQRQQWFKHFIVAFMSVFICYLTVYLLRNNFKAAQTLLIEQNHFSTTELGMIGLAFSVMYGIGKTILGYVVDGRNAKKIMSFLLGISAIISIIIGILLVAKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 55752 - DNA, 1317 bp, Caenorhabditis elegans
  CDS (1)..(1317)
atgcctcgaatacggccgcgcagtggaaatgaagacttcctaacaagaatcactggggaaacatggaccagaaaccaatatatagtttttattcatacatttttcagctttgccatgatccatgcaacaagaaaaacgcttgccacagtaaaaccttcaattattcacacttggaccagtaactcgacaggaactccatttatggaatccgaagaacatgctaccagattcctaggagttttggatacaagtttcatgataacttatgcaattggtttattcgtaagcggaactcttggagatcattacaatcccagaaaaatgttgagttttggaatggcaatgtctgcgatttcagttttctgttttggttttctaacagaaaaatatcatttttattctgcacccctgtacattttcctatggatttgcaatggattctcacaatctgttggatggccaattgaagttgcaattatgggaaattggtttggaaaagacgcacgaggtactgtaatgggaatatggtccgcgtgtggaagtactggaaatatcattggaacattgatagctagtcatgcattgtccctaggatacgagtacccattccttataatctgttcgttgcttcttggatacagtatgattgtttactggcagttaccttcagctccttgggatatagatcacagcttcccacatgattcggaaaataaagaaaaacaagagcttcttccaaacagacctccggctttaggatttttcaaaacttggctaattccaggagtgatctccttttctctggcatttgcctgcctcaaatttgtaaacgacgggtttttcttctggctgccctactatctacatgacggtctcaactggccagagacatttgcagatgctttatcgacatggtatgatgtaggaggaatccttgcatcagtggtagcaggagctgcatctgacagaatgaaatcaagaacctcattaattttctacatgctcatcgcgtcgtttgtgtcgttgtatatttattcacaatccccagcttcttactcttggaatgctttcctacttcttgtaactggattttgtgttggcgggccacttaacatgatatccagttcagtagtggcagatcttggtaaaagtgacaagttgaaaggaaatgcagaagcacttgcgacagttactggaataattgatggaacaggaagttgtggatctgcgattggacaatttatgattccaaaccttcaacattggtatggatggaactcggtgttttatggatttatggctatggtaggcaattga

SEQ ID NO: 55753 - protein, 438 aa, Caenorhabditis elegans
MPRIRPRSGNEDFLTRITGETWTRNQYIVFIHTFFSFAMIHATRKTLATVKPSIIHTWTSNSTGTPFMESEEHATRFLGVLDTSFMITYAIGLFVSGTLGDHYNPRKMLSFGMAMSAISVFCFGFLTEKYHFYSAPLYIFLWICNGFSQSVGWPIEVAIMGNWFGKDARGTVMGIWSACGSTGNIIGTLIASHALSLGYEYPFLIICSLLLGYSMIVYWQLPSAPWDIDHSFPHDSENKEKQELLPNRPPALGFFKTWLIPGVISFSLAFACLKFVNDGFFFWLPYYLHDGLNWPETFADALSTWYDVGGILASVVAGAASDRMKSRTSLIFYMLIASFVSLYIYSQSPASYSWNAFLLLVTGFCVGGPLNMISSSVVADLGKSDKLKGNAEALATVTGIIDGTGSCGSAIGQFMIPNLQHWYGWNSVFYGFMAMVGN

SEQ ID NO: 55754 - DNA, 1509 bp, Caenorhabditis elegans
  CDS (1)..(1509)
atgctagttacgggtggtcatatgccgagaatcagactcaggaacgatgtaagctccagcagtttttggacgagaataactggtcaaaaatggagcaagcatcatgtttttatatttgtacatacttttatgagttatgcaatgcttcatgccactcggaaaacattgtctactgttaaaccatcacttattcacacatggatctcaaatacttcaacacccgatggtccagtatttccatctcaacaagctgcagctgaattcttaggtgttctggatacaggattcttggttgcatatgcaattggtctgtacatatgtggaatacttggagacaactacaatcctcgtcgccttctaacagctggaatgatgctttcttcaattattgtattctgttttggatatctaactgaaacttttcatttctactctccgatggtctactcgtttttatggattttgaatgggtttattcaatccgtcgggtggcctgttgaagtctctattatgggcaattggtttggacataatgctcgtggagcagttatgggagcttggtcatcgtgtgcaagcgttggaaacataattggaacattgatagctagttacactctttttctgggatatcagtactcattcctgattgcatgctcccttttattcatctacagttttcttgtattctttcaacttccatcagctccatgggaagtgagtagtgatattctaccagaacaaatggaagaggaagagactgatgatgagcctacagaaagaccaccaccaattggattcttgaaagcttggttacttccaggtgttattgcatattcactggcttatgcgtgtctgaagcttgttaattacggtttcttcttctggttgccatactaccttcatgctggcttgcactggcccgaatcctacgccgactcactttccacgtggtatgatgttggaggaatcgtggctgctgtgctcgccggagccttttcggatcacatgagatctcgaaccccagttgtgtttattatgctgttaatggcaactgtttcactttatatttatgcacattcccccgaatcctacaactggaatgcattcctcttactcgtcgccggatttttcatcggaggaccggccaacatgatctcaagctcaattacggcagatctcggaaaatgtgatcaacttcgtggaaacgcggaagctctttccacagtgacgggaattattgatggaactggaagtattggagctgcaattggacaatggtttattccatcggttcagcattggtttgggtgggatgcggtgttttatggatttattgtcatgatactctgcaccgccctttgcttggtcccagttctttggaaagagcacaaagagcgcagaattcatcgttccgaagaggtagattcactgttacagagtgattccgatgaaaatttagcagatgatattcaggaaattagacgaaggcctactaatgcaattgtataa

SEQ ID NO: 55755 - protein, 502 aa, Caenorhabditis elegans
MLVTGGHMPRIRLRNDVSSSSFWTRITGQKWSKHHVFIFVHTFMSYAMLHATRKTLSTVKPSLIHTWISNTSTPDGPVFPSQQAAAEFLGVLDTGFLVAYAIGLYICGILGDNYNPRRLLTAGMMLSSIIVFCFGYLTETFHFYSPMVYSFLWILNGFIQSVGWPVEVSIMGNWFGHNARGAVMGAWSSCASVGNIIGTLIASYTLFLGYQYSFLIACSLLFIYSFLVFFQLPSAPWEVSSDILPEQMEEEETDDEPTERPPPIGFLKAWLLPGVIAYSLAYACLKLVNYGFFFWLPYYLHAGLHWPESYADSLSTWYDVGGIVAAVLAGAFSDHMRSRTPVVFIMLLMATVSLYIYAHSPESYNWNAFLLLVAGFFIGGPANMISSSITADLGKCDQLRGNAEALSTVTGIIDGTGSIGAAIGQWFIPSVQHWFGWDAVFYGFIVMILCTALCLVPVLWKEHKERRIHRSEEVDSLLQSDSDENLADDIQEIRRRPTNAIV

SEQ ID NO: 55756 - DNA, 1371 bp, Caenorhabditis elegans
  CDS (1)..(1371)
atggtacagacgatgtcgtcacggaaggtgatggtgttcgtggtgacgtttgtcagttacggcctgtaccacgcgagtcgcaaagcattatccggagtgaaatcgtcgataaaagcggattggctgagcaactcgtccggccacgcgccactattcaccaatgaagccgacgccaagcactttttgggatcactcgacgcgattttcatggcggcctacgcggcggctctcttcttttggggttggctcggcgatcggctgaatccgaagcttgtcgtcgcagctggaatggttggctctgcggttacgctcactctcttcggcgccatcccaaaatggttcaatttctaccatgcgccctactatatcatgacctacgtggcgtttgggcttgttcaggcctgcggatggcccagtgaaatcgcgattatggccaactggttcggaaaaggaaatcgcggatttgtgatgggtgtctgggccgcgtgtcagcccgtcggcaacattttcggatcgattttcacggcgatggtgcttccactaggttatcagtacacttttgtgttcaattcggtgctcattgctctcggagcaattgtagtcgtcatggctattgattcatcgcctaatgaagagcatgaggatggcgtagaggcaaatagctccgagccccatcacaacttccacggtgagccaatatccctcttcaaggccgttcttctgccaggcgtgctcgcctactgcatctgcaatgcctgcctgaaactcgtcaactacgccttctttttctggcttccactctacttgaccgatgcctatcactgggaagagtcgcaggcggatcagttgagcatttggtacgattttggaggcattattggaagtgtgctcggcggatacattactgacaagatgggaaaacgatctccgctcatcgtcgcgatgctcgtgtgctccattggctcgctgtacttttacgctcacgtcgggccgcacatgttctggaatgcggtcgtcatgaccaccgtcggagttacagtctctgggccgtacaacttgatcgttgggtccatctcaatcgatctaggatcacaacctgctctagctgggaacacacaggcgatgtccacggtgtcgggattgttggatggcactggatcggcaggatccgctgttggacagcttctcattccgatcatccaggacgacctgggatggaaggctgtgttctatgtgttcatgctattgaacggattcgccatcctagccatcctcaagcgctgcatcatcgatctgaaatcgcttcgaaagctccgcagtggagaagaatctccgcttctcaatgacgaagccggtgatcacgaggactga

SEQ ID NO: 55757 - protein, 456 aa, Caenorhabditis elegans
MVQTMSSRKVMVFVVTFVSYGLYHASRKALSGVKSSIKADWLSNSSGHAPLFTNEADAKHFLGSLDAIFMAAYAAALFFWGWLGDRLNPKLVVAAGMVGSAVTLTLFGAIPKWFNFYHAPYYIMTYVAFGLVQACGWPSEIAIMANWFGKGNRGFVMGVWAACQPVGNIFGSIFTAMVLPLGYQYTFVFNSVLIALGAIVVVMAIDSSPNEEHEDGVEANSSEPHHNFHGEPISLFKAVLLPGVLAYCICNACLKLVNYAFFFWLPLYLTDAYHWEESQADQLSIWYDFGGIIGSVLGGYITDKMGKRSPLIVAMLVCSIGSLYFYAHVGPHMFWNAVVMTTVGVTVSGPYNLIVGSISIDLGSQPALAGNTQAMSTVSGLLDGTGSAGSAVGQLLIPIIQDDLGWKAVFYVFMLLNGFAILAILKRCIIDLKSLRKLRSGEESPLLNDEAGDHED

SEQ ID NO: 55758 - DNA, 1164 bp, Caenorhabditis elegans
  CDS (1)..(1164)
atggcggcctacgcggcggctctcttcttttggggttggctcggcgatcggctgaatccgaagcttgtcgtcgcagctggaatggttggctctgcggttacgctcactctcttcggcgccatcccaaaatggttcaatttctaccatgcgccctactatatcatgacctacgtggcgtttgggcttgttcaggcctgcggatggcccagtgaaatcgcgattatggccaactggttcggaaaaggaaatcgcggatttgtgatgggtgtctgggccgcgtgtcagcccgtcggcaacattttcggatcgattttcacggcgatggtgcttccactaggttatcagtacacttttgtgttcaattcggtgctcattgctctcggagcaattgtagtcgtcatggctattgattcatcgcctaatgaagagcatgaggatggcgtagaggcaaatagctccgagccccatcacaacttccacggtgagccaatatccctcttcaaggccgttcttctgccaggcgtgctcgcctactgcatctgcaatgcctgcctgaaactcgtcaactacgccttctttttctggcttccactctacttgaccgatgcctatcactgggaagagtcgcaggcggatcagttgagcatttggtacgattttggaggcattattggaagtgtgctcggcggatacattactgacaagatgggaaaacgatctccgctcatcgtcgcgatgctcgtgtgctccattggctcgctgtacttttacgctcacgtcgggccgcacatgttctggaatgcggtcgtcatgaccaccgtcggagttacagtctctgggccgtacaacttgatcgttgggtccatctcaatcgatctaggatcacaacctgctctagctgggaacacacaggcgatgtccacggtgtcgggattgttggatggcactggatcggcaggatccgctgttggacagcttctcattccgatcatccaggacgacctgggatggaaggctgtgttctatgtgttcatgctattgaacggattcgccatcctagccatcctcaagcgctgcatcatcgatctgaaatcgcttcgaaagctccgcagtggagaagaatctccgcttctcaatgacgaagccggtgatcacgaggactga

SEQ ID NO: 55759 - protein, 387 aa, Caenorhabditis elegans
MAAYAAALFFWGWLGDRLNPKLVVAAGMVGSAVTLTLFGAIPKWFNFYHAPYYIMTYVAFGLVQACGWPSEIAIMANWFGKGNRGFVMGVWAACQPVGNIFGSIFTAMVLPLGYQYTFVFNSVLIALGAIVVVMAIDSSPNEEHEDGVEANSSEPHHNFHGEPISLFKAVLLPGVLAYCICNACLKLVNYAFFFWLPLYLTDAYHWEESQADQLSIWYDFGGIIGSVLGGYITDKMGKRSPLIVAMLVCSIGSLYFYAHVGPHMFWNAVVMTTVGVTVSGPYNLIVGSISIDLGSQPALAGNTQAMSTVSGLLDGTGSAGSAVGQLLIPIIQDDLGWKAVFYVFMLLNGFAILAILKRCIIDLKSLRKLRSGEESPLLNDEAGDHED

SEQ ID NO: 55760 - DNA, 1338 bp, Clostridium perfringens str. 13
  CDS (1)..(1338): transl_table=11
atgtttggattttttagcccagctccagcaatacctagacttccaaaagataaggtatcatcagcatacaaagcatatcgtattcgtatgttccttatgatatttattggatatacaggttactacttagttagaaaaaactttgctgtagcatcaccatatttaattgataactatggattttcaaaaacacaaatcggacttataagtatgggacttgctgtatcttacggtttaagtaagttcattttaggaaatttatcagacaaatcaaatgtaaagaaatttatatgttttggacttattgcatcatcagtattaagtgttctaatgggatttgctcgtacagttccaatattcttaatacttatggtatttaacggattcttccaaggtatgggagctccaccatgttcaatagtattaggtaaatggttctctcaaaaagaaagaggacttaaaatgggaatatggaatacttctcataatataggtggaggtttaatcgcccctatagcaactttatgtttattagtatttggacaaaatcatttccaatcaatattctttgtaccagcaataatatgtacaatagtagctttattctgttatgtaattggagctgacactccagcatctgttggattacctccagttgaagaatatagaaatgattatcctgaagttaaggctgaggttaatccaacaactttatcttcaaaagaaataatggttaaatatgttcttaaaaataaatatgtttggtacttagcactagctaatatctttgtttatttaataagacaaggtgttgttaactggattcctatatacttaaaagaatcaaaaggattctctgctgctaatgcaaactgggcaatgttcttatttgaatatgctgcaataccagcatcaatattacttggatggctttcagacgttgtattcaaaggaaagcgtgctccacttagtatcttatgtatgatcggtgttatatttgctacagtagcttactggcaaacaagcagtacattagtaacaatgatttctgttgcatttataggatgcttcatatacggacctcaattattaataggaatgaacttaatagacgttgtacctaacttcgctgttggttctgctacaggtttctcaggactttgcggataccttcttggtgaattcatggctgacttcgttttaggtatgatagctgatagctttggatggaacggtgcattcatatttatcatagtaggtgcattcattgcattacttcttttagctttaactttaaagataaagaaaaatccacaagttgaagataagatagcttaa

SEQ ID NO: 55761 - protein, 445 aa, Clostridium perfringens str. 13
MFGFFSPAPAIPRLPKDKVSSAYKAYRIRMFLMIFIGYTGYYLVRKNFAVASPYLIDNYGFSKTQIGLISMGLAVSYGLSKFILGNLSDKSNVKKFICFGLIASSVLSVLMGFARTVPIFLILMVFNGFFQGMGAPPCSIVLGKWFSQKERGLKMGIWNTSHNIGGGLIAPIATLCLLVFGQNHFQSIFFVPAIICTIVALFCYVIGADTPASVGLPPVEEYRNDYPEVKAEVNPTTLSSKEIMVKYVLKNKYVWYLALANIFVYLIRQGVVNWIPIYLKESKGFSAANANWAMFLFEYAAIPASILLGWLSDVVFKGKRAPLSILCMIGVIFATVAYWQTSSTLVTMISVAFIGCFIYGPQLLIGMNLIDVVPNFAVGSATGFSGLCGYLLGEFMADFVLGMIADSFGWNGAFIFIIVGAFIALLLLALTLKIKKNPQVEDKIA

SEQ ID NO: 55762 - DNA, 1338 bp, Streptococcus pyogenes MGAS8232
  CDS (1)..(1338): transl_table=11
atggaagaggattataacaaaagagaacctgagaagtttacgcaatttctgcgccgtcaaaaggtcgtcttttttgtcgtattttttggttatgtgtgtgcctacttggtacgcaacaatttcaaactaatgtcaaacactattatggtgcaaaatggttgggacaaggctcaaattgcgaccttgctatcgtgtttgaccgtttcttatggcttagcaaaattctatatgggggccttaggggatcgtgttagcttgagaaagctcttttcgatcagcttgggtgcaagcgctttgatttgtattttaatcggttttttcaatagttcaatggtggtattaggaatactgctagtcttgtgtggtgtcgtacaaggtgccttggcacctgcctcacaagccatgattgccaattattttccaaataaaacacgcggcggagccatcgctggatggaacatttctcaaaacatgggatcagccctcttgccattaaccatcgccttgctcaccagtatgggcttggtggtaccagctaatggcaatattttacttgcctttttaattcctggtgttttagtgttcttgtttgctttgtgttgctggaagcttggcggtgataaccctgagtctgagggacttgactctcttcgaacgatgtatggtgatgcgggcgagtcagctgttgccagtgaagaagaaaagcataacctgtcttattggcaactcatctggaaatacgttttttgtaacccgtcgctcttacttgttgctgctgtcaatgtggccctttatttcgttcgttttgggattgaagactggatgccgatctacttgtcacaagtagccaatatgtcagaggctcatatccattttgcgatttcaatgttagagtgggtcgctattccaggctcgctggtatttgcgtggttagcggttcgttatcctaataaaatggccaagattggggctattgggctttttgtgttagcggctattgtctttgtctatgaacgcttgactgccacaggtgctccaaactatttcttgttgcttgttattgcaggtattttagggtcattgatttatggcccacagttgatcgtgaatattttaacaatcaactttgttcctttaaatgttgcaggaacagcgattggttttgtaggagtaacagcttatctcatcggcaatatgggagcaaactggctgatgccgattttggcagatggttttggctggttttggtcatatattgtcgttgcagccttatctgctttttcagcggttggttatttaattttagccaaacgtgaggaagaaatcatcaaagattag

SEQ ID NO: 55763 - protein, 445 aa, Streptococcus pyogenes MGAS8232
MEEDYNKREPEKFTQFLRRQKVVFFVVFFGYVCAYLVRNNFKLMSNTIMVQNGWDKAQIATLLSCLTVSYGLAKFYMGALGDRVSLRKLFSISLGASALICILIGFFNSSMVVLGILLVLCGVVQGALAPASQAMIANYFPNKTRGGAIAGWNISQNMGSALLPLTIALLTSMGLVVPANGNILLAFLIPGVLVFLFALCCWKLGGDNPESEGLDSLRTMYGDAGESAVASEEEKHNLSYWQLIWKYVFCNPSLLLVAAVNVALYFVRFGIEDWMPIYLSQVANMSEAHIHFAISMLEWVAIPGSLVFAWLAVRYPNKMAKIGAIGLFVLAAIVFVYERLTATGAPNYFLLLVIAGILGSLIYGPQLIVNILTINFVPLNVAGTAIGFVGVTAYLIGNMGANWLMPILADGFGWFWSYIVVAALSAFSAVGYLILAKREEEIIKD

SEQ ID NO: 55764 - DNA, 1374 bp, Streptococcus agalactiae 2603V/R
  CDS (1)..(1374): transl_table=11
atgttgaaaaaactatttgcaccccctcagaaaagagaacgtttatcagctgaggaaattaagcataaatatcctcgttatcgtgtacaagtccttatttctatttttgtaggttatatgggatactattttgttcgtaatacgacttcaattttatctggtatccttaatatgtctgctactgagattggtattattacctgtgctagctacattgcttatggtctctctaaatttatttctggtttgatttcagatgaatcgaattctaaaattttccttccagttggtttgtttcttacaggactagttaatgtgttaatcggtgttattccatctgtaattactagtatctggctctttactatcatgtatcttattaatggttggttacaagggatgggataccctcctggagcgcgtacattagtctattggtatgataataaagaaagaattaaatatgctaccatttggaatttatctcacaattttggtggagcaatagcgccgattttaactggtgtaggtctagctcttgctggtaatgattctcttaatcaagcgcgtgctgcttattggtttccaggggtggtggcttgtcttttggctgttcttgtttactttttacaagaagatactccagaatctatcggacttccgcctatagaagagtatcataaagagcaatatactaatgttgtggattcaagtgacattttagaagagcctgaagttttgggtatgggcgaaattataaaaaaatatattctaccaaatactaaactgatgtgggcatccttgtattcaatatttgtatatattttacgttacggtattgtctcatggactcctaagtttttagcgacgagtgtgcaagatggtggaaaaggtattactgcaacagctggtatgggtggtttttcactttttgaaataggtggtattattgggatgctaacagcaggatatctatctgccaaagtgtttaaaaactctaaacctttaaccaatgtagccttcttagttgtagcaatcttattactagctgcctattggtttattccagcaggacctcaatatatggcattagacttcattattttactaggtttgggggcatcaatctacggtcctgttatgatggttggcctgtatgctatggagttagttccaaaagcagcagctggagcagcttcaggattgactggcacatttagttatgtcggaggagcaacgatcgctactctagctattggtattattattgaccactttggttggggagtagcatttataatatttggtatttctggatttgcggctattgtctgtaccttgctttcaagagataagagtctagagtattggtga

SEQ ID NO: 55765 - protein, 457 aa, Streptococcus agalactiae 2603V/R
MLKKLFAPPQKRERLSAEEIKHKYPRYRVQVLISIFVGYMGYYFVRNTTSILSGILNMSATEIGIITCASYIAYGLSKFISGLISDESNSKIFLPVGLFLTGLVNVLIGVIPSVITSIWLFTIMYLINGWLQGMGYPPGARTLVYWYDNKERIKYATIWNLSHNFGGAIAPILTGVGLALAGNDSLNQARAAYWFPGVVACLLAVLVYFLQEDTPESIGLPPIEEYHKEQYTNVVDSSDILEEPEVLGMGEIIKKYILPNTKLMWASLYSIFVYILRYGIVSWTPKFLATSVQDGGKGITATAGMGGFSLFEIGGIIGMLTAGYLSAKVFKNSKPLTNVAFLVVAILLLAAYWFIPAGPQYMALDFIILLGLGASIYGPVMMVGLYAMELVPKAAAGAASGLTGTFSYVGGATIATLAIGIIIDHFGWGVAFIIFGISGFAAIVCTLLSRDKSLEYW

SEQ ID NO: 55766 - DNA, 1320 bp, Shigella flexneri 2a str. 301
  CDS (1)..(1320): transl_table=11
atgttgccgtttctgaaagcgcctgccgatgcgccattaatgactgataaacatgaaattgatgcccgttatcgctactggcgtcggcatattctgctgaccatctggctgggttacgcgctgttttacttcacgcggaaaagttttaacgccgcggtaccagaaatccttgctaacggcgtgctcagccgtagcgatatcggcctgttagcgaccctgttttacattacttacggcgtgtcgaagtttgtctccggcattgtcagcgatcgctcaaatgcccgttattttatggggatagggcttatcgccacgggcatcatgaacattctgtttggcttctcgacgtcgctatgggcgtttgccgtgctctgggtgctgaacgcctttttccagggctggggttcaccggtgtgtgcgcgtctgttaacggcctggtattcacgtaccgagcgcggcggttggtgggcattatggaacacggcgcataacgtcggcggcgcactcattcccattgtgatggcagcgagcgcgctgcattacggctggcgtgccgggatgatgattgctggttgtatggcgatagtcgtggggatttttctctgctggcggctacgcgatcgcccgcaggcgttaggtttaccggcggtcggtgaatggcggcacgacgcgctggaaattgctcaacaacaagaaggggcagggttgacgcgtaaagagatcctcaccaaatatgtgttgctgaatccgtatatctggctgctttcgttttgctatgtgctggtctatgtggtccgggcggcgatcaacgactggggcaatttgtatatgtccgagacgctgggcgtcgatctggtcacggcgaatacggcagtgacgatgtttgaactgggcggatttatcggtgcgctggtagccggttggggctcggacaaattgtttaacggcaaccgtgggccgatgaatttgattttcgccgccggaattttgctttcagtcggctcgctgtggctgatgccatttgccagctacgtgatgcaggcaacctgcttcttcaccattggtttttttgtctttggcccgcagatgttaattggtatggcggcggcagagtgttcccacaaagaggcggcaggggcggcgacggggtttgtcggcttgtttgcttatctgggggcgtcgcttgctggttggccgctggcgaaagtgctcgatacctggcactggagcggattttttgtggttatctctatcgccgccgggatttccgcactgctgttactgccctttttgaacgcccagacaccgcgtgaagcgtga

SEQ ID NO: 55767 - protein, 439 aa, Shigella flexneri 2a str. 301
MLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIMNILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 55768 - DNA, 1332 bp, Leptospira interrogans serovar Lai str. 56601
  CDS (1)..(1332): transl_table=11
atgatttcaccgttacgttggctactccctgcaaaagcaaagccattattatcaaaagaattaatagatcgatcttatccgcgttttagatggaggattttagaagcaacctttatcggttatgcgacgttttatctcgtaaggaataattttccagttatttccaaagaaatgggagaagcccttcattatagtcaagaacaaatcacaaacattttagcagtgactgcgatcacatacgggataggaaaatttttaatgggaatcttatccgatcgtagtaatccaaaatacttcatgccattgggtttgattttaaccgcgatttgtaatttgtttttcggagcatcaaatcagtacgaagttcatttttatctttgggcattaaacggattgatgcaagggatgggatggcctccttgtggacgttctcttggtcattggttcggagtttccgaaagaggatctaaatttgcaatttggaacatagcgcataacgtgggaggaggtttggtaggaattatcgcagcttacagcgcatcttggtggggttggaggaatgcgttttatattcccgctttgattgcgattgtgaccgcgatttatcttttatttcgattggtggatacacctcagtcggttggtcttcctccaatcgaagaatatcaaaaagatccggaaaaggaggtaagactttctatacaagaacaagaaaaggaactttcttttcgagaaatcattttaggttctgtattaaaaaatcattatgtttggacttttgcatttgctaattttttcgtttatgtggttcgatatggtttgacggatataggtcctacttatttaaaactttctaaaggagcttctttagagaaaggtgggatcagcacgttgatctacgaatttgctggaattgcttctacccttcttgtaggatggggttccgataagctggggggtaaaagaggaatggtaagtcttttatgtatgcttcctattttgtttgctttaatttcattattatttactcctttaggatttctatggttggatcttgtattgttcggaatcatcggtttttttatctatccacctgttatgttgttaggtgttgctgggcttgattttacttctaaaaaagcggttggagctgcagccggttttataggtttattcggttatttgggaaggacgattctttcaaaatcggtaggatggttgagtaaacaaactggatttcattgggaacaacctatgtatttaatgatcggtgcgactttaatttcaatcgcgttactcgccattacttggaattggaaacctaaggcatag

SEQ ID NO: 55769 - protein, 443 aa, Leptospira interrogans serovar Lai str. 56601
MISPLRWLLPAKAKPLLSKELIDRSYPRFRWRILEATFIGYATFYLVRNNFPVISKEMGEALHYSQEQITNILAVTAITYGIGKFLMGILSDRSNPKYFMPLGLILTAICNLFFGASNQYEVHFYLWALNGLMQGMGWPPCGRSLGHWFGVSERGSKFAIWNIAHNVGGGLVGIIAAYSASWWGWRNAFYIPALIAIVTAIYLLFRLVDTPQSVGLPPIEEYQKDPEKEVRLSIQEQEKELSFREIILGSVLKNHYVWTFAFANFFVYVVRYGLTDIGPTYLKLSKGASLEKGGISTLIYEFAGIASTLLVGWGSDKLGGKRGMVSLLCMLPILFALISLLFTPLGFLWLDLVLFGIIGFFIYPPVMLLGVAGLDFTSKKAVGAAAGFIGLFGYLGRTILSKSVGWLSKQTGFHWEQPMYLMIGATLISIALLAITWNWKPKA

SEQ ID NO: 55770 - DNA, 1317 bp, Pseudomonas putida KT2440
  CDS (1)..(1317): transl_table=11
atgaatcaatccctagccgcgttcaaacgctggcgcattcagattttcgccatcacctggctggcttacgccgccttctacttcacccgcaaagccttctcggtggccaaactgggcatcgccgaagacccaggcttcatgctcgacaaggccgccatggccaacctggatgccatctacctggccgcctatgccgtgggccaattcacctggggcatgcttgccgaccgcttcggcccgcgcgtggtggtgctgggcgggttgctgatttctgcggcggcggcagtcgtgatgggcagttacgcaaccttcccgatcttcgccacctgcatgctggtacagggcctggcgcaatccaccggctgggccggcttgtgcaagaacatcggcagcttcttcccggcttcgcagcgcgggcgggtgctgggcctgtggagttcctgctatgccttcggcggcctggtggcctcgccgttcgcgggctggtgggcctacaccctggtgggcacctggcacgcggcgttcttctccagcgcggtcgtggtggcgctggtggcggtgctgttcttcttcctgcagcgcaacaaacccgaggacgtcggcttgccggcggttgagcccgagccgcaaagcatggccccggccgacaacctgtgcagcgtgtgggcacccctgagggagatcctgcgcaaccgcacggtgttgaccctgggccttgcgtacttcctgctgaagccggcgcgctacgccatcttgctgtggggccctgtgatcgtcttcgagcagatgccctcggtgggcaaagtgggcgcggcaatcatcccgactgctttcgaactggccgggctgcttggcccgatcatgatcggcctggcctcggacaaactgtttggcgcccggcgcatgccagcctgcgtgatcagcctggtgctgctgaccgtgacattggcggcgttcatggcggccatgaacaccggcagcgtgctgctggtggtggccttgctgttcgtcatgggcctgaccctgtacgggccggactcgatgatcagcggcgctgcagccatcgacttcggcaccgccaaggccggcgccaccgcagcaggttttgtcaacggctgtggctcggtgggcgcggtgctgggtgggctgctgccgggttacttcgacggcgtcacggtattcatcgtgttcgcgggctgtgcgctgttctcggcgctggtgttgctgccgcactggaacagccgcccggccagcagcgcgcaaggcaccgacgtggcaccgaacaccagcatggcaatcaagccactgcgtacttaa

SEQ ID NO: 55771 - protein, 438 aa, Pseudomonas putida KT2440
MNQSLAAFKRWRIQIFAITWLAYAAFYFTRKAFSVAKLGIAEDPGFMLDKAAMANLDAIYLAAYAVGQFTWGMLADRFGPRVVVLGGLLISAAAAVVMGSYATFPIFATCMLVQGLAQSTGWAGLCKNIGSFFPASQRGRVLGLWSSCYAFGGLVASPFAGWWAYTLVGTWHAAFFSSAVVVALVAVLFFFLQRNKPEDVGLPAVEPEPQSMAPADNLCSVWAPLREILRNRTVLTLGLAYFLLKPARYAILLWGPVIVFEQMPSVGKVGAAIIPTAFELAGLLGPIMIGLASDKLFGARRMPACVISLVLLTVTLAAFMAAMNTGSVLLVVALLFVMGLTLYGPDSMISGAAAIDFGTAKAGATAAGFVNGCGSVGAVLGGLLPGYFDGVTVFIVFAGCALFSALVLLPHWNSRPASSAQGTDVAPNTSMAIKPLRT

SEQ ID NO: 55772 - DNA, 1392 bp, Escherichia coli CFT073
  CDS (1)..(1392): transl_table=11
atgctggctttcttaaaccaggttcgcaagccgaccctggaccttccgctcgaagtgcggcgcaaaatgtggttcaaaccgttcatgcaatcctacctggtggtctttatcggctaccttacgatgtacctgattcgcaagaactttaacatcgcgcagaacgacatgatctcgacctacgggttgagcatgacgcagctggggatgatcggcctgggcttctccatcacttatggcgtgggtaaaacgctggtttcttactacgccgacggcaaaaacaccaaacaattcctgccgttcatgctgatcctgtctgccatttgtatgctgggcttcagtgccagtatgggcagcggctcggttagcctgttcctgatgattgccttctacgccttaagcggctttttccagagtaccggcggttcgtgcagttactccaccatcaccaaatggacgccgcgtcgtaaacgcgggacattcctcggtttctggaacatttctcacaaccttggtggtgcaggcgcagcaggtgtggcgctgttcggcgcaaattacctgttcgatggtcatgtcatcggcatgtttattttcccgtcgattatcgcgctgattgttggttttatcggtctgcgttacggcagcgactccccggaatcttatggcctcggcaaagctgaagagctgtttggcgaggagatcagtgaagaggataaagagacagaatctaccgatatgaccaagtggcagatctttgttgagtatgtgctgaaaaacaaagtgatctggctgctgtgctttgccaacattttcctctatgtggtgcgtattggtatcgaccagtggtcaaccgtgtatgcgttccaggaactgaaactctctaaagcgttggcaattcagggctttacgctgtttgaagctggtgcgctggtcggtacgctgctgtggggctggctctctgacctggcgaacggtcgccgtggcctggtggcctgtatcgcgctggcgctgattatcgccacgctcggtgtgtatcaacacgccagcaacgaatatatctacctggcttctctctttgcgttgggtttcctggtctttggcccgcaattgttgattggtgtggctgctgttggctttgtacctaaaaaagcgattggcgctgccgatggtattaaaggcaccttcgcttacctgattggtgacagctttgccaagttaggtctgggaatgattgccgatgggacgccggtatttggccttaccggctgggcaggcaccttcgccgcgctggatatcgccgcgattggttgtatctgcctgatggcgatagtggcggtgatggaagaacgcaaaatccgccgcgagaaaaaaattcagcagttgacagtggcataa

SEQ ID NO: 55773 - protein, 463 aa, Escherichia coli CFT073
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKALAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 55774 - DNA, 1323 bp, Escherichia coli CFT073
  CDS (1)..(1323): transl_table=11
atgatgttgccgtttctgaaagcgcctgccgatgcgccattaatgactgataaacatgaaattgatgcccgctatcgctactggcgtcggcatattctgctgaccatctggctgggttacgcgctgttttacttcacgcgtaaaagttttaacgccgccgtaccagaaatccttgctaacggcgtgctcagccgtagcgatattggcctgttagcgaccctgttttacattacctacggcgtgtcgaagtttgtctccggcattgtcagcgatcgctcaaatgcccgttattttatggggatagggcttattgccacgggcattatcaacattctgtttggcttctcgacgtcgctatgggcgtttgccgtgctttgggtgttgaacgcctttttccagggctggggttcaccggtgtgtgcgcgtctgttaaccgcttggtattctcgtaccgagcgcggcggttggtgggcattatggaacacggcgcataacgtcggcggcgcactcattcccattgtgatggcagcgagcgcgctgcattacggctggcgtgccgggatgatgattgcgggttgtatggcgatcgtcgtggggatttttctctgctggcggctgcgcgatcgtccgcaggcgttaggtttaccggcggttggtgaatggcggcacgacgcactggagattgctcaacaacaagaaggggcagggctgacgcgtaaagagatcctcaccaaatatgtgttgctgaatccgtatatctggctgctttcgttttgctatgtgctggtctatgtggttcgggcggcgatcaacgactggggcaatttgtatatgtccgagacgctgggcgtcgatctggtcacggcgaatacggcagtgacaatgtttgaactgggcggatttatcggtgcgctggtagcgggttggggttcggacaaactgtttaacggcaaccgcgggccgatgaatttgattttcgccgccggaattttgctttcagtcggctcgctgtggctgatgccatttgccagctacgtgatgcaggcaacctgcttcttcaccattggtttttttgtctttggcccgcagatgttaatcggcatggcggcggcagagtgttcccacaaagaggcggcaggggcggcgacgggatttgtcggcttgtttgcttatcttggtgcgtcgcttgctggttggccgctggcgaaagtactcgatacctggcactggagcggattttttgtggttatcgccatcgccgccgggatttccgcactgctattactgccctttttgaacgcccagacaccgcgagaagcgtga

SEQ ID NO: 55775 - protein, 440 aa, Escherichia coli CFT073
MMLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVIAIAAGISALLLLPFLNAQTPREA

SEQ ID NO: 55776 - DNA, 1365 bp, Escherichia coli CFT073
  CDS (1)..(1365): transl_table=11
atgttatcaatatttaaaacggggcaagcggcggatagtgttccggcggagaaaattcaggtgacatatcgtcgctatcgtatgcaggcgttacttagcgtatttctggggtatcttgcatactatatcgtgcgtaataatttcaccttatcaacgccttatcttaaagagcaattagatctcagcgccacacaaattggcgtactgagtagctgtatgcttatcgcctatggtatcagcaaaggagtgatgagtagccttgccgataaagccagtccgaaagtctttatggcgtgtgggctggtgttatgtgccatcgttaacgttggcctgggattcagcaccgcattctggatttttgcggcattggttattctgaatggtcttttccagggaatgggcgttggtccttctttcatcactattgctaactggttccctcgccgggagcgtggtcgggttggtgctttctggaatatctctcataacatcggtggtggtattgttgcaccgattgttggtgccgcttttgccctactcggcagcgagcactggcaaagtgcgagttatatcgttccggcctgcgtggccatcgtttttgcggtaattgtgctgattctcggtaaaggttccccacatcaggaaggtctaccctctctggaagagatgatgccggaagaaaaagtcgtcctgaatacccgacagacggtaaaagcaccagaaaacatgagcgcctttcagattttctgcacttatgtattacgcaataaaaatgcctggtatgtctcactggttgacgtatttgtatacatggtgcgcttcgggatgattagctggttgcctatttatctgctgacggtgaaacatttttcaaaagaacaaatgagcgtcgcatttttattttttgaatgggccgcgatcccttccacgctacttgccggttggttgtcagacaaactgtttaaagggcgtcgtatgccattggcgatgatttgtatggcgctgattttcatttgcctgattggctactggaaaagtgaatcgttgtttatggtgacaatttttgctgccattgttggttgtctgatttacgttccacaatttctggcttccgttcagactatggagatcgtgcccagctttgctgttggctccgcggtaggtttacgtggttttatgagctatatcttcggtgcatctctgggcaccagcctgtttggtattatggtcgatcatattggctggcatggcggattttatcttcttggctgcggtattatttgttgcatcattttttgctggttatcacatcgtggtgcaattgaacttgaacgtcacagagccgcatatataaaagagcactaa

SEQ ID NO: 55777 - protein, 454 aa, Escherichia coli CFT073
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAALVILNGLFQGMGVGPSFITIANWFPRRERGRVGAFWNISHNIGGGIVAPIVGAAFALLGSEHWQSASYIVPACVAIVFAVIVLILGKGSPHQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 55778 - DNA, 1380 bp, Vibrio vulnificus CMCP6
  CDS (1)..(1380): transl_table=11
atgcttaatttctttaaaactcgtccggatgcgccgttatcagacagctccaacgagggaatgctaaagcgctacaagaactaccaatggcaggtattcttaggccttatttttggttacgccgtcttttacgtagtacgtatgagtttgggtgttgtgaaaaagcccatgctcgatgcgggcatcgtgaccatcgaagaactcggtatcatgggttcggcgttcttcttcacttacgccttcggtaagttcttaaacggcttcctatctgactacgccaacattggccgctttatgtcgtgttccctactggtatcgggtgtactctcggttgtgatggggatgaacaccgttggcttcttcttcgttctgctttggggcttaaacggttggttccaatcagtgggttccgcaccttcgtgtgtatcgctttaccaatggttttcgccaaaacagcgtggtagccgttactccatttggggtggttcacgtaacatcggtgaaggtatcacttggatcctaacggcgacactagtgagctacttcggctggcgtgcaggtttcattggcgcgggtatcgctgccgtagttgctgcactgatcatgctgaaagtactgaaagatcgtccacaaacttacggcttaccagatccaggtactgcatttggcgaaggtaccgaaatcaagaaagcgaacgacccaaaagaaacacgtcgtgcgcagatgtttatcctaaaacaacctgtggtatggcttattgccctatcttgtgcggcaatgtacatctctcgctacgcaatgtcttcttgggcggtattgttcctacaagaaacaaaaggttactcactgattgacgcaggttttgccatgtcaatgtacccaacagccggtctagcgggtgcgattctgtcaggtatcctttcagacaaagtgttcaaaggtaaccgtaacatccctaacctactgtacggattggcaaacattgccggtatgtgtttgatgttctttggcccagataaccgtgttatcgacgcagtggcactgagcatgatcggcttctctatcggtggtctagtggtattcctcgcgggtctgattgcttgtgacctgatgccgaaaaacgcggttggtgcggtaaaaggtttgatcggtctgtgttcttacattgcagcgtcagctcaagagcttatctctgcatctctgatcaccatcactgaagtcgatggcgtaaaacactacgactttggtaacgctcagtacttctggcttgccgctggtgtggtatcggttctactcgcactgacggtatggaatgcgaagaaagtggtcgatatcgacgaagaacaagacaaaaagctacaaacacgcacagcttcttaa

SEQ ID NO: 55779 - protein, 459 aa, Vibrio vulnificus CMCP6
MLNFFKTRPDAPLSDSSNEGMLKRYKNYQWQVFLGLIFGYAVFYVVRMSLGVVKKPMLDAGIVTIEELGIMGSAFFFTYAFGKFLNGFLSDYANIGRFMSCSLLVSGVLSVVMGMNTVGFFFVLLWGLNGWFQSVGSAPSCVSLYQWFSPKQRGSRYSIWGGSRNIGEGITWILTATLVSYFGWRAGFIGAGIAAVVAALIMLKVLKDRPQTYGLPDPGTAFGEGTEIKKANDPKETRRAQMFILKQPVVWLIALSCAAMYISRYAMSSWAVLFLQETKGYSLIDAGFAMSMYPTAGLAGAILSGILSDKVFKGNRNIPNLLYGLANIAGMCLMFFGPDNRVIDAVALSMIGFSIGGLVVFLAGLIACDLMPKNAVGAVKGLIGLCSYIAASAQELISASLITITEVDGVKHYDFGNAQYFWLAAGVVSVLLALTVWNAKKVVDIDEEQDKKLQTRTAS

SEQ ID NO: 55780 - DNA, 1341 bp, Vibrio vulnificus CMCP6
  CDS (1)..(1341): transl_table=11
atgtttggactgtttcaatctccgagctacacacaagctcccttggacaaaagccaagttgatgaacgttatcgttactggcgactgcatatcatgatcggcatgtacattgggtacgcgggcttttatttcactcgcaaaaccttcaactacgccgcgcctgccatgattgttgatttgggcttagacaaaggcgatctcggtttaatcggcacacttttctacatcacctatggcctatcgaagtttatctccgggaccatttctgaccgctctaatccacgttattttatgggtgtgggcctgatcgcctcagggattatcaatatcgtgtttggtttttccagctcgctgattgcgctttccatcttgtgggtgctcaacgcttggttccaaggttggggatggccttcttgttccaaactcctcaccacctggtattcgcgctcagaacgcggcttcttgtgggcaatttggaacacagcccacaacgtgggtggcgcactgatcccattattggtcggctacctcacttttcatttcagttggcgtgaaggctttattgttcctggcattatcggcgtgttacttggccttattgtttgctggcgattaagagataaacccaccactcaggggctgccaaccgtcggtcagtggcgtcatgatgcgctcgaactggctcaagagaaacatggccaaggactcagctatcacgaaattctcacgcactatgttttcaacaacaaatacatttggttgctcgcttttagctatgtactggtttacatcgtgcgcaccgcaatcaatgactggggcaatctctaccttaccgagcaacaccattactctctgatcaacgccaacgctgcattgtcgatgttcgagatcggtggctttgttggttctctcgtagcaggttggggctcggataaactgttcggtggtaaccgcggtccgatgaatctgctatttgccgccggtattttcttgtctgttgctgcgctgtggttaatgccgttaaccaactttgcctttcaagcggcgggtttattctctattggcttcttcgtgtttggcccacaaatgcttatcggcatggcagccgctgagtgttctcacaaagattcagctggcgcagccacgggttttgttggtctgtttgcctacatgggcgcggcgttgtctggctacccgcttgcactgattttggaagaatacagctggaccggtttcttcgtcaccatctctatctgtgcggcggtgatcggcttactgttgctgccctttcttcaagctcaaccgtctcgtaaaccactggcccccaaacttcgcttatag

SEQ ID NO: 55781 - protein, 446 aa, Vibrio vulnificus CMCP6
MFGLFQSPSYTQAPLDKSQVDERYRYWRLHIMIGMYIGYAGFYFTRKTFNYAAPAMIVDLGLDKGDLGLIGTLFYITYGLSKFISGTISDRSNPRYFMGVGLIASGIINIVFGFSSSLIALSILWVLNAWFQGWGWPSCSKLLTTWYSRSERGFLWAIWNTAHNVGGALIPLLVGYLTFHFSWREGFIVPGIIGVLLGLIVCWRLRDKPTTQGLPTVGQWRHDALELAQEKHGQGLSYHEILTHYVFNNKYIWLLAFSYVLVYIVRTAINDWGNLYLTEQHHYSLINANAALSMFEIGGFVGSLVAGWGSDKLFGGNRGPMNLLFAAGIFLSVAALWLMPLTNFAFQAAGLFSIGFFVFGPQMLIGMAAAECSHKDSAGAATGFVGLFAYMGAALSGYPLALILEEYSWTGFFVTISICAAVIGLLLLPFLQAQPSRKPLAPKLRL

SEQ ID NO: 55782 - DNA, 1380 bp, Staphylococcus epidermidis ATCC 12228
  CDS (1)..(1380): transl_table=11
atgaacttttttgatattcataaaataccaaacaaagggataccattagctgtacaacgcaaattatggcttagaaactttatgcaagcgttttttgtcgtattctttgtttacatggcgatgtatttaattcgaaacaattttaaagcggcacaaccgttattaaaagaagaaatcggattatcaacattagaactgggttatataggattagcgtttagtattacttacggtttaggaaaaacattactcggttattttgtcgatggtcgtaatacgaagcgtattatttccttcttattaatattatctgcgattacagtacttattatgggatttgtattaagttacttcggctctgtgatgggactattaattgtactgtgggggcttaacggtatatttcaatctgtgggtgggcctgcaagttattcaacgatttcaaggtgggcacctcgaacaaagcgtggacgttatttaggattttggaatacatcacataacattggtggtgcaattgctggcggtgtcgcactctggggtgcgaatacatttttccacggtaatgtcgttgggatgtttatttttccttctattatcgctttaatcattggaatcgtgacattatttattgggaaagatgatccagaagaattaggttggaatcgtgctgaagaaatttgggaagagcctatcgatcaagaaaatattgattctcaaggtatgactaaatgggatatctttaaaaaatatatcctgggaaatccagtgatttggattttgtgtatctcaaatgttttcgtatatatcgtgcgtattggtattgataattgggcgccgctatacgtatcagagcatttacactttaataagggtgacgcggttaatactattttctactttgaaataggagcattagtagccagtttattatggggttatatctcagaccttttaaaaggacgtcgtgcgattgtagcgattggatgtatgtttatgattacctttgttgtgctgttttatacgaacgcaacaagtgtgacaatggtcaatatttctctatttgcattaggcgctttaatcttcggtccacagttactcattggtgtatctctgactggctttgttcctaaaaatgcaattagtgtcgctaacggtatgacaggttcattcgcatatctattcggggattcaatggctaaagtgggtctggctgcaatcgctgatccaacacgtaatggtctaaatatttttgggtatacgttgagtggttggacagatgtctttattgtattctatgtagctttattcttaggaatgatactattagccattgttgcttattacgaagaaaagaaaattagaaaattaaaaatttaa

SEQ ID NO: 55783 - protein, 459 aa, Staphylococcus epidermidis ATCC 12228
MNFFDIHKIPNKGIPLAVQRKLWLRNFMQAFFVVFFVYMAMYLIRNNFKAAQPLLKEEIGLSTLELGYIGLAFSITYGLGKTLLGYFVDGRNTKRIISFLLILSAITVLIMGFVLSYFGSVMGLLIVLWGLNGIFQSVGGPASYSTISRWAPRTKRGRYLGFWNTSHNIGGAIAGGVALWGANTFFHGNVVGMFIFPSIIALIIGIVTLFIGKDDPEELGWNRAEEIWEEPIDQENIDSQGMTKWDIFKKYILGNPVIWILCISNVFVYIVRIGIDNWAPLYVSEHLHFNKGDAVNTIFYFEIGALVASLLWGYISDLLKGRRAIVAIGCMFMITFVVLFYTNATSVTMVNISLFALGALIFGPQLLIGVSLTGFVPKNAISVANGMTGSFAYLFGDSMAKVGLAAIADPTRNGLNIFGYTLSGWTDVFIVFYVALFLGMILLAIVAYYEEKKIRKLKI

SEQ ID NO: 55784 - DNA, 1350 bp, Pseudomonas syringae pv. tomato str. DC3000
  CDS (1)..(1350): transl_table=11
atgttcgggtttttccgccccgccaggcaccaggcacccctccccgaagaaaaagtcgatagcacctatcgacgcctgcgctggcagattttcgcaggcatctttatcggttacgccggctactatttgctgcgcaagaatttctcgctggcgatgccgtatctgatcgacgaaggctacacgcgtggccaactgggcgtggcgatgtctgccattgcgattgcctacggcttgtcaaaattcctcatggggatcatttccgaccgatccaacccgcgttactttctgccgttcggcctgctggtgtctgccgggatcatgttcatcttcggcttcgcgccgtgggcgacgtccagtgtcacgatcatgttcgtgctgctgttcatcaatggctgggcacagggcatgggttggccgccgagcgggcggacgatggtgcattggtggtcgcagaaagagcgcggcggtgttgtgtcggtgtggaacgtggcgcacaacgtcggcggcggcctgatcggtccgctgtttctgctgggtatgggctggacaaacgactggcatgcagcgttctatgtgccggcggcagttgcgctgctggtggcggtattcgccttcgccacgatgcgtgacactccgcaatcggtgggtttgccgcccatcgagcactacaagaacgattacccggaaggctacgatgagagccacgaggaagaattcagcgctcgggaaatcttcgtcaagtacgtgctgcgcaacaaattcctgtggtacatcgccatggccaacgtgttcgtttacctgctgcgctacggcgttctggactgggccccgacctacctgaaagaagccaagcacttcacggtcgacaagacctcatgggcttactttctgtacgagtgggcaggtattccgggcacgctgctgtgcggctggatgtcggacaagatcttcaagggcaatcgcggcctgaccggcatggtgttcatgtttctggtgaccatcgccacgctggtgtactggctgaaccctgaaggcaacccgaccgtcgacatgatcgcgctggtgtccatcggcttcctgatctacggcccggtgatgctgatcggcttgcaggcactggaactggcccccaagaaggcggcgggcacggcagcgggctttaccgggctgtttggctatctgggcggctctgtcgcggcgagcgctgcgatgggctacacggttgaccacttcggctgggatggcggcttcgtgctgctgatcggcgcgtgcatcctggcgatggtgtttcttgcgccaacgctgcggcacaaacaggtcgccagtacgtcccgcgacatcaaacgctga

SEQ ID NO: 55785 - protein, 449 aa, Pseudomonas syringae pv. tomato str. DC3000
MFGFFRPARHQAPLPEEKVDSTYRRLRWQIFAGIFIGYAGYYLLRKNFSLAMPYLIDEGYTRGQLGVAMSAIAIAYGLSKFLMGIISDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDESHEEEFSAREIFVKYVLRNKFLWYIAMANVFVYLLRYGVLDWAPTYLKEAKHFTVDKTSWAYFLYEWAGIPGTLLCGWMSDKIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMVFLAPTLRHKQVASTSRDIKR

SEQ ID NO: 55786 - DNA, 1437 bp, Vibrio parahaemolyticus RIMD 2210633
  CDS (1)..(1437): transl_table=11
atgttaattttgtttcgttcgctccttttgggttctttaccatcgcatatacataatgaggttcctatgtttggaatattcaaacctaaggcgcacattgatcgtctatccccagatagcattgatagcacctattctcgcctccgttggcaactgttcatcggtatttttgttggctacgccggctactatttggttcgtaaaaacttcagtttagcgatgccgtacctcatcgaggagggttacagccgtggtgaccttggtgttgctttggccgctgtttcaatcgcttatggcctttcaaaatttttaatgggcagcgtgtctgaccgttctaacccgcgctatttcctcagtggcggtttgttgatgtctgctctggttatgttctgctttggctttatgccatgggcaacaggcagcatcacggcaatgtttattcttctatttttgaacggttggttccaaggtatggggtggccggcctgtgggcgaaccatggtgcactggtggtcacgtaaagagcgtggtgagatcgtttcggtttggaacgtagcgcacaacgtgggtggcggtttgattggtccactattcattttgggtctgtgggcatttaacgatgattggcgcaccgcattttatgtacctgcatttttcgccactttggttgcagtgttcatttggatgacggttcgagatacgcctcagtcttgtggtctaccgccgattgaagagtacaaagatgactacccagatgactacgacaagtcgcatgaacaagaaatgacggcgaaggaaattttcttcaagtacgtattcaacaataaactgttgtggtcgattgcgattgcaaacgcgtttgtttacttgatccgttacggtgtgttggactgggcacccgtttatctaaaagaagcgaaggacttctcggtagataaatcgtcttgggcttacttcctatacgagtgggcgggtattcctggcacgttattgtgtggttggatttcggacaagctgttcaaaggccgtcgtgcacctgcaggcatcttgttcatggtattggtaacgttggcggtattggtttactggttcaaccctgcgggcaacccaacaatcgatatgatggctcttatcgcgattggcttcttgatttacggccctgtcatgctgattggtttgtatgcacttgaattggcgccgaaaaaagcagcgggtactgctgctggtctaactggcttgtttggttacttaggcggtgcggtggctgcgaacgcggttcttggttacaccgtggaccatttcggttgggatggcggtttcatcattctaattggttcatgtattacttctatcgtgtgtttgacgtatgcgcttctaggcgaacgcgcacaccacgagcaaaaagagcgcgaaaaggaacaagaagcgctagcgtaa

SEQ ID NO: 55787 - protein, 478 aa, Vibrio parahaemolyticus RIMD 2210633
MLILFRSLLLGSLPSHIHNEVPMFGIFKPKAHIDRLSPDSIDSTYSRLRWQLFIGIFVGYAGYYLVRKNFSLAMPYLIEEGYSRGDLGVALAAVSIAYGLSKFLMGSVSDRSNPRYFLSGGLLMSALVMFCFGFMPWATGSITAMFILLFLNGWFQGMGWPACGRTMVHWWSRKERGEIVSVWNVAHNVGGGLIGPLFILGLWAFNDDWRTAFYVPAFFATLVAVFIWMTVRDTPQSCGLPPIEEYKDDYPDDYDKSHEQEMTAKEIFFKYVFNNKLLWSIAIANAFVYLIRYGVLDWAPVYLKEAKDFSVDKSSWAYFLYEWAGIPGTLLCGWISDKLFKGRRAPAGILFMVLVTLAVLVYWFNPAGNPTIDMMALIAIGFLIYGPVMLIGLYALELAPKKAAGTAAGLTGLFGYLGGAVAANAVLGYTVDHFGWDGGFIILIGSCITSIVCLTYALLGERAHHEQKEREKEQEALA

SEQ ID NO: 55788 - DNA, 1395 bp, Vibrio parahaemolyticus RIMD 2210633
  CDS (1)..(1395): transl_table=11
atgttaaaattcctcgaacaggtgcggaagccgaccctcgatcttcctgtcgaagttagaagaaagatgtggtttaaaccgttcatccaatcttacttggtcgtattcatcggctacctaaccatgtacttgattcgtaagaacttcaatgtcgcgcaaaacgacatgatctcaacttacggtttgagcatgacagacctaggtcttattggccttggcttctccatcacatacggcatcggtaaaaccgttgtgtcttactacgctgacggtaagaacaccaagcaattcctcccttttatgctgatcctttctggtcttgcaatgcttggtttcagcttcagcatgggcggcggtagtgcaagcctgttcttgatggtggctttctacgctctgagtggtttcttccaaagtactggtggcccttctagttactcaaccattacaaaatggacacctcgtaacaaacgcggctcttacctaggcttgtggaacatgtcgcacaacgttggtggtgcgggcgcagcgggtgttgctcttttcggtgctaactacctattcgacggccacgtaatcggcatgtttgtgttcccttctatcatcgcgatcatcgttggctttatcggtatgcgctttggtagcgactcaccagaagcttatggtctaggtaaagtagaagaacttttcgatgaagcagtgagtgaagaagacaccgctgctgaagaaaaccagatgaccaaaaaagaaatctttgttgaatacgttcttaaaaacaaagttatctggctactttgctttgccaacatcttcctttacatcgtgcgtatcggtatcgaccaatggtcaacggtatacgcgtaccaagagcttggtctgtcaaaagaaacggcaatctctggctttactctgttcgaagtcggtgcgcttgtgggtactttgatgtggggttacttatctgacctagcaaacggtcgccgcgcattggttgcttgtgtgtctcttggtttgatcatcgtatcgcttgagttctaccaacacgcaacaaatgaattcatgtacttgtcatctctattcgtacttggtttcttggtgtttggtccgcaacttcttatcggtgttgcagcggttggttttgttcctaaaaaagcaatcagtgtagctgacggtgtgaaaggtacattcgcttacctaatcggtgacagcttcgcgaaacttggtctcggtatgattgcagacggtacaccaatcttcggtctaacaggctggaaaggtaccttcgcagccctagatacctccgccatgatttgtattgttttgcttgctttcgtcgctatcgcggaagagaagaagattcgacacgcgaagaagcttcaacttgcacaaaaccaagcctaa

SEQ ID NO: 55789 - protein, 464 aa, Vibrio parahaemolyticus RIMD 2210633
MLKFLEQVRKPTLDLPVEVRRKMWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAVSEEDTAAEENQMTKKEIFVEYVLKNKVIWLLCFANIFLYIVRIGIDQWSTVYAYQELGLSKETAISGFTLFEVGALVGTLMWGYLSDLANGRRALVACVSLGLIIVSLEFYQHATNEFMYLSSLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHAKKLQLAQNQA

SEQ ID NO: 55790 - DNA, 1341 bp, Vibrio parahaemolyticus RIMD 2210633
  CDS (1)..(1341): transl_table=11
atgtttggatttttacgttcacctaaatttactcaaccgagtctgagcaacgagcaaatcgaccagcgttaccgccattggcgtttgcacattatgttggggatgtacatcggctacgcaggtttctactttactcgtaagacctttaactacgccgcaccagcgatgattaccgatcttggcttagataaaggcgatttgggccttatcggtacgcttttctacattacttacggctgctcgaagtttatttccggtacgatttcagatcgctctaaccctcgttatttcatgggattaggattgattgcgacaggtctggtcaatatcgcgttcggtttttctagctcactcgcggctttcattactctgtggatcttaaacgcgtggttccaaggctggggctggccttcatgctccaagctgttaaccacttggtattcacgctccgagcgtggcttcttatgggcgatttggaacaccgcacacaacgttggtggcgctctgatccctattttggtgggctatttaacgttgcactacagctggcgtgaaggctttattctacccggcatcatcggggtattactcggtctattcgtttgttggcgattgcgcgacaaacccacaacaatgggcttaccaagtgtcggacaatggcgcaacgacgcactagaacttgcgcaagaaaattacggacgtggcctcacctaccgcgaaattctgaaatcgtacgtatttaacaacaaatacatctggctgctcgcgttcagttatgtgttggtttacatcgtccgaaccgcaatcaatgactggggaaacctgtacttgaccgagcagcatcactatagcctgattaacgccaacgctgctctgtcgatgtttgaaatcggtggttttgttggttcattggttgcgggttggggctcagacaaactctttggcggtaaccgtgggccaatgaacttgctgttcgcgattgggattttcttgtctgtctctgcgctttggctgatgcctctgaccaactttgcattccaagcggcgggattgttctccatcggcttctttgtctttgggccacaaatgctgatcggtatggcggcggcggagtgctctcacaaagattctgccggcgcggcaacaggattcgtgggcttgttcgcctacatgggcgcagcattgtctggctatccactggcgttaattcttgaagaatatcattggacgggtttcttcatcaccatttcagtttgtgcagccgtcattggccttttgttgttgccatttttgcaagcgcaaccatcacgaaaaccactcgaaccaaaacctcggttgtaa

SEQ ID NO: 55791 - protein, 446 aa, Vibrio parahaemolyticus RIMD 2210633
MFGFLRSPKFTQPSLSNEQIDQRYRHWRLHIMLGMYIGYAGFYFTRKTFNYAAPAMITDLGLDKGDLGLIGTLFYITYGCSKFISGTISDRSNPRYFMGLGLIATGLVNIAFGFSSSLAAFITLWILNAWFQGWGWPSCSKLLTTWYSRSERGFLWAIWNTAHNVGGALIPILVGYLTLHYSWREGFILPGIIGVLLGLFVCWRLRDKPTTMGLPSVGQWRNDALELAQENYGRGLTYREILKSYVFNNKYIWLLAFSYVLVYIVRTAINDWGNLYLTEQHHYSLINANAALSMFEIGGFVGSLVAGWGSDKLFGGNRGPMNLLFAIGIFLSVSALWLMPLTNFAFQAAGLFSIGFFVFGPQMLIGMAAAECSHKDSAGAATGFVGLFAYMGAALSGYPLALILEEYHWTGFFITISVCAAVIGLLLLPFLQAQPSRKPLEPKPRL

SEQ ID NO: 55792 - DNA, 1338 bp, Streptococcus pyogenes SSI-1
  CDS (1)..(1338): transl_table=11
atggaagaggattataacaaaagagaacctgagaagtttacgcaatttctgcgccgtcaaaaggttgtcttttttgtcgcattttttggttatgtgtgcgcttacttggtacgcaacaatttcaaactaatgtcaaacactattatggtacaaaatggttgggacaaggctcaaattgcgaccttgctatcgtgtttgaccgtttcttatggtttagcaaaattctatatgggagccttaggggatcgtgttagcttgagaaagctcttttcaatcagcttgggtgcaagcgctttgatttgtattttaattggttttttcaatagttcaatggtggtgttagggatactgctagtcttgtgtggtgtcgtacaaggtgccttggcacctgcctcacaagccatgattgccaattattttccaaataaaacacgcggcggagccatcgctggatggaacatttctcaaaacatgggatcagccctcttgccattaaccatcgccttgctcaccagtatgggcttggtggtaccagctaatggcaatattttacttgcatttttaattcctggtgttttagtgttcttgtttgctttgtgttgctggaagcttggcggtgataaccctgagtctgagggacttgactctcttcgaacgatgtatggtgatgcgggcgaatcagctgttgccagtgaagaagaaaagcataacctgtcttattggcaactcatctggaaatacgttttttgtaacccgtcgctcttacttgttgctgctgtcaatgtggccctttattttgttcgttttgggattgaagactggatgccgatctacttgtcacaagtagccaatatgtcagaggcccatattcattttgcgatttcaatgttagagtgggtagctattccaggctcgctggtatttgcgtggttagcggttcgttatcctaataaaatggccaagattggggctattgggctttttgtgttagcggctattgtgtttgtctatgaacgcttgactgccacaggtgctccaaactatttcttgttgcttgttattgcaggtattttagggtcattgatttatggcccacagttgatcgtgaatattttaacaatcaactttgttcctttaaatgttgcaggaacagcgattggttttgtaggagtaacagcttatctcatcggcaatatgggagcaaactggctgatgccgattttggcagatggttttggctggttttggtcatatattgtcgttgcagccttatctgctttttcagcggttggttatttgattttagccaaacgtgaggaagaaatcatcaaagattag

SEQ ID NO: 55793 - protein, 445 aa, Streptococcus pyogenes SSI-1
MEEDYNKREPEKFTQFLRRQKVVFFVAFFGYVCAYLVRNNFKLMSNTIMVQNGWDKAQIATLLSCLTVSYGLAKFYMGALGDRVSLRKLFSISLGASALICILIGFFNSSMVVLGILLVLCGVVQGALAPASQAMIANYFPNKTRGGAIAGWNISQNMGSALLPLTIALLTSMGLVVPANGNILLAFLIPGVLVFLFALCCWKLGGDNPESEGLDSLRTMYGDAGESAVASEEEKHNLSYWQLIWKYVFCNPSLLLVAAVNVALYFVRFGIEDWMPIYLSQVANMSEAHIHFAISMLEWVAIPGSLVFAWLAVRYPNKMAKIGAIGLFVLAAIVFVYERLTATGAPNYFLLLVIAGILGSLIYGPQLIVNILTINFVPLNVAGTAIGFVGVTAYLIGNMGANWLMPILADGFGWFWSYIVVAALSAFSAVGYLILAKREEEIIKD

SEQ ID NO: 55794 - DNA, 1392 bp, Salmonella enterica subsp. enterica serovar Typhi Ty2
  CDS (1)..(1392): transl_table=11
atgttaacaatattaaaaacagggcgatcggcgcataaagtcccaccggaaaaagtccaggctacgtatggtcgatatcgtatacaggcattgttaagcgtatttctgggatatctcgcttactatatagtcagaaacaacttcacattatcgacgccttatttaaaagagcaattggatctcagcgctacgcaaatcggcctgctgagtagctgtatgcttattgcttacggaatcagtaaaggcgtaatgagcagtctggcggataaagccagcccaaaagtcttcatggcgtgcggtctggtactctgcgtgattgttaacgttgggctgggattcagtagcgcattctggatatttgccgctctggtggtcttcaatggcctttttcagggcatgggcgtcggcccctcgtttattactattgcaaactggttccctcgtcgggaacgcggacgcgtaggcgccttctggaatatctcgcataacgttggcggcgggatcgtcgcgcctatcgtcggtgcggcttttgcgatattgggcagcgaacactggcaaagcgccagttatatcgttccggcctgcgtcgccgtcatttttgccttaattgttctggtcttgggaaaaggttcgccgcgcgaagaaggtcttccctccctggaacagatgatgccggaagaaaaagtcatactgaaaacgaagaatacggcaaaagcgccggaaaatatgagcgcatggcaaatcttctgtacttatgtgctgcgcaataaaaatgcctggtatatttcgctggtcgatgtcttcgtctatatggtgcggtttggcatgattagctggttgcctatctatctgttgacagtaaaacacttttcaaaagaacagatgagcgtcgcgtttctctttttcgagtgggcggcaattccctctacgctactggcaggctggctgtcagataaactgtttaagggccgcagaatgccgttagccatgatttgcatggcgctgatttttgtctgtctgatcggatactggaaaagtgaatctttgctgatggtaacgattttcgccgccattgtaggttgtctgatttacgtcccgcaattcctcgcgtccgtacagacaatggagatagtccccagctttgccgtaggttccgccgtcggtttacgtgggttcatgagctatattttcggcgcctcgttgggcaccagcctgtttggcgtcatggtggataaactgggctggtacggcggattttatcttctgatgggcggcatcgtgtgctgcattctattctgttacctctcccatcgcggcgcgctggaactggaacgccagcgccagaatgcgttacataatcaggactcactgcagcttgcggacgcgcaataa

SEQ ID NO: 55795 - protein, 463 aa, Salmonella enterica subsp. enterica serovar Typhi Ty2
MLTILKTGRSAHKVPPEKVQATYGRYRIQALLSVFLGYLAYYIVRNNFTLSTPYLKEQLDLSATQIGLLSSCMLIAYGISKGVMSSLADKASPKVFMACGLVLCVIVNVGLGFSSAFWIFAALVVFNGLFQGMGVGPSFITIANWFPRRERGRVGAFWNISHNVGGGIVAPIVGAAFAILGSEHWQSASYIVPACVAVIFALIVLVLGKGSPREEGLPSLEQMMPEEKVILKTKNTAKAPENMSAWQIFCTYVLRNKNAWYISLVDVFVYMVRFGMISWLPIYLLTVKHFSKEQMSVAFLFFEWAAIPSTLLAGWLSDKLFKGRRMPLAMICMALIFVCLIGYWKSESLLMVTIFAAIVGCLIYVPQFLASVQTMEIVPSFAVGSAVGLRGFMSYIFGASLGTSLFGVMVDKLGWYGGFYLLMGGIVCCILFCYLSHRGALELERQRQNALHNQDSLQLADAQ

SEQ ID NO: 55796 - DNA, 1359 bp, Salmonella enterica subsp. enterica serovar Typhi Ty2
  CDS (1)..(1359): transl_table=11
atgttgagtatttttaaaccagcgcttcataaagcgcgcttgccagcggcggagattgatccgacctatcgccgattacgctggcagattttcctggggatattctttggctatgccgcgtattatctggtgcgcaagaactttgccctcgcgatgccctacctggtagaacagggtttttcacgcggcgatctgggctttgcgctgtccgggatttctatcgcttatggtttttcgaaatttataatgggttcggtgtccgatcgctcgaatccgcgcgtttttctgccggcagggttgattctggccgcagcagtcatgttgtttatgggctttgtgccgtgggcgacatccagcatcgccgtgatgtttgtgctgttgttcctttgcggctggttccaggggatggggtggccgtcgtgcggacgtacgatggttcactggtggtcgcagaaagagcgcggcggcattgtgtcggtctggaactgtgcgcataacgtcggcggcgggatcccgccactgctgttcctgctggggatggcgtggtttaacgactggaaagcggcgctctatatgccagcctttggcgcgattgtggtggcactgttcgctttcgcaatgatgcgcgatacgccgcaatcctgcggtctgccgcctatcgaagagtataaaaacgactatccggatgactacaacgaaaaagcggaagaagagctgactgcgaagcagatcttcatgcagtacgtactgccgaacaaattactgtggtatatcgctatcgccaacgtgttcgtctacctgctgcgctacggtatcctcgactggtcaccgacctacctgaaagaagtgaagcatttcgcactcgataaatcctcctgggcctacttcctctatgaatacgcgggtattccaggcacgctgctgtgtggctggatgtcggataaagtcttccgcggcaaccgtggcgcgtcgggcgtattctttatgaccctggtcactatcgcgaccatcgtttactggatgaacccggcaggcaacccgaacgttgatatggcttgtatgattatcatcggcttcctgatctacggcccggtaatgttgatcggtctgcacgcgctggagctggcgccgaaaaaagcggcgggtacggcggcgggctttaccggtctgtttggttacctgggcggttctgtcgctgcaagcgccattgtgggttataccgttgacttcttcggttgggatggcggctttatggtgatgattggcggtagcattctggcggtaatcctgctggtggtcgtgatgattggcgaaaaacgccatcatgatgagctgcagttaaaacgcaacggaggctaa

SEQ ID NO: 55797 - protein, 452 aa, Salmonella enterica subsp. enterica serovar Typhi Ty2
MLSIFKPALHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPSCGRTMVHWWSQKERGGIVSVWNCAHNVGGGIPPLLFLLGMAWFNDWKAALYMPAFGAIVVALFAFAMMRDTPQSCGLPPIEEYKNDYPDDYNEKAEEELTAKQIFMQYVLPNKLLWYIAIANVFVYLLRYGILDWSPTYLKEVKHFALDKSSWAYFLYEYAGIPGTLLCGWMSDKVFRGNRGASGVFFMTLVTIATIVYWMNPAGNPNVDMACMIIIGFLIYGPVMLIGLHALELAPKKAAGTAAGFTGLFGYLGGSVAASAIVGYTVDFFGWDGGFMVMIGGSILAVILLVVVMIGEKRHHDELQLKRNGG

SEQ ID NO: 55798 - DNA, 1329 bp, Salmonella enterica subsp. enterica serovar Typhi Ty2
  CDS (1)..(1329): transl_table=11
atgctttcgtttttaaaagccccggccaacgcgccgctcatcaccgataagcacgaggttgacgcccgctatcgctactggcggcggtatatcctgatcaccatttggttgggttacgcgctgttctatttcacccgtaaaagctttaacgccgccgcgccggaaatccttgccagcggtattctgacccgcagcgatatcggcctgctggcgacgctgttttacatcacctacggggtgtcgaaatttgtctccggcatcgttagcgatcgctctaacgctcgctattttatgggcatcgggctgattgcgaccggcgtagtgaatattctgttcggcttctcgacctcgctgtgggcctttgcgctgctatgggcgctgaacgcctttttccaggggtttggatcgccggtttgcgcccgtttgctgactgcctggtactcgcgtaccgagcgcggcggctggtgggcgttatggaacaccgcgcataatgtcggcggggcgctgatccctctcgttatggccgctgtcgccctgcattatggctggcgcgtcgggatgatggtggccggattgcttgccatcggggtgggcatggtcctctgctggcggctgcgcgaccgtccgcaggcgattggtttaccgccggtaggcgactggcggcacgatgcgctggaggtcgcccaacagcaagagggcgcgggactaagccgcaaagaaatcctcgctaaatatgtgctgtcgaatccctatatctggctgctttcgttgtgttatgtcttagtgtacgtggtgcgcgcggcgatcaacgactggggcaacctgtatatgtccgagacgctgggcgtggatttggtcacggccaacacggcagtatcgatgtttgagttgggtggatttatcggcgcgctggtggcgggttggggctcggacaaactcttcaacggcaaccgcggaccgatgaatttaatcttcgctgccgggattttgctctctgtgggttcgctgtggctgatgccgttcgccagctacgtcatgcaggcggcctgtttcttcaccaccggtttctttgtcttcggcccgcagatgctcattggcatggcggcggcggagtgctcgcataaagaggcggcgggcgcagccaccggctttgtcggcctgttcgcctatctcggcgcgtcgctttccggctggccgttagcgaaagtgctggagatctggcactggaccggtttttttgcggtcatcgccatcgcggcggggatctccgcgctattgctgctgccatttctgaacgcccaggccccacgcgagacccacgaagcgtga

SEQ ID NO: 55799 - protein, 442 aa, Salmonella enterica subsp. enterica serovar Typhi Ty2
MLSFLKAPANAPLITDKHEVDARYRYWRRYILITIWLGYALFYFTRKSFNAAAPEILASGILTRSDIGLLATLFYITYGVSKFVSGIVSDRSNARYFMGIGLIATGVVNILFGFSTSLWAFALLWALNAFFQGFGSPVCARLLTAWYSRTERGGWWALWNTAHNVGGALIPLVMAAVALHYGWRVGMMVAGLLAIGVGMVLCWRLRDRPQAIGLPPVGDWRHDALEVAQQQEGAGLSRKEILAKYVLSNPYIWLLSLCYVLVYVVRAAINDWGNLYMSETLGVDLVTANTAVSMFELGGFIGALVAGWGSDKLFNGNRGPMNLIFAAGILLSVGSLWLMPFASYVMQAACFFTTGFFVFGPQMLIGMAAAECSHKEAAGAATGFVGLFAYLGASLSGWPLAKVLEIWHWTGFFAVIAIAAGISALLLLPFLNAQAPRETHEA

SEQ ID NO: 55800 - DNA, 1392 bp, Salmonella enterica subsp. enterica serovar Typhi Ty2
  CDS (1)..(1392): transl_table=11
atgctggccttcttaaaccaggtgcgcaagccgaccctggatctgccgctcaatgtgcggcgtaaaatgtggttcaagtcgttcatgcagtcctatctggtggtttttatcggctacctgaccatgtacctgatccgcaaaaactttaacatcgcgcagaacgacatgatctctacctacaggttgagcatgaccgagctggggatgattggcctgggcttctcgatcacctacggcgtggggaaaacgctggtttcctactacgctgacggtaaaaataccaagcagtttctaccgtttatgttgatcctctccgctatctgtatgctcggcttcagcgccagcatgggcgcggggtcaaccagtctgtttctgatgatcgctttctatgccctgagcggtttcttccagagtaccggcggatcgtgcagctactcgaccatcaccaaatggactccgcgtcgtaaacgcggcacctttctcggcttctggaatatctcccacaacctcggcggcgcgggcgcggcaggcgtggcgctgttcggcgccaactacctgttcgacggtcacgtcatcggcatgtttatcttcccgtcgattatcgcgctgattgttggctttatcggtctgcgtttcggcagcgactccccggaatcttacggtctgggtaaagctgaagaactgttcggcgaagagatcagcgaagaggataaagagactgaagaaaacgaaatgaccaagtggcagatctttgttgaatatgtgttgaaaaacaaagtgatctggctgctgtgtttctccaatatcttcctgtatgtggtgcgtattggtatcgaccagtggtcaaccgtctacgccttccaggaactgaaactttctaaagaggtggcgattcagggctttaccttgtttgaagtgggcgcgctggtcggcacgttgctgtggggctggctctctgacctggcgaacggtcgtcgcgcgctggtagcctgtgtggcgctggcgttgatcatcgctaccctcggcgtctaccagcacgccagcaaccagtatgtctatctggcctcgctgttcgcgctcggtttcctggtgtttgggccgcagctattaattggtgtggcggctgtcggtttcgtaccgaaaaaagccatcggcgctgcggacggtatcaagggcaccttcgattatcttatcggcgatagctttgctaagctgggtctgggcatgattgccgacggcacccccgtttttggtctgaccggttgggcgggtaccttcgccgcgctggacgctgccgcgatcggctgtatctgcctgatggcgatggtcgccgtgatggaagagcgcaaaatccgccgtgagaaaaaaattcagcaagtcaatatcgcttaa

SEQ ID NO: 55801 - protein, 463 aa, Salmonella enterica subsp. enterica serovar Typhi Ty2
MLAFLNQVRKPTLDLPLNVRRKMWFKSFMQSYLVVFIGYLTMYLIRKNFNIAQNDMISTYRLSMTELGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRFGSDSPESYGLGKAEELFGEEISEEDKETEENEMTKWQIFVEYVLKNKVIWLLCFSNIFLYVVRIGIDQWSTVYAFQELKLSKEVAIQGFTLFEVGALVGTLLWGWLSDLANGRRALVACVALALIIATLGVYQHASNQYVYLASLFALGFLVFGPQLLIGVAAVGFVPKKAIGAADGIKGTFDYLIGDSFAKLGLGMIADGTPVFGLTGWAGTFAALDAAAIGCICLMAMVAVMEERKIRREKKIQQVNIA

SEQ ID NO: 55802 - DNA, 1347 bp, Bacteroides thetaiotaomicron VPI-5482
  CDS (1)..(1347): transl_table=11
atgctgaaacatcttataaatttttacaaggtctcttcaccggggccttgtaacggagacgttatgtcttcatccggcaagcgtcggttgaaatatctgcaatggtctacctttctttcggcaactttcggatacggtatgtattatgtctgccggttgagcttgaatgtagtaaagaaaccgattgtagacgagggaatcttttctgaaacggaactcggaataatcggttcggtgctgttctttacgtatgcggtgggtaaatttacgaatggatttctggcagatcgaagtaatataaatcgttttatgactaccggcctgcttgttaccgcattgattaatctttgtctcggtttctcccattcatttattttgtttgctgttctttggggagtcagcggctggtttcagtctatgggggctgcttcgtgtgtagtcggactttcccgttggttcacggataaagaacgtggctcttattatggcttttggtccgccagtcataatattggtgaagcactgacatttataattgtagcatctattgttagtgtttgcggctggcgttatggtttctttggggcgggtatggtaggattgctgggggcattaattgtatggcgtttttttcatgacagtcccgaaagcaagggctttcctccggtcaatgttccgaaagaaaagaaaacgatgagtgcttccgaaacgacagattttaataaagctcaacggcaggttctgacaatgcctgctatctggatccttgctttatcaagtgcatttatgtatatcagccgatatgcggtaaacagttggggagttttttatttggaagcacagaaaggatattccactttggatgccagtttcattatttccattagttctgtttgtggtattatcggcactatgttttccggtgtaatttctgataaactgtttggtggccggcgtaatgttccggctttgattttcggactgacgaatgttttagcattatgtttgttcttattagtgccaggggtacacttttggctcgatgctgtggcaatgatcctctttggactgggcatcggagtactgatttgtttcttaggtgggctgatggctgttgatattgctcctcgcaatgcttcgggagctgctttgggagttgttggaattgccagttatatcggagctgggctgcaagatgtcatgagcggagttttgattgaaggacataaaacgatccggagtggggtagaggtttacgactttacttatatcaattggttttggatcggatcggctatattgtcggtatttttcgctttatgggtgtggaatgcgaagcaaaaataa

SEQ ID NO: 55803 - protein, 448 aa, Bacteroides thetaiotaomicron VPI-5482
MLKHLINFYKVSSPGPCNGDVMSSSGKRRLKYLQWSTFLSATFGYGMYYVCRLSLNVVKKPIVDEGIFSETELGIIGSVLFFTYAVGKFTNGFLADRSNINRFMTTGLLVTALINLCLGFSHSFILFAVLWGVSGWFQSMGAASCVVGLSRWFTDKERGSYYGFWSASHNIGEALTFIIVASIVSVCGWRYGFFGAGMVGLLGALIVWRFFHDSPESKGFPPVNVPKEKKTMSASETTDFNKAQRQVLTMPAIWILALSSAFMYISRYAVNSWGVFYLEAQKGYSTLDASFIISISSVCGIIGTMFSGVISDKLFGGRRNVPALIFGLTNVLALCLFLLVPGVHFWLDAVAMILFGLGIGVLICFLGGLMAVDIAPRNASGAALGVVGIASYIGAGLQDVMSGVLIEGHKTIRSGVEVYDFTYINWFWIGSAILSVFFALWVWNAKQK

SEQ ID NO: 55804 - DNA, 1368 bp, Chlamydophila caviae GPIC
  CDS (1)..(1368): transl_table=11
atgaatatttggaccagattctttcagcctcccaagcacattaaagaacttgatgatccagaattagtcaaaaaacagtacaagtattggagaattcgcatcttctacagcatgtttatagggtatgtcttctattatttcacaaggaagagttttacctttgccatgcctacgctgatgacagaccttggttttgataaagcacaactagggatcattggtagtactttgtacatcagttatggcatcagtaagtttgttagcggcgttatatctgatcagtccaaccctcgttacttcatggcgttgggtttaattatcacagggctcactaacatctttttcggaatgtcctcctctattcttttattcgctttatggtggggacttaatggttggtttcaaggatggggatggcctccttgcgctcgtttattaactcactggtactcaaaatccgaaagagggacttggtggagtgtatggagcacatcacataatattggtggtgctttaattcctattcttacagggtttgctattgattgctgtggttggcgtggggcgatgtttattccaggtgccctatgtattatgatgggatttgttttaatcaaccgtcttcgtgatacgccacaatctttaggccttccagctattgaaaaatatagaaaagcacaaaaggctaaaaaacacgaaaagacaacagcagatatcctagaagaagaagctgaaaaagaattatccactagagaaatcctcttcacctatgtcttgaagaacaaatggatctggttattatcttttgcttcatttttcatttatgttgtccgtatggctgtaaatgattggagcgcgttattcttaatcgaaacaaaacgttatgttgctgtaaaggccaacttctgcgtttctctatttgagatcggcgggcttttcggtatgttaattgctggatggttatctgataagatttccaagggcaagcgcggtccgatgaatgttgtattttctttaggactcttatttgcaattttaggcatgtggtatggccgagatcaagatatgtggtggttagacggcaccctgctctttgttatcggtttcttcttatttggtccccaaatgatgattggtttagcagctgctgaattatcccataaaaaagctgcgggtaccgctagcggtttcgcaggttggtttgcttatttcggagcagcatttgcaggttatccattaggaaaaatagctcaggattggggatggaaaggatttttcattgctcttctaagctgtgctttaattgctttggttttattcctacctacatggaatgcctccgagagaagtttacagactaaaaaataa

SEQ ID NO: 55805 - protein, 455 aa, Chlamydophila caviae GPIC
MNIWTRFFQPPKHIKELDDPELVKKQYKYWRIRIFYSMFIGYVFYYFTRKSFTFAMPTLMTDLGFDKAQLGIIGSTLYISYGISKFVSGVISDQSNPRYFMALGLIITGLTNIFFGMSSSILLFALWWGLNGWFQGWGWPPCARLLTHWYSKSERGTWWSVWSTSHNIGGALIPILTGFAIDCCGWRGAMFIPGALCIMMGFVLINRLRDTPQSLGLPAIEKYRKAQKAKKHEKTTADILEEEAEKELSTREILFTYVLKNKWIWLLSFASFFIYVVRMAVNDWSALFLIETKRYVAVKANFCVSLFEIGGLFGMLIAGWLSDKISKGKRGPMNVVFSLGLLFAILGMWYGRDQDMWWLDGTLLFVIGFFLFGPQMMIGLAAAELSHKKAAGTASGFAGWFAYFGAAFAGYPLGKIAQDWGWKGFFIALLSCALIALVLFLPTWNASERSLQTKK

SEQ ID NO: 55806 - DNA, 1350 bp, Bacillus cereus ATCC 14579
  CDS (1)..(1350): transl_table=11
atgttttttacacaattatttaaacctgcgccccacgcggaacgcttaccagctgatcgcgttgatagcgaataccgtaaattacgtttacaagtattcttaggtatcttcatcggttatgcaggctactactttgttcgaaaaaacttttcactagcaatgccatacttaatcgagcaaggctttagtaaaggggaacttggggttatcctttcagcagtttctattgcttacggattaagtaaatttcttatgggtatcgtatccgatcgttgtaatcctcgctactttttagcagctgggctatttttatcaggtatcattaatattattttcggctcattttctttcattacaacgagcattatacttatgtttgtacttcagtttttaaatggatgggtacaaggtatgggatggcctccttgtggtcgtacgatggttcactggttctctattagcgaacgtggtacaaaaatgtctatttggaacgtcgctcataatgttggcggagcgcttatgccttcccttgtaacattaggcttatacttcttcgcagatgactggaaaagtattttttacttcccaggtattctttcaattttagttggtatttatgtattaattacgatgaaagatacacctcaatcttgtggactaccttctattgaagaacatactggggaatatccaccagatgaaaaagtaaaagatcgcgaacgcgaactttcagtaaaggaaattttatttaaatacgtattaaacaataagtttttatggtacatcgctattgcgaacgttttcgtatatttcgtacgttacggcgttgtagactgggctcctacttatttagtagaagaaaaaagctttactcatagtagctcacgtactgcttacgctctatatgaatgggctggtattccaggtacacttctttgcggatggatgagtgataaactatttaaaggacgtcgtgcacctgctggtattctatttatggttggtgtatttatcgcagttcttgtttactggttaaaccctcctggtaatccaatggttgatagtatcgcacttgtcgcaattggatttttaatttacggaccggttatgttaattggtctacacgctctagatttagcaccaaagaaagctgctggaactgcagcaggcttaactggattcttcggttacttaggcggagcagctttcgctagtgcagctatgggctttatcgtagatgcattcggatgggatggcggattcatcttattacttgcatcttgcgtacttgcaatgttcttccttgctcttactttaaatacagggtcagtaaaatcaaaacaagcttaa

SEQ ID NO: 55807 - protein, 449 aa, Bacillus cereus ATCC 14579
MFFTQLFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFADDWKSIFYFPGILSILVGIYVLITMKDTPQSCGLPSIEEHTGEYPPDEKVKDRERELSVKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLNTGSVKSKQA

SEQ ID NO: 55808 - DNA, 1335 bp, Bacillus cereus ATCC 14579
  CDS (1)..(1335): transl_table=11
atgtttaaatggctcaagccagcacctgcaattgaaagattgccagcggatatgatcgatcatgtatatcgattactacgtattcgtgtgttaatcgggatttcagttggatatgctgcttattatttagttcgtagtaactttacgttatcaagtacgtatttagtacaagaatatggttttagtacagctgaaattggtctactaggctcagtaatggcaattgtttatggatttagtaagttctttatggggaatttatcagataaagctttcgcccagcgctttatcgcagtcggtttattcttatcagggcttgtaaatatttgtttcggctttgcatcatcatttgggatgattgttacattacttgttgttaacggtattgtacaaggtatgggagcaccaccttgtagtattgttatgacgaaatggttctcgaagaaagaacgtggtacgaaaacaggtctttggaatatttcacataacgttggtggaatgcttgtgccaccacttgtcggaattggtgtaggtattttcggtgaaaatcattggcaaggcggcgtgtttattttccctgcgattatcgcaatggtaattgcagtacttgtttggatcaatgcgaaggatacaccagaatctgaaggtcttcctccaattgatgagtatcgtaatgactatgaaaatcttgaaaaggcagataatgctaacaagatgtcaccaaaagaaattttaatgaagtatgtagtgaaaaataaatttgtatggttcttatgtattgcgaatgcttttgtttatttaattcgtttcggtgttattaactgggttccactttatttaacgacagttaaaggattttcaaaagcagaagcgcatgcggcatatgcaatctttgaaggtatggcaattccaagttcattaatcgttggttttttaagtgataaattatttaaaggaaaacgtatgccattatgtattattagtatggttggagttgttattggtacgtttatatattggcaagcaactagcgtacttgttgtaagtattgcagtttctattatcggttgtttaatttatgtaccacagttcttaatcggtttaagtgcgatggaattagtaccgaaatttgcagtaggtacgacagttggtatgtgtggtctattcggttatgtaggcggaagtcttgtagctaacgcagcaattggtgttattgttgatagttctggctgggatggttgtttcatcttactattaacaggagcaattttatcaacagtcttcttatttattgttcaacgtggacatgagagaaaagatcctaaagtagcataa

SEQ ID NO: 55809 - protein, 444 aa, Bacillus cereus ATCC 14579
MFKWLKPAPAIERLPADMIDHVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKAEAHAAYAIFEGMAIPSSLIVGFLSDKLFKGKRMPLCIISMVGVVIGTFIYWQATSVLVVSIAVSIIGCLIYVPQFLIGLSAMELVPKFAVGTTVGMCGLFGYVGGSLVANAAIGVIVDSSGWDGCFILLLTGAILSTVFLFIVQRGHERKDPKVA

SEQ ID NO: 55810 - DNA, 1404 bp, Shigella flexneri 2a str. 301
  CDS (1)..(1404): transl_table=11
ttgcgacaattggttatcagtattacagaaggattaaatatgtcattattcacagaacctaaggaaattgaaagattaccctctgaagagattgaacgattatatcccgtcctgcgatacagggtctttatcagcattttcctcggatatatggggtattattttgtccgaaacaccaccagtgtgttatccggtgtgctgcacatgtctgcaaccgagatcggcattatctcctgtgccggttttttatcctatggtatatcaaagtttgtttccggacttatttctgacagaagtaattcaaaagtatttttgtctcttggtttattcctgtccggactggtaaattttctgataggatatattcccgggatcatcacatccgttacgttattttcaacaatgtatttacttaacggctggatccaaggtatgggatatcctcctggtgccaaaacactggtgttctggtatgaacatcgggaaaggatcacctgggccacactgtggaatttatcgcacaatgtcgggggagctctggcccccgttctgattggtttcagttttggttttttcggcgacagtgctctggatcatgcccgggccgcatttatcttcccaggagtactgtgtatggcaatgagtgtgctgatttactttattcaggtggacagacctgtatcagtggggcttcctcccattgaagaatggaaaggtaacgtcgtttcacacccggctaaaggccgtgaacaaggtccgagactctccattcctgatatcatcagaaaacatatcatccgaaataataaactcatttactgctgtatctatggttcgtttgtttatattctgagatacggtattgtttcctgggctcctaagtttttaagtgacagtctggatgtcggtggtaaggatatgggaaaactggcatcaatgggggggggttctgtttttgaaatcggtggtgtggctggtatgcttcttgccggatacctgtctgtcagactgttcagaaactcaaaaccattaacaaatactttatttctggcacttaccattattttattaatcgcgtactggtacgtgccatcaggcaatgaatatctctggctaaactatacaatccttattctgttggggctggcagtgtatggtccggtgatgtttattggtctttattcaatggagcttgttcctaaagaagctgccggagccgcatcagggctgtcaggcacattttcctatatcttcggctcaattgttgcgacactgggaatgggacttgttgtcgattatctgggatggggggccacatttatcgtactgatactgtctgctgtttttgccatcattttcacactgatgagtcgtgaacgctcactggagttcgaaaaagagtaa

SEQ ID NO: 55811 - protein, 467 aa, Shigella flexneri 2a str. 301
MRQLVISITEGLNMSLFTEPKEIERLPSEEIERLYPVLRYRVFISIFLGYMGYYFVRNTTSVLSGVLHMSATEIGIISCAGFLSYGISKFVSGLISDRSNSKVFLSLGLFLSGLVNFLIGYIPGIITSVTLFSTMYLLNGWIQGMGYPPGAKTLVFWYEHRERITWATLWNLSHNVGGALAPVLIGFSFGFFGDSALDHARAAFIFPGVLCMAMSVLIYFIQVDRPVSVGLPPIEEWKGNVVSHPAKGREQGPRLSIPDIIRKHIIRNNKLIYCCIYGSFVYILRYGIVSWAPKFLSDSLDVGGKDMGKLASMGGGSVFEIGGVAGMLLAGYLSVRLFRNSKPLTNTLFLALTIILLIAYWYVPSGNEYLWLNYTILILLGLAVYGPVMFIGLYSMELVPKEAAGAASGLSGTFSYIFGSIVATLGMGLVVDYLGWGATFIVLILSAVFAIIFTLMSRERSLEFEKE

SEQ ID NO: 55812 - DNA, 1437 bp, Haemophilus ducreyi 35000HP
  CDS (1)..(1437): transl_table=11
atgtttggtccatttaaaccatctcctcatattacggagttaccctcaaataaaatagatgcaagatataaattcttacgttggcaagtttttgcgggtatcttctttggctatgctgcttattattttgtacgtgctaatttcgatttagcacaaaaagggctaattgaagcaggcctttataataaagctgaactaggtattatcggaaccagtgccggtttagcatatggtttatcaaaatttgtgatggctggtatatcagatcgctctaatccaaaagtatttttgccgtttggtttgttgctttctgacttatgtatgaccatgatggggttaatgccttgggtaacttcgggcattgcggtaatatttattatgattttcttaaatggttggttccaaggtatgggttgcggtagaactatggtgcattggtggtctaaatctgaacgcggtactattgtgtctatttggaattgtgcacataatgtcggtggtatggtgccgggtgcgatggtgctattagcaagtgcaatttattttagtaatactggtgagcatgcaacggcgaaagatgtatggcaacaagcgctctattatccgggtattgctgcaatgattgccgctattcctgtatatttggtgatgaaagatacgccacaatcttgtggcttgccgccaatcgaaaaatggaaaaacgattacccagatgattatgatgaaaaaaccgctgagcaagatttaaccactaaagagatttttgttaattacgtattaaaaaataaattattgtggtatatcgctattgctaatgtgtttgtctatttaattcgttacggtattttgaaatggtctcctgtttatttaggtgaagtgaaacatttcaatataaaagggaccgcttgggcttatacaatttatgaattagccgctattcctggtactttattatgcggttggatatctgataaagtgttcaaaggtaaacgtggtttgactggttttattttcatgatcttaacgactatcgcggtaattgcattgtggaaaaatccggctacacctgaagcagaattagcacaatatgcaggtcgtcctttctatgataatccatatcaattaatggactttactttaatgactaccgttggtttcttaatctatggtcctgtaatgttaatcggtttacacgcccttgaattagcacctaaaaaagcagccggtacttcagcgggcttcacggggttatttggttatttaggcggtacggtttctgcatcagcggttgttggttgggctgcggaatactatggctgggatggcggtttctatgtaatgattacaggcggtatcttagctgtgttattgatgtttattgtgatggttgaagaaggcaaacataaagccaaattagaagaccattatggtaaataa

SEQ ID NO: 55813 - protein, 478 aa, Haemophilus ducreyi 35000HP
MFGPFKPSPHITELPSNKIDARYKFLRWQVFAGIFFGYAAYYFVRANFDLAQKGLIEAGLYNKAELGIIGTSAGLAYGLSKFVMAGISDRSNPKVFLPFGLLLSDLCMTMMGLMPWVTSGIAVIFIMIFLNGWFQGMGCGRTMVHWWSKSERGTIVSIWNCAHNVGGMVPGAMVLLASAIYFSNTGEHATAKDVWQQALYYPGIAAMIAAIPVYLVMKDTPQSCGLPPIEKWKNDYPDDYDEKTAEQDLTTKEIFVNYVLKNKLLWYIAIANVFVYLIRYGILKWSPVYLGEVKHFNIKGTAWAYTIYELAAIPGTLLCGWISDKVFKGKRGLTGFIFMILTTIAVIALWKNPATPEAELAQYAGRPFYDNPYQLMDFTLMTTVGFLIYGPVMLIGLHALELAPKKAAGTSAGFTGLFGYLGGTVSASAVVGWAAEYYGWDGGFYVMITGGILAVLLMFIVMVEEGKHKAKLEDHYGK

SEQ ID NO: 55814 - DNA, 1344 bp, Chromobacterium violaceum ATCC 12472
  CDS (1)..(1344): transl_table=11
atgatcagcctgttcaaacccgcgccacaccttcccccgctgcccgacgcgcagcagcacggcctgtaccgccggctgcgctggcagatcttcctcggcattttcatcggctacgccggctactacctggtccgcaagaatttctcgctggccatgccttatctggtagagcagggcttttcgcgcggcgacctcggcttcgcgatgtccggcgtcgccatcgcctacggcctgtccaagttcctgatgggcgcggtgtccgaccgctccaacccgcgcgtgttcctgtccgccggcttggtgctgtccgccgccgtgttcctgctgatgggcttcgcgccgtgggccacttccagcgtcggcgtcatgttcgtgctgctgttcctcaacggctggtttcagggcatgggctggccggcctgcggccgcaccatggtgcactggtggtcgcagaaggagcgcggcggtgtggtgtcgatctggaactgcgcgcacaacgtcggcggcggcctgatcggcccgctgttcatcctgggcatgggctggttcaacgactggcgcgccgccttctacgtgccggccgccgccgcgatcggcgtcgccgtcttcgcctggctgaccatgcgcgacacgccgcagtcttgcggcctgccgccggtggaggcttaccggaacgactacccggaagactacagcgacaagcatgagcaggagctgaccgcgcgcgaaatcttccgcaaatacatcctgcccaacaagctgctgtggtacatcgcgctggccaacgtcttcatctacctgctgcgctacggcgtgctggactgggcgccgacctatctgaaggaggtcaagcacttctcggtcgacaagtcgtcgtgggcctacttcctgtacgagtgggccggcattcccggcacgctgctatgcggctggatgtcggacaagctgttccgcggcaaccgcggcgccaccggcgtgttcttcatggcgctggtgaccctggccaccgtggtctactggctgaacccggccggcaaccccaccgtggacatgctggcgctgatcgccatcggcttcctgatctacggcccggtgatgctggtgggcctgcacgcgctggagctggcgcccaagaaggccgccggcaccgccgccggcttcaccggcctgttcggctacctgggcggctcggtggccgccaacgcggtggtgggctacaccgtcgaccatttcggctgggacggcggcttcgcgttgctgatcggctcctgcgtcgccgccatcgtgctgctggcgctgaccacctggcatggccatcaacagggcaagctggcttcggcttga

SEQ ID NO: 55815 - protein, 447 aa, Chromobacterium violaceum ATCC 12472
MISLFKPAPHLPPLPDAQQHGLYRRLRWQIFLGIFIGYAGYYLVRKNFSLAMPYLVEQGFSRGDLGFAMSGVAIAYGLSKFLMGAVSDRSNPRVFLSAGLVLSAAVFLLMGFAPWATSSVGVMFVLLFLNGWFQGMGWPACGRTMVHWWSQKERGGVVSIWNCAHNVGGGLIGPLFILGMGWFNDWRAAFYVPAAAAIGVAVFAWLTMRDTPQSCGLPPVEAYRNDYPEDYSDKHEQELTAREIFRKYILPNKLLWYIALANVFIYLLRYGVLDWAPTYLKEVKHFSVDKSSWAYFLYEWAGIPGTLLCGWMSDKLFRGNRGATGVFFMALVTLATVVYWLNPAGNPTVDMLALIAIGFLIYGPVMLVGLHALELAPKKAAGTAAGFTGLFGYLGGSVAANAVVGYTVDHFGWDGGFALLIGSCVAAIVLLALTTWHGHQQGKLASA

SEQ ID NO: 55816 - DNA, 1326 bp, Photorhabdus luminescens subsp. laumondii TTO1
  CDS (1)..(1326): transl_table=11
atgcaagccaccagtcaggaacagatttcacaacactatcgccgctggcgcagccgtttgctgatttccatgatcattggctatgccgcattttatctgacgcgaaaaagcttcaactttgtcatgccggttatgcagttggaactgggactggataaaggacacattggctggataaccactctgttctatctggcttacggcagctcaaaatttatttccggtgtatttcatgatcgcaccggctatcgctggtttatgggtgccggattagtgatgacaggtgtgttaaacattatcttcgctttctgttcatcattttctgccctgctgatcatttggacactgaacggcttctttcagggctggggatggcccccctgcgccagattgctgacacactggtactcccgcaatgagcgcggcttctggtggggatactggaatatctccatcaatattgttggcattactgtcccaatgctgtccgcttttctggcgacaacttatagctggcaaacagcgctgatgatgccgggaattatcggcattttattaggcatctggctttgctatcagttatgtggcaccccacaacagcacggtttgcccagtgtaggacagtggcgacaggattcactggagcttcgacatgaacagctatcgcaccccatgccgatgatgcagatactgcgggataccatcttaactaacagaactatctggttgctaggatgctcctacattctggtttatctcatcagaatggcgattaacgattggggaaacctgtggttgtcagaaacacatggtgccaatctgctcagcgctaatgcgacgctctcactgtttgaactcggtggtttaaccggtgcgctattttccggttggggatctgatttactgttccgcggccaacgcgccccaatgattctgctgtttgctcttgggctatttatggctgtcaccgcattgtggctcactcccattcatcactacacgctgttggcagtctgttttttcagtatcggtttttttgtatttggcccgcaaatgctgattgggctggctgcaacagaatattgccataaacaagccgccggcaccgtcacgggttatctaggattgtacgcctatttgggcgcagcaatcgcaggctggccgctaagtcaggtggttgcccactacggctggtccgggatgtttgccctactcaccgccgcagccgccatgatgggtttgctgttgatgccaatgttaatggcagacgtgagtaaaagggaacatggagtagcatcgcgactttccaataataagcagttttga

SEQ ID NO: 55817 - protein, 441 aa, Photorhabdus luminescens subsp. laumondii TTO1
MQATSQEQISQHYRRWRSRLLISMIIGYAAFYLTRKSFNFVMPVMQLELGLDKGHIGWITTLFYLAYGSSKFISGVFHDRTGYRWFMGAGLVMTGVLNIIFAFCSSFSALLIIWTLNGFFQGWGWPPCARLLTHWYSRNERGFWWGYWNISINIVGITVPMLSAFLATTYSWQTALMMPGIIGILLGIWLCYQLCGTPQQHGLPSVGQWRQDSLELRHEQLSHPMPMMQILRDTILTNRTIWLLGCSYILVYLIRMAINDWGNLWLSETHGANLLSANATLSLFELGGLTGALFSGWGSDLLFRGQRAPMILLFALGLFMAVTALWLTPIHHYTLLAVCFFSIGFFVFGPQMLIGLAATEYCHKQAAGTVTGYLGLYAYLGAAIAGWPLSQVVAHYGWSGMFALLTAAAAMMGLLLMPMLMADVSKREHGVASRLSNNKQF

SEQ ID NO: 55818 - DNA, 1353 bp, Photorhabdus luminescens subsp. laumondii TTO1
  CDS (1)..(1353): transl_table=11
atgttaagtattttcaagccggcacctcataggtcccggctgtcaacagaacaggtagatccagtctatcgtcgcttacgttggcaaatttttatggggatcttctttggttatgcagcttactatctggtaagaaaaaactttgcacttgcaatgccttatctggttgagcaaggtttttccaaaggtgagctcggtttcgcactatcagggatctctatcgcatacggcttctccaaattcatcatgggctccgtatccgaccgttctaacccacgagtcttcttacctgcgggtctgatcctcgcggctcttgttatgctgtttatgggtttcgtaccctgggcaacgtccagtatcactatcatgtttgttctgctgttcttatgtggttggttccaggggatgggttggcctccttgtggtcgtaccatggtgcactggtggtcacagaaagaacgcggcggtatcgtttctatctggaactgctcacataatgtgggtggtggtttaccaccattgctatttctgttgggcatggcgtggttcaatgactggaaagccgcactttacatgccggctttcgccgccattctcgttgcattgattgtctttgccctgatacgtgacacaccgcaatcctgtggcttgccaccaatcgaagagtataaaaatgactatccttctgattatacagagaaagatgaaaatgagttaaccgctaaacagattttcatgcaatacgtgttaccgaacaaactgctgtggatggttgctatggctaacgtattcatttatctgttacgttacggtattcttgactggtcaccaacctatctgcgtgaagccaagcatttcgcactagataaatcttcatgggcttatttcctgtacgaatatgccggtatcccaggcacgctactatgtggttggatgtcagacaaaatatttaaaggtaaccgtggtgcaaccggtgtgttctttatgacgctggttactatcgcaactatcgtattctggttgaacccaccaggtaaccctactgtagatatggcttgtatgttgattattggcttccttatctacggcccagtgatgctgactggtttacatgcccttgagctagctccaaagaaagccgcgggtacagccgccggctttaccggcttatttggttacttaggtggctctgttgctgcaagtgctatcatcggctacaccgttgactttttcggttgggacagcggctttatggtaatgattggtggtagtatcttgtccgttattctattgctaatcgttatgattaccgaaaaaaaacataaacaggaaatagcccaccaatatggctaa

SEQ ID NO: 55819 - protein, 450 aa, Photorhabdus luminescens subsp. laumondii TTO1
MLSIFKPAPHRSRLSTEQVDPVYRRLRWQIFMGIFFGYAAYYLVRKNFALAMPYLVEQGFSKGELGFALSGISIAYGFSKFIMGSVSDRSNPRVFLPAGLILAALVMLFMGFVPWATSSITIMFVLLFLCGWFQGMGWPPCGRTMVHWWSQKERGGIVSIWNCSHNVGGGLPPLLFLLGMAWFNDWKAALYMPAFAAILVALIVFALIRDTPQSCGLPPIEEYKNDYPSDYTEKDENELTAKQIFMQYVLPNKLLWMVAMANVFIYLLRYGILDWSPTYLREAKHFALDKSSWAYFLYEYAGIPGTLLCGWMSDKIFKGNRGATGVFFMTLVTIATIVFWLNPPGNPTVDMACMLIIGFLIYGPVMLTGLHALELAPKKAAGTAAGFTGLFGYLGGSVAASAIIGYTVDFFGWDSGFMVMIGGSILSVILLLIVMITEKKHKQEIAHQYG

SEQ ID NO: 55820 - DNA, 1380 bp, Vibrio vulnificus YJ016
  CDS (1)..(1380): transl_table=11
atgcttaatttctttaaaactcgtccggatgtgccgttatcagacagctccaacgagggaatgctaaagcgctacaagagctaccaatggcaggtattcttaggccttatttttggttacgccgtcttttacgtagtacgtatgagtttgggtgttgtgaaaaagcccatgctcgatgcgggcatcgtgaccatcgaagaactcggtatcatgggttcggcgttcttcttcacttacgccttcggtaagttcttaaacggcttcctatctgactacgccaacattggccgctttatgtcgtgttccctactggtatcgggtgtactctcggtcgtgatggggatgaacaccgttggcttcttcttcgttctgctttggggcttaaacggttggttccaatcagtgggttcagcaccttcatgtgtatcgctttaccaatggttctcaccaaaacagcgtggtagccgttactccatttggggcggttcacgtaacatcggtgaaggtatcacttggatcctgacggcgacactagtgagctacttcggctggcgtgcaggtttcattggcgcgggtatcgctgcagtagttgctgcactgatcatgctgaaagtactgaaagaccgtccacaaacttacggcttgccagatccaggcacagcgtttggcgaaggtaccgaaatcaagaaagcgaacgacccaaaagaaacacgtcgtgcgcagatgtttatcctaaaacaacctgtggtatggcttattgccctgtcttgtgcggcaatgtacatctctcgctacgcaatgtcttcttgggcggtattgttcctacaagaaacaaaaggttactcactgattgacgcaggttttgccatgtcaatgtacccaacagccggtctagcgggtgcgattctgtcaggtatcctttcagacaaagtgttcaaaggtaaccgtaacatccctaacctactgtacggattggcaaacattgccggtatgtgtttgatgttctttggcccagataaccgtgttatcgacgcagtggcactgagcatgatcggcttctctatcggtggtctagtggtattcctcgcgggtctgattgcttgtgacctgatgccgaaaaacgcggttggtgcggtaaaaggtttgatcggtctgtgttcttacattgcagcgtcagctcaagagcttatctctgcatctctgatcaccatcactgaagtcgatggcgtaaaacactacgactttggtaacgctcagtacttctggcttgccgctggtgtggtatcagtactactcgcactgacggtatggaacgcgaagaaagtggtcgatatcgacgaagaacaagacaaaaagctacaaacacgcacagcttcttaa

SEQ ID NO: 55821 - protein, 459 aa, Vibrio vulnificus YJ016
MLNFFKTRPDVPLSDSSNEGMLKRYKSYQWQVFLGLIFGYAVFYVVRMSLGVVKKPMLDAGIVTIEELGIMGSAFFFTYAFGKFLNGFLSDYANIGRFMSCSLLVSGVLSVVMGMNTVGFFFVLLWGLNGWFQSVGSAPSCVSLYQWFSPKQRGSRYSIWGGSRNIGEGITWILTATLVSYFGWRAGFIGAGIAAVVAALIMLKVLKDRPQTYGLPDPGTAFGEGTEIKKANDPKETRRAQMFILKQPVVWLIALSCAAMYISRYAMSSWAVLFLQETKGYSLIDAGFAMSMYPTAGLAGAILSGILSDKVFKGNRNIPNLLYGLANIAGMCLMFFGPDNRVIDAVALSMIGFSIGGLVVFLAGLIACDLMPKNAVGAVKGLIGLCSYIAASAQELISASLITITEVDGVKHYDFGNAQYFWLAAGVVSVLLALTVWNAKKVVDIDEEQDKKLQTRTAS

SEQ ID NO: 55822 - DNA, 1377 bp, Vibrio vulnificus YJ016
  CDS (1)..(1377): transl_table=11
atgtttggtatattcaaacctaaggcgcatatcgatcgcgtttccagcgactcgctcgacagcacctactcacgtctacgctggcaattgttcatcggtattttcgtcggctacgctggctactaccttgtccgtaagaactttagtttggcgatgccctacctgattgagcaaggctttagccgtggcgatcttggtgtggctttggccgccgtctccattgcttatggtctgtctaagtttctaatgggcagcgtctctgaccgttctgatcctcgctatttcttaagtgcgggtttggtgatgtcttccttggtcatgttctgcttcggctttatgccatgggcaactggcagcatcacggcaatgtttatcttgctgttcctcaacggatggttccaaggtatgggttggcctgcgtgtgggcgcaccatggtgcactggtggtcacgtaaagagcgtggtgagatcgtttcagtgtggaacgtggcacacaacgtcggtggtggcttgattggtcctatcttcctatttggtttgtggatgtttaatgatgactggcgcactgcgttttatgtgccggcatttttcgccatgatcgtcgcagtattcatctggctcaccgtgcgtgatactccacaatcctgtggcctaccgccaattgaagagtacaaaaacgactacccagatgattacaacacgtctcatgaaacagagatgaccgcaaaagaaattttctttaagtatgtattttcaaacaaacttttgtggtcgatagctattgctaatgctttcgtttatttgattcgttacggtgtattggactgggcgccagtgtacttaaaagaagcgaaagagttcacggtagataaatcatcttgggcttacttcctatacgaatgggcgggtattccaggcacgctattgtgtggttggatttcagataaactgttcaaaggccgccgcgcaccagctggcatcctatttatgttccttgtcactctggcggttcttgtttactggtttaacccagcgggcaacccaggtattgatatggcggcgctggtagcaatcggcttcctgatctacggtcctgtcatgcttatcggcctttatgcgcttgagcttgctccgaagaaagcggcaggtacagcagcaggtttgactggtctatttggttacctagggggcgccgtggcagccaacgcagtattaggttacaccgtagaccatttcggctgggatggcggcttcattattctggttggttcttgtatcacttctatcgtttgtttgacttacgcattgctgggtgaaaaagcccatcatgatgccaaacagaaagagaaggaaaaagaacaagaagccatcgcgtaa

SEQ ID NO: 55823 - protein, 458 aa, Vibrio vulnificus YJ016
MFGIFKPKAHIDRVSSDSLDSTYSRLRWQLFIGIFVGYAGYYLVRKNFSLAMPYLIEQGFSRGDLGVALAAVSIAYGLSKFLMGSVSDRSDPRYFLSAGLVMSSLVMFCFGFMPWATGSITAMFILLFLNGWFQGMGWPACGRTMVHWWSRKERGEIVSVWNVAHNVGGGLIGPIFLFGLWMFNDDWRTAFYVPAFFAMIVAVFIWLTVRDTPQSCGLPPIEEYKNDYPDDYNTSHETEMTAKEIFFKYVFSNKLLWSIAIANAFVYLIRYGVLDWAPVYLKEAKEFTVDKSSWAYFLYEWAGIPGTLLCGWISDKLFKGRRAPAGILFMFLVTLAVLVYWFNPAGNPGIDMAALVAIGFLIYGPVMLIGLYALELAPKKAAGTAAGLTGLFGYLGGAVAANAVLGYTVDHFGWDGGFIILVGSCITSIVCLTYALLGEKAHHDAKQKEKEKEQEAIA

SEQ ID NO: 55824 - DNA, 1428 bp, Vibrio vulnificus YJ016
  CDS (1)..(1428): transl_table=11
gtgtacgacacaatgacaagagagttcacaatgttaaaattccttgaacaagtgcggaagccgaccctcgaccttccagtcgaagtaagacgcaaaatgtggtttaagccgtttatccaatcttaccttgtggtatttattggttacttgaccatgtacttgatccgtaaaaacttcaacgtcgcgcaaaacgatatgatctccacttacggtttaagcatgaccgatttgggtctgattggtcttggtttttcgattacttacggtatcggtaaaaccgtcgtttcctactacgctgacggcaaaaacactaagcagtttctccctttcatgctgatcctttctggtcttgccatgcttggtttcagcttcagcatgggcggtggcagcgccagcttgttcttgatggtggcgttctacgcactcagtggtttcttccaaagtacgggtggcccttctagttactcaaccatcacgaagtggacaccacgcaacaaacgtggttcttacctaggtctttggaacatgtcgcacaacgtgggtggtgccggtgcggctggtgttgccctgttcggtgctaactacctattcgatggccacgttattggtatgtttgtcttcccttctatcatcgccatcatcgttggtttcatcggcatgcgctttggtagtgactcacctgaggcttatggcctaggtaaagttgaagaactttttgatgaagccgtcagcgaagaagatactgcagctgaagaaaatcaaatgaccaagaaagagatctttgttgagtatgtactgaaaaacaaagtgatctggctactttgctttgccaacatcttcctttacatcgtgcgtatcggtatcgaccaatggtcaacggtttacgcgtaccaagaacttggtctatcaaaagaagcggcaatctccggttttaccctattcgaagtgggcgcactcgtcggtacgctaatgtggggttacctttctgacttggcgaacggtcgtcgtgctttagtggcgtgtgtgtctcttgctttgatcatcgtatcccttgagttctaccaacacgcaacaagcgaattcatgtacttagcatcgctatttgttcttggtttcctcgtgtttggtcctcaattgcttatcggtgttgctgcagttggctttgttccgaagaaagccatcagtgtggcggatggtgtaaaaggcactttcgcttacctaatcggtgacagctttgccaaacttggtcttggtatgattgcagacggtacaccaatctttggtttgaccggttggaaaggcaccttcgcggcactggatacctcagcgatgatttgtattgtccttcttgccttcgttgctatcgcagaagagaaaaagattcgacataacaagaagaaacttgaactcgcggccagccagtcttaa

SEQ ID NO: 55825 - protein, 475 aa, Vibrio vulnificus YJ016
MYDTMTREFTMLKFLEQVRKPTLDLPVEVRRKMWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAVSEEDTAAEENQMTKKEIFVEYVLKNKVIWLLCFANIFLYIVRIGIDQWSTVYAYQELGLSKEAAISGFTLFEVGALVGTLMWGYLSDLANGRRALVACVSLALIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHNKKKLELAASQS

SEQ ID NO: 55826 - DNA, 1341 bp, Vibrio vulnificus YJ016
  CDS (1)..(1341): transl_table=11
atgtttggactgtttcaatctccgagctacacacaagctcccttggacaaaagccaagttgatgaacgttatcgttactggcgactgcatatcatgatcggcatgtacattgggtacgcgggcttttatttcactcgcaaaaccttcaactacgccgcgcctgccatgattgttgatttgggtttagacaaaggcgatctcggtttaatcggcacgcttttctacatcacctatggcctatcgaagtttatctccgggacgatttctgaccgctctaatccacgttattttatgggtgtgggcctcatcgcctcagggattatcaatatcgtgtttggtttttccagctcactgattgcgctttccatcttgtgggtgctcaacgcttggttccaaggttggggatggccttcttgttccaaactcctcaccacctggtattcgcgttcagaacgcggctttttgtgggcaatttggaacaccgcccacaacgtgggtggcgcactgatcccattattggtcggctacctcacttttcatttcagttggcgtgaaggctttattgttcccggcattatcggcgtgttgcttggccttattgtttgctggcgattaagagacaaacccaccactcaggggctgcccaccgtcggtcagtggcgccatgacccgctcgaactggctcaagagaaacatggccaaggactaagctatcgcgaaattctcacgcactatgttttcaacaacaaatacatttggttactcgcttttagctatgtactggtttacatcgtgcgcaccgcaatcaatgactggggcaatctctaccttaccgagcaacaccattactctctgatcaacgccaacgcagcgctgtcgatgttcgagatcggtggctttgttggttctctcgtagcaggttggggctcggataaactgttcggtggtaaccgtggtccgatgaatctgctatttgccgctggtattttcttgtctgttgctgcgctgtggttaatgccgttaaccaactttgcctttcaagcggcggggttattctctattggcttcttcgtgtttggcccacaaatgcttatcggcatggcagccgctgagtgttctcacaaagattcagctggcgcagccacggggtttgttggtctgtttgcctacatgggcgcggcgttgtctggctacccacttgcactgattttggaagaatacagctggaccggtttcttcgtcaccatctctatctgtgcggcggtgatcggcttactgttgctgccctttcttcaagctcaaccgtctcgtaaaccactggcccccaaacttcgcttatag

SEQ ID NO: 55827 - protein, 446 aa, Vibrio vulnificus YJ016
MFGLFQSPSYTQAPLDKSQVDERYRYWRLHIMIGMYIGYAGFYFTRKTFNYAAPAMIVDLGLDKGDLGLIGTLFYITYGLSKFISGTISDRSNPRYFMGVGLIASGIINIVFGFSSSLIALSILWVLNAWFQGWGWPSCSKLLTTWYSRSERGFLWAIWNTAHNVGGALIPLLVGYLTFHFSWREGFIVPGIIGVLLGLIVCWRLRDKPTTQGLPTVGQWRHDPLELAQEKHGQGLSYREILTHYVFNNKYIWLLAFSYVLVYIVRTAINDWGNLYLTEQHHYSLINANAALSMFEIGGFVGSLVAGWGSDKLFGGNRGPMNLLFAAGIFLSVAALWLMPLTNFAFQAAGLFSIGFFVFGPQMLIGMAAAECSHKDSAGAATGFVGLFAYMGAALSGYPLALILEEYSWTGFFVTISICAAVIGLLLLPFLQAQPSRKPLAPKLRL

SEQ ID NO: 55828 - DNA, 1371 bp, Corynebacterium diphtheriae NCTC 13129
  CDS (1)..(1371): transl_table=11
atgtttgcttggttgcaagcccccggccctgctgccccgctgtcggcggagcaggtggatcgcacctacccacggatgcgtctgcaggtgttcatgggtattttcttgggctatgcgggtttttatttgatccgtaataatatttcggcgattgccccgttgcttattgatgaaagtggtgcgattgataagccggcgatcggcattattggtaatgctgtgttggtcagctatggcctgtctaagttctttagtgccatggtgtcggatcgttctaatgctcgctatttcttgccgctgggcttggcactgtcggcgctgatgaacttggtagttgcgtttgtgccgtgggtttcggccagcgtgggcgtgttcgctacggtgatgttccttaatggttggttccaaggcatgggttaccctccttgtggccgtattgtggtgcagtggttctctactagtgagcgcggttggaagggttcgttgtggaacacttctcacaacttgggtgcttttggtttgccagtgttggtcggtattggtttgagcatgacgggcgagaattggcgtgctgcttactggcttcctgcgttggttgctttggttgtcgcgttggttgcgttcttgcttattcgtgataatcctcagtctgttggtttgccgcctatcgacgactaccgcaacgatcctgcgaaggttgcggaggatacgggcgagaagatttcgacgaaggatttggtgttcaagcatattttgcacagccgcatcattatgctgttggccattgcgaatgtgtttgtttatgccttgcgttatggtgttttgcactggattaccacgtacttgtctgagcagcaccacatgagcattggtagcggtctgattggttttgctgctttcgagttggctggctttattggcacggttttgtgcggttggttgtcggacaatgtgtttaagggcaatcgttctgctgctatttcgttgttcaccttgggcgctggtttgtctatcgctgcatactggttggctcctgtgggtacgccgttctggttgatggttattttcgttgcctttattggtggttttatctacggtcctgttggcttgatcggtttgcaggcattggatctttcacctcgtaacgtggctggtaccgctgctggcttcacgggcttgttcggttacctgctgggtgcaaccttggcttcgactggtgtgggcttcttggttaagttcgctggttggaatgtcacgttcattgtgttcttggtctttacggttttgattctggttattttccaggtgatctggcgcgaggagaagaagttgatgcaggagcgtgctttgaagctcgagcagggtgtttag

SEQ ID NO: 55829 - protein, 456 aa, Corynebacterium diphtheriae NCTC 13129
MFAWLQAPGPAAPLSAEQVDRTYPRMRLQVFMGIFLGYAGFYLIRNNISAIAPLLIDESGAIDKPAIGIIGNAVLVSYGLSKFFSAMVSDRSNARYFLPLGLALSALMNLVVAFVPWVSASVGVFATVMFLNGWFQGMGYPPCGRIVVQWFSTSERGWKGSLWNTSHNLGAFGLPVLVGIGLSMTGENWRAAYWLPALVALVVALVAFLLIRDNPQSVGLPPIDDYRNDPAKVAEDTGEKISTKDLVFKHILHSRIIMLLAIANVFVYALRYGVLHWITTYLSEQHHMSIGSGLIGFAAFELAGFIGTVLCGWLSDNVFKGNRSAAISLFTLGAGLSIAAYWLAPVGTPFWLMVIFVAFIGGFIYGPVGLIGLQALDLSPRNVAGTAAGFTGLFGYLLGATLASTGVGFLVKFAGWNVTFIVFLVFTVLILVIFQVIWREEKKLMQERALKLEQGV

SEQ ID NO: 55830 - DNA, 1410 bp, Corynebacterium diphtheriae NCTC 13129
  CDS (1)..(1410): transl_table=11
atgttcagtgtgttcgatctcaagaaaatccctaacaaaggaataccactcgagcaacaacgcaagatgtggctgggacagttcctcaaggcgttcttcgtcgtgttcttcgtgtacatgtcgatgtacttcatcaggaacaacttcaaagccgcacagccgatgctcaaagaagacttcggcctcaccaccctccaactgggctacatcggcctcgccttctccatcacctacggcattggcaaaaccttggtcggctacttcgtagacggccacaactccaagcgcatcatctccactctgctgatctgcgcctccaccatggttctcctcatgggcctgctcctgagttacttcggctcagtcatcggcatcttcatcgtcttgtggggccttaacggtctattccaatccgctggcggccccgcctcctattcgacgatttctcgctgggcaccccgaaccaaacgcggcaaatacctaggcctatggaacgcctcccacaacgtcggtggcgcactcgccggtggcctagctctctggggcgctaacgtattcttcggcggcaacgtcgtcggcatgttcatcttcccagcactgatcggcctcaccatcggtatcatcggcctcttcgtcggcaaagacgaccccgaagaactgggctggaaccgcagcgaggaaatcttcggcgaagctgtggaagcagaaaactcccaggcagaaaccatgccccagcgcgaaatcttccttaactacgtgctgaaaaacccctggctgtggacactctgtatcgccaacgtcttcgtctacatcgtccgcattggtatcgacaactgggcaccgctctacgtcaccgaggaactccactttgacaagggcgacgccgtaaacaccatcttctacttcgagatcggcgcactggtggccagcctgctatggggctacgtctccgacctgctcaaaggccgccgcgccatcgtggcaatcggctgcctgttcatgatctacttcgccgtcatgctctaccgcaacgccagcagcgtcaccatggtgaacctctcgctgttcatcttgggcgcactgatcttcggcccccagctactcatcggtgtctcgctcgtcggcttcgtgcctaagcgcgcaatcagcgtggctaacggcatgaccggtactttcggctacctctttggcgactccatggccaaagtcggcctcgccgccatcgcagaccccgagcaaaaaggcctcaccgtcttcggacacctcctccacggatggggtgctgtctttaccgtcttctacttcgcactgaccatcggcatcgtattgctcatgatcgtcgccgtgggtgaagaacgccgcatccgcaagctccaagcagcagaggcggtaggcaaggcactcgcctag

SEQ ID NO: 55831 - protein, 469 aa, Corynebacterium diphtheriae NCTC 13129
MFSVFDLKKIPNKGIPLEQQRKMWLGQFLKAFFVVFFVYMSMYFIRNNFKAAQPMLKEDFGLTTLQLGYIGLAFSITYGIGKTLVGYFVDGHNSKRIISTLLICASTMVLLMGLLLSYFGSVIGIFIVLWGLNGLFQSAGGPASYSTISRWAPRTKRGKYLGLWNASHNVGGALAGGLALWGANVFFGGNVVGMFIFPALIGLTIGIIGLFVGKDDPEELGWNRSEEIFGEAVEAENSQAETMPQREIFLNYVLKNPWLWTLCIANVFVYIVRIGIDNWAPLYVTEELHFDKGDAVNTIFYFEIGALVASLLWGYVSDLLKGRRAIVAIGCLFMIYFAVMLYRNASSVTMVNLSLFILGALIFGPQLLIGVSLVGFVPKRAISVANGMTGTFGYLFGDSMAKVGLAAIADPEQKGLTVFGHLLHGWGAVFTVFYFALTIGIVLLMIVAVGEERRIRKLQAAEAVGKALA

SEQ ID NO: 55832 - DNA, 1362 bp, Danio rerio
  CDS (1)..(1362)
atgggagcagcaggttacggatattatcgcaccgttatattcatctccatgtttgcgggatacatgctttactacttcaaccggaagactttttcctttctgatgccatccgtgatggaggagattgagctggataaagaagagcttggactgatcaccagcagtcagactctggcctacgctatcagtaagttcatcagcggagtgctttcagaccggatcagcgctcgctggctcttctccatcggcctcttcattgttggtaccataaacatcgccttctcctgctcctccacggtcatgctgttcaccgtgctttggttcgtgaatggattcggtcagggctacggctggccaccgtgtggaaaggtgctccggaagtggtttgaaccgtcccagtttgggacgtggtgggccatcctatgctgcagtatgaatctggcaggtagtctgggccccatcatcactacagtgctggtccagtattatgactggagggtcatcatgtccgtgtctgggctgatctgcatggccgtcgctgttgtttgccttctgatggtcaaaaacgagcccagtgacgtcgggctgcccagcattcagcctggagctaaaaagggcaaggggaagaagggaggccctaatgatgaaagcagtctgaaggatttcctgctgtctccttacctgtgggttctgtctgccggatacctggttgtgtttggggtaaagatcgcctgcactgactggggtcagctgttcctcatgcaggagaaaggccagtctgccatgatgggcagctcgtacatgagtgcgctggaagttggtgggttttttggcagcattggagctggttatctgtctgacagggctgttgctaggcaagggctgggtgtttatggcaatcctcgtcatgggctgctcctgatgatgatggcagggatggctgtgtccatgtacctcttccgggttaccatcacaccagaaaccccagaggaagcaccgctgtgggttctggctctacatccagtttcagtcctcactggtgtctcggagaaagagctatggattctgattcttggtgctgcatttggattttcctcatacggaccaatcgccttgttcggagtgattgcgagtgaaagcgccccatccaacttctgcgggacgtcccacgccattgtagctctgatggcaaatgttggtgcattcattgccggcctgccattcagtaccattgccaaacgctacagctgggacacagcattctgggtagcagaggtctcctgcgccataaccacagtttgtttcttcttcgtccgtaacgtgcgcacaaaaatgggccatgtgcctaaaaagatggactaa

SEQ ID NO: 55833 - protein, 453 aa, Danio rerio
MGAAGYGYYRTVIFISMFAGYMLYYFNRKTFSFLMPSVMEEIELDKEELGLITSSQTLAYAISKFISGVLSDRISARWLFSIGLFIVGTINIAFSCSSTVMLFTVLWFVNGFGQGYGWPPCGKVLRKWFEPSQFGTWWAILCCSMNLAGSLGPIITTVLVQYYDWRVIMSVSGLICMAVAVVCLLMVKNEPSDVGLPSIQPGAKKGKGKKGGPNDESSLKDFLLSPYLWVLSAGYLVVFGVKIACTDWGQLFLMQEKGQSAMMGSSYMSALEVGGFFGSIGAGYLSDRAVARQGLGVYGNPRHGLLLMMMAGMAVSMYLFRVTITPETPEEAPLWVLALHPVSVLTGVSEKELWILILGAAFGFSSYGPIALFGVIASESAPSNFCGTSHAIVALMANVGAFIAGLPFSTIAKRYSWDTAFWVAEVSCAITTVCFFFVRNVRTKMGHVPKKMD

SEQ ID NO: 55834 - DNA, 1191 bp, Wolbachia endosymbiont of Drosophila melanogaster
  CDS (1)..(1191): transl_table=11
gtgaactttgtcttctttcaatatttactattcttctgtggatatatgctgctttatttatcaagacaaagtataccaattgctctaccactgttaatagatactgaccatgtaaaattaagctatttttttgcctgcttttcttttttttatggagtatcaaaatttgttaatggaataatcatggactccaaaaataatccattatttatgtttgggctatgcaatattgcaactggattattaaccattggtataactttatcatataataatctaactttattactgttaacattaatattattagcttggacacaagggttaggttggccagctattaccaagtttatggttacaaactctagcatctcttcaattgcatcatcatggggagttatgagcgcatctcagcaacttggttcttgtattactttaattgtattaccaagtataattaaaatatataatgcaaaaagtgcatttttgtactctggtttcttatgcttactttttggaatttatataatattaaaggcatattacaaagaaagtgccaactttactacctattataaggtgcagaaatctcaaataggtatcaaggtaacaagttccatatggtttctatgttgtgctactttttgtgcttatattataaaaatgggaatcttcttttggtttcctataattttaaagaataaattacaaatttctcttgtacaatcctcactaataacaggcgtatatgatttaggtggaatccttggaactttaataacaggaagaattagtgatatgtacttctttcaaaatagaagcttgctggcatcactttatatgttgggtatagcactcacttttattgcaatgaactttggtcaaaacataattcttatgaacctttgtgcaatcttatcaggattctttatatttggagtgcaagtactgacaggtgttatagctgtagaaattgctccacaaaataatgtatgtgcaattgtaagcttaacaggattatttgggtatattgcaagttcaatattttcatgcgtgctcttaggagtacttgttaagcactgtggtaacagtattatgttttcatttttttccatttgctctgttgttgcactcgtttgcttttccatactatcaagcaaagatctaaaaaaactaagtaaagcggtgtaa

SEQ ID NO: 55835 - protein, 396 aa, Wolbachia endosymbiont of Drosophila melanogaster
MNFVFFQYLLFFCGYMLLYLSRQSIPIALPLLIDTDHVKLSYFFACFSFFYGVSKFVNGIIMDSKNNPLFMFGLCNIATGLLTIGITLSYNNLTLLLLTLILLAWTQGLGWPAITKFMVTNSSISSIASSWGVMSASQQLGSCITLIVLPSIIKIYNAKSAFLYSGFLCLLFGIYIILKAYYKESANFTTYYKVQKSQIGIKVTSSIWFLCCATFCAYIIKMGIFFWFPIILKNKLQISLVQSSLITGVYDLGGILGTLITGRISDMYFFQNRSLLASLYMLGIALTFIAMNFGQNIILMNLCAILSGFFIFGVQVLTGVIAVEIAPQNNVCAIVSLTGLFGYIASSIFSCVLLGVLVKHCGNSIMFSFFSICSVVALVCFSILSSKDLKKLSKAV

SEQ ID NO: 55836 - DNA, 1350 bp, Bacillus cereus ATCC 10987
  CDS (1)..(1350): transl_table=11
atgtttttcacacaattctttaaacctgcgccccacgtggaacgcttaccagctgatcgcgttgatagtgaataccgtaaattacgtttacaagtatttttaggtatcttcatcggctatgcaggttattactttgttcgaaaaaacttttcactagcaatgccatacttaattgaacaaggctttagtaaaggggagcttggggttatcctttcagcagtttctatcgcttacggattaagtaaatttcttatgggtatcgtatccgatcgttgtaatcctcgctactttttagcagctgggctatttttatcaggtatcattaatattgttttcggctcattttctttcattacaacgagcattatacttatgtttgtacttcagtttttaaatggatgggtacaagggatgggatggcctccttgtggtcgtacaatggttcactggttctctattagtgaacgtggtacaaaaatgtctatttggaacgtcgctcataatgtcggtggcgcacttatgccttcccttgtaacattagggttatatttctttgcaaatgattggaaaagtattttttacttcccaggtattctttcaattttagttggtatttatgtattaattacgatgagagatacacctcaatcttgtggattaccttctattgaagaacatactggagaatatccaccagatgaaaaagtacaagatcgcgaacgcgaactttcggtaaaagaaattttatttacatacgtactaaacaataaatttttatggtacatcgcgattgcgaacgttttcgtatatttcgtacgttacggtgttgtagactgggctcctacttatttagtagaagaaaaaagctttactcatagtagttcacgtacagcttacgctctatatgaatgggctggtattccaggtacacttctttgcggctggatgagtgataaactattcaaaggacgccgcgcacctgctggtattttatttatggttggtgtatttatcgccgttcttgtttactggctaaaccctcctggtaatccaatggttgatagtatcgcacttgtcgcaattggatttttaatttacggaccggttatgttaattggtctacacgctcttgacttagcaccaaagaaagctgctggaactgcagcgggcttaactggcttcttcggttacttaggcggagcagctttcgctagtgctgctatgggctttatcgtcgatgcatttggatgggatggcggattcatcttgttacttgcatcttgtgtacttgcaatgttcttccttgctcttactttaaagacaggatctccaaaacaaaagcaagcttaa

SEQ ID NO: 55837 - protein, 449 aa, Bacillus cereus ATCC 10987
MFFTQFFKPAPHVERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIVFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMRDTPQSCGLPSIEEHTGEYPPDEKVQDRERELSVKEILFTYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSPKQKQA

SEQ ID NO: 55838 - DNA, 1335 bp, Bacillus cereus ATCC 10987
  CDS (1)..(1335): transl_table=11
atgtttaaatggctcaagccagcacctgcaattgaaagattgcctgcggatatgatcgaccgtgtatatcgattactacgtattcgtgtgttaatcggaatttcagttggatatgctgcttattatttagttcgtagtaactttacgttatcaagtacgtatttagtacaagaatatggttttagtacagctcaaattggtctactaggttcagtaatggcaattgtttatggatttagtaagttctttatggggaatttatcagataaagctttcgcccagcgctttatcgcggtcggtttatttttatcagggcttgtaaatatttgcttcggttttgcatcttcatttgggatgattgttacattacttgttgtgaacggtattgtacaaggtatgggtgcacctccttgtagtatcgttatgacgaaatggttttcaaagaaagaacgtggtacgaaaacaggtctttggaatatttcacataacgttggtggaatgcttgtaccaccacttgtcggaattggtgtaggtatttttggtgaaaatcattggcaaggcggtgtgtttattttcccagcgattatcgcaatggtaattgcagttcttgtttggattaatgcgaaggatacaccggaatcagaaggtcttcctccaattgatgagtatcgtaatgactatgaaaatcttgaaaaagcagatcatgctaacaagatgtcaccaaaagaaattttaatgaagtatgtagtgaaaaataaatttgtatggttcttatgtattgcaaatgcattcgtttatttaattcgtttcggcgttattaactgggttccactttatttaacgacagttaaaggtttctcaaaaaatgaagcacatgcggcgtacgcaatctttgaaggtatggcaattccaagttcattaatcgttggtcttttaagtgataaattatttaaaggaaaacgtatgccattatgtatcattagtatggtcggagttgttattggtacgtttgtatattggcaagcaactagcatacttgttgtaagtattgcagtttctattatcggttgtttaatttatgtaccacagttcttaatcggtttaagtgcgatggaattagtaccgaaatttgcagtaggtacgacagttggtatgtgtggtctgttcggttacgtaggcggaagtcttgtagcaaacgcagcaatcggtgttattgttgatcgttctggctgggatggttgcttcatcttactattaacaggtgctattttatcaacgatcttcttgttcatcgttcaacgtggacatgaaagcaaagcgcctaaagcggcgtaa

SEQ ID NO: 55839 - protein, 444 aa, Bacillus cereus ATCC 10987
MFKWLKPAPAIERLPADMIDRVYRLLRIRVLIGISVGYAAYYLVRSNFTLSSTYLVQEYGFSTAQIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADHANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKAA

SEQ ID NO: 55840 - DNA, 1290 bp, Danio rerio
  CDS (1)..(1290)
atggcgaagactggatatggctactaccgggcgactatattcctggccatgtttgtgggctacacgctgtattacttcaacaggaagacgttctccttcgtgatgccgtctgtaatgcaggagatcacgctggataaggatgatctgggtctcatcaccagcagtcaatctctggcttacgccatcagcaagttcataagcggtgtgctgtctgatcagatgagcgcacgatggctcttctctattgggctgtttacagtcggcggcattaatgtcattttctctcagtcgtcttccgtggctgtcttctcaggcctgtggtttcttaatggactaggtcaaggtctaggatggccaccttgtgcaaaagtgctacgtaagtggttcgaaccatctcagtttggcacctggtgggcagtgctgtcctgcagtatgaatctggctggatgtctcggacccataattgcaactctgatggctcaaagctacagctggaggtccacgctgtccatctctggcttgacctgcgtggtcacatcaatcttctgtctgatcattatccgaaatgagcccagtgaagttggcctgccaaatattgaagctggagccaagaaaggcaaaggaggctccagcaaaaatgaaagcaccttcaaagagttcatcttttctccatatctatggctgatgtcgctggggtacctggtggtgtttggggtgaagactgcctacacagactggggacaactttttctcatccaggataaggggcagtcggctctaatgggcagttccttcatgagtgcccttgaaatcggaggactgctgggtagtttagctgctggattcctgtcagacagagccgtggcaaagcatggtttgcgattgtatggtaaccctcggcatgggctcttgctctccatgatggctgggatgtgtgtgtccatgtacctcttccgcacaactgtcacggcacacagctcaaacgtctggattctcttgttgggtgctgcttttggcttttcctcctatggaccgattgccttgtttggagttcttgcgaatgaaagtgctccatcaaactactgcgggacttctcacgccattgtcgcactgatggcaaatgttggtggttttctgtcaggcttgccattcggaactgttgctaaacaccacggctggaacacagcattctgggtagcagaaatagcctgcatggtcacaacagttggatacttcctgctccgaaatatacgcactaagatgggaagcattcccaagaaggcagactag

SEQ ID NO: 55841 - protein, 429 aa, Danio rerio
MAKTGYGYYRATIFLAMFVGYTLYYFNRKTFSFVMPSVMQEITLDKDDLGLITSSQSLAYAISKFISGVLSDQMSARWLFSIGLFTVGGINVIFSQSSSVAVFSGLWFLNGLGQGLGWPPCAKVLRKWFEPSQFGTWWAVLSCSMNLAGCLGPIIATLMAQSYSWRSTLSISGLTCVVTSIFCLIIIRNEPSEVGLPNIEAGAKKGKGGSSKNESTFKEFIFSPYLWLMSLGYLVVFGVKTAYTDWGQLFLIQDKGQSALMGSSFMSALEIGGLLGSLAAGFLSDRAVAKHGLRLYGNPRHGLLLSMMAGMCVSMYLFRTTVTAHSSNVWILLLGAAFGFSSYGPIALFGVLANESAPSNYCGTSHAIVALMANVGGFLSGLPFGTVAKHHGWNTAFWVAEIACMVTTVGYFLLRNIRTKMGSIPKKAD

SEQ ID NO: 55842 - DNA, 1332 bp, Leptospira interrogans serovar Copenhageni str. Fiocruz L1-130
  CDS (1)..(1332): transl_table=11
atgatttcaccgttacgttggctactccctgcaaaagcaaagccattattatcaaaagaattaatagatcgatcttatccgcgttttagatggaggattttagaagcaacctttatcggttatgcgacgttttatctcgtaaggaataattttccagttatttccaaagaaatgggagaagcccttcattatagtcaagaacaaatcacaaacattttagcagtgactgcgatcacatacgggataggaaaatttttaatgggaatcttatccgatcgtagtaatccaaaatacttcatgccattgggtttgattttaaccgcgatttgtaatttgtttttcggagcatcaaatcagtacgaaattcatttttatctttgggcattaaacggattgatgcaagggatgggatggcctccttgtggacgttctcttggtcattggttcggagtttccgaaagaggatctaaatttgcaatttggaacatagcgcataacgtgggaggaggtttggtaggaattatcgcagcttacagcgcatcttggtggggttggaggaatgcgttttatattcccgctttgattgcgattgtgaccgcgatttatcttttatttcgattggtggatacacctcagtcggttggtcttcctccaatcgaagaatatcaaaaagatccggaaaaggaggtaagactttctatacaagaacaagaaaaggaactttcttttcgagaaatcattttaggttctgtattaaaaaatcattatgtttggacttttgcatttgctaattttttcgtttatgtggttcgatatggtttgacggatataggtcctacttatttaaaactttctaaaggagcttctttagaaaaaggtgggatcagcacgttgatctacgaatttgccggaattgcttctacccttcttgtaggatggggttccgataagctggggggtaaaagaggaatggtaagtcttttatgtatgcttcctattttgtttgctttaatttcattattatttactcctttaggatttctatggttggatcttgtattgttcggaatcatcggtttttttatctatccacctgttatgttgttaggtgttgctgggcttgattttacttctaaaaaagcggttggagctgcagccggttttataggtttattcggttatttgggaaggacgattctttcaaaatcggtaggatggttgagtaaacaaactggatttcattgggaacaacctatgtatttaatgatcggtgcgactttaatttcaattgcgttactcgccattacttggaattggaaacctaaggcatag

SEQ ID NO: 55843 - protein, 443 aa, Leptospira interrogans serovar Copenhageni str. Fiocruz L1-130
MISPLRWLLPAKAKPLLSKELIDRSYPRFRWRILEATFIGYATFYLVRNNFPVISKEMGEALHYSQEQITNILAVTAITYGIGKFLMGILSDRSNPKYFMPLGLILTAICNLFFGASNQYEIHFYLWALNGLMQGMGWPPCGRSLGHWFGVSERGSKFAIWNIAHNVGGGLVGIIAAYSASWWGWRNAFYIPALIAIVTAIYLLFRLVDTPQSVGLPPIEEYQKDPEKEVRLSIQEQEKELSFREIILGSVLKNHYVWTFAFANFFVYVVRYGLTDIGPTYLKLSKGASLEKGGISTLIYEFAGIASTLLVGWGSDKLGGKRGMVSLLCMLPILFALISLLFTPLGFLWLDLVLFGIIGFFIYPPVMLLGVAGLDFTSKKAVGAAAGFIGLFGYLGRTILSKSVGWLSKQTGFHWEQPMYLMIGATLISIALLAITWNWKPKA

SEQ ID NO: 55844 - DNA, 1383 bp, Parachlamydia sp. UWE25
  CDS (1)..(1383): transl_table=11
gtgaataaattgctcaatttgctgcaaccagctccccatattcctgaattaaaagaccaagagcttgtcaaagatcaatataaatattggcgtattcgcattctttattcgatgttcataggatatgctttctattattttactcgaaaaagttttacttttgcgatgcctggtcttattcaagatttgggctttgataaaagccagttaggaattttaggaagtattctttcaattacgtatggagtgagtaaatttgcaagtgggatcattggagatcgtactaactctcgttatatgatggccattgggttaatgttaacgggcatttgtaatatttgttttgggctttcttcttctattttcttttttgccctattttggggtcttaatggatggtttcagggatttggttggcctccttgtgcgcgctttttaactcaatggtattcacattcagagagaggttcgtggtggtccacatggaatgtttcacataatgtaggcggttttttaatcccctggatagcaggaattactcttcaatattttggctggcgttatgccatgtatattcctggaattttatgcatcctcatcagttttttcttaatcaatcgtttaagagatactccgcagtctcttggattacctcctattgaaaaataccgtaatgattatgtggataaagctgaggcagacaaagaggctgaacaattaacaacaaaacaactattagtcaattttgttcttaaaaattcctatatttggatattagcgctcgcctatttttttgtttatgccgtgcgaacaggaatcaatgattggacagctttatttttagttgaatccaaaggatatagtagcattggagcaaatggatgtgtttctttatttgaagttggcggattttttggaagtctagctgctggttggtcatcagataaacttttcggcgcaaaaagaggacctattaatgttctatttacactaggaatgtttgcttttattgccattttttggatgataccctctggctatttgttatttgattctgtcctcatgttttgtataggtttttctatttttggcccacaaatgatgattggtttagcggctgcagaactgtctcataaaaaagcggtggcaacttcaactggatttgttggtttttttgcttatatcggagctgcttttgcaggctatcccttgggatatatcactcagcaatggggatggcaaggtttttattgggctttaatgggatgttgtattattgcactatttctacttattccactttggtcagtttctgccaccactttaaagcctaaaaataaatcgagttctcctgttagttcgcctgcgttagcttctaaataa

SEQ ID NO: 55845 - protein, 460 aa, Parachlamydia sp. UWE25
MNKLLNLLQPAPHIPELKDQELVKDQYKYWRIRILYSMFIGYAFYYFTRKSFTFAMPGLIQDLGFDKSQLGILGSILSITYGVSKFASGIIGDRTNSRYMMAIGLMLTGICNICFGLSSSIFFFALFWGLNGWFQGFGWPPCARFLTQWYSHSERGSWWSTWNVSHNVGGFLIPWIAGITLQYFGWRYAMYIPGILCILISFFLINRLRDTPQSLGLPPIEKYRNDYVDKAEADKEAEQLTTKQLLVNFVLKNSYIWILALAYFFVYAVRTGINDWTALFLVESKGYSSIGANGCVSLFEVGGFFGSLAAGWSSDKLFGAKRGPINVLFTLGMFAFIAIFWMIPSGYLLFDSVLMFCIGFSIFGPQMMIGLAAAELSHKKAVATSTGFVGFFAYIGAAFAGYPLGYITQQWGWQGFYWALMGCCIIALFLLIPLWSVSATTLKPKNKSSSPVSSPALASK

SEQ ID NO: 55846 - DNA, 1386 bp, Listeria monocytogenes str. 4b F2365
  CDS (1)..(1386): transl_table=11
atgtcattattcagtttaaaaagaaagaactattttgttccactagaaattcaaaggcaacaatggttcaaacactttatcgttgcatttatgtctgtatttatttgttatctaacggtctatcttctaaggaataactttaaagcggctcagacattgttaattgagcagaaccatttcagcaccacagaactaggaatgattggtttagctttttctgttatgtacggaattggaaaaacgattttagggtatgccgtggatggaagaaatgctaaaaaaataatgagttttttattagggatttccgccattatatcaattattattggaatacttttagttacaaagcaagcaacagtgggtatattgtttatcctttggggagcaaatggatttgtgcaatcaccaggtggaccggcttcctattcaactatcacacgatggacgccaaaattgaaaagaggaagatggttaggcttttggaatgcctcgcataatataggtggtgctttagcgggaattgttgctttttggggtgcgactactttctttaatggcggggcagggggaatgtttatcgttccgggtatcattgcgatcatcattgcaattatttgcttctccgtggggcatgatgaaccagaagaattaggatggaactctgccgctgaaatttttgaagagcgggaagaacaaggagaatcggagacaaaagacctttctagatttcaaattttgtgtcgatttgttattaataatccatgggtatggactttatgtgtcataaatatattcatctatattgttagaattggtattgataattgggcgcccgtttattgtattcaagcgctaggatggagtacaaaagatgcaattatgactatttctttttttgaaattggagcattgctaggttcattatcgtggggctggctctcagatattatgaaaggccgccgtatgctttgctctattattgcagttgtcattgaatttttcatgttaattagttattcgcaagttacaagtgtttatagcatgtatacggtattatttattttaggattcttagtatttggcccccaacttttaattggtgtgtcggtgatcgagtttgttcctagaaatgctttagctgtaacaaatggcttaactggaacgtttgcatacttattcggagattcttttgctaaagtctttctaggatatatcgcagacccaacaaaagcgggtatacaaatatttggctatactttacacggctggggcgcaacttttaccattatgtttacagctttaattattgcaggcttaatgatgattccagttgcattaaaacaagagaaaatcatccgacaagcaaaagttttacatctataa

SEQ ID NO: 55847 - protein, 461 aa, Listeria monocytogenes str. 4b F2365
MSLFSLKRKNYFVPLEIQRQQWFKHFIVAFMSVFICYLTVYLLRNNFKAAQTLLIEQNHFSTTELGMIGLAFSVMYGIGKTILGYAVDGRNAKKIMSFLLGISAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGIQIFGYTLHGWGATFTIMFTALIIAGLMMIPVALKQEKIIRQAKVLHL

SEQ ID NO: 55848 - DNA, 1350 bp, Bacillus anthracis str. Sterne
  CDS (1)..(1350): transl_table=11
atgttttttacacaattctttaaacctgcgccccacgcggaacgcttaccagctgaccgcgttgacagtgaataccgtaaactacgtttacaagtattcttaggtatcttcatcggctatgcaggttattactttgttcgaaaaaacttttcactagcaatgccatacttaattgaacaaggctttagtaaaggggaacttggggttatcctttcagcagtttctatcgcttacggattaagtaaatttcttatgggtatcgtatccgatcgttgtaatcctcgctactttttagcagctgggctatttttatcaggtatcattaatattattttcggctcattttctttcattacaacgagtattatacttatgtttgtacttcagtttttaaatggatgggtacaaggtatgggatggcctccttgtggtcgtacaatggttcactggttctctattagtgaacgtggtacaaaaatgtctatttggaacgtcgctcataacgtcggcggagcgcttatgccttctcttgtaacattaggcttatacttctttgcgaatgactggaagagtattttttacttcccaggtattctttcaattttagttggtgtttatgtattaattacgatgaaagatacacctcaatcttgtggattaccttctattgaagaacatactggagaatatccaccagatgagaagataaaagatcgtgaacgtgaactttcagcaaaggaaattttatttaaatacgtactaaacaataaatttttatggtacatcgcgattgcgaacgttttcgtatatttcgtacgttacggtgttgtagactgggctcctacttatttagtagaagaaaaaagctttactcatagtagttcacgtacagcttatgctctatatgaatgggctggtattccaggtacacttctttgcggctggatgagtgataaactatttaaaggacgccgcgcacctgctggtattttatttatggttggtgtatttatcgccgttcttgtgtactggctaaaccctcctggtaatccaatggttgatagtatcgcacttgttgcaattggatttttaatttacggacctgttatgttaattggtctacacgctcttgacttagcaccaaagaaagcggctggaactgcagctggattaactggcttcttcggttacttaggcggagcagctttcgctagtgccgctatgggctttatcgtcgatgcattcggatgggatggcggattcatcttattacttgcatcttgtgtacttgcaatgttcttccttgctcttactttaaagacagggtcagtaaaacaaaagcaagcttaa

SEQ ID NO: 55849 - protein, 449 aa, Bacillus anthracis str. Sterne
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGVYVLITMKDTPQSCGLPSIEEHTGEYPPDEKIKDRERELSAKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSVKQKQA

SEQ ID NO: 55850 - DNA, 1335 bp, Bacillus anthracis str. Sterne
  CDS (1)..(1335): transl_table=11
atgtttaaatggctcaagccagcacctgcaattgaacgtttaccagcggatatgatcgaccgtgtgtatcgattactacgtattcgcgtgttaatcggaatttcagttggatatgctgcttattatttagttcgtagtaactttacgttatcaagtacgtacttagtacaagaatatggttttagtacagctgaaattggtctactaggttcagtaatggcaattgtttatggatttagtaagttctttatggggaatttatcagataaagctttcgcccagcgctttatcgcagtcggtttatttttatcagggcttgtaaatatttgcttcggttttgcatcttcatttgggatgattgttacattacttgtcgttaacggtattgtacaaggtatgggagcaccaccttgtagtattgttatgacgaaatggttctcgaagaaagagcgcggtacgaaaacaggtatttggaatatttcacataacgttggtggaatgcttgtaccaccacttgtcggaattggtgtaggtatttttggtgaaaatcattggcaaggcggcgtgtttattttcccagcgattatcgcgatggtaattgcagttcttgtttggattaatgcgaaggatacaccagaatcagaaggtcttcctccaattgatgagtatcgtaatgactatgaaaatcttgaaaaagcagacaacgctaacaagatgtcaccaaaagaaattttaatgaagtatgtagtaaaaaataaatttgtatggttcttatgtattgcaaatgcatttgtttatttaattcgcttcggtgttattaactgggttccactttatttaacgacagttaaaggcttctcaaaaaatgaagcacatgcagcatacgcaatctttgaaggtatggcaattccaagttcattaatcgttggtcttttaagtgataaattatttaaaggaaaacgtatgccactatgtattattagtatggtcggagttgttattggtacgtttgtatattggcaagcaactagcatacttgttgtaagtattgcagtttctattatcggttgtttaatttatgtaccacagttcttaatcggtttaagtgcgatggaattagtaccgaaatttgcagtaggtacgacagttggtatgtgtggtctattcggttatgtaggcggaagtcttgtagcaaacgcagcaatcggtgttattgttgatcgttctggctgggatggttgtttcatcttactattaacaggtgccattttatcaacaatcttcttgttcatcgttcaacgtggacatgagagcaaagctcctaaagcggcgtaa

SEQ ID NO: 55851 - protein, 444 aa, Bacillus anthracis str. Sterne
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKAA

SEQ ID NO: 55852 - DNA, 1350 bp, Bacillus thuringiensis serovar konkukian str. 97-27
  CDS (1)..(1350): transl_table=11
atgttttttacacaattctttaaacctgcgccccacgcggaacgcttaccagctgaccgcgttgacagtgaataccgtaagctacgtttacaagtattcttaggtatcttcatcggctatgcaggttattactttgttcgaaaaaacttttcactagcaatgccatacttaattgaacaaggctttagtaaaggggaacttggggttatcctttcagcagtttctatcgcttacggattaagtaaatttcttatgggtatcgtatccgatcgttgtaatcctcgctactttttagcagctgggctatttttatcaggtatcattaatattattttcggctcattttctttcattacaacgagtattatacttatgtttgtacttcagtttttaaatggatgggtacaaggtatgggatggcctccttgtggtcgtacaatggttcactggttctctattagtgaacgtggtacaaaaatgtctatttggaacgtcgctcataacgtcggcggagcgcttatgccttctcttgtaacattaggcttatacttctttgcgaatgactggaagagtattttttacttcccaggtattctttcaattttagttggtatttatgtattaattacgatgaaagatacacctcaatcttgtggattaccttctattgaagaacatactggagaatatccaccagatgagaagataaaagatcgtgaacgtgaactttcagcaaaggaaattttatttaaatacgtactaaacaataaatttttatggtacatcgcgattgcgaacgttttcgtatatttcgtacgttacggtgttgtagactgggctcctacttatttagtagaagaaaaaagctttactcatagtagttcacgtacagcttatgctctatatgaatgggctggtattccaggtacacttctttgcggctggatgagtgataaactatttaaaggacgccgcgcacctgctggtattttatttatggttggtgtatttatcgccgttcttgtgtactggctaaaccctcctggtaatccaatggttgatagtatcgcacttgttgcaattggatttttaatttacggacctgttatgttaattggtctacacgctcttgacttagcaccaaagaaagcggctggaactgcagctggattaactggcttcttcggttacttaggcggagcagctttcgctagtgccgctatgggctttatcgtcgatgcattcggatgggatggtggattcatcttattacttgcatcttgtgtacttgcaatgttcttccttgctcttactttaaagacagggtcagtaaaacaaaagcaagcttaa

SEQ ID NO: 55853 - protein, 449 aa, Bacillus thuringiensis serovar konkukian str. 97-27
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMKDTPQSCGLPSIEEHTGEYPPDEKIKDRERELSAKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSVKQKQA

SEQ ID NO: 55854 - DNA, 1335 bp, Bacillus thuringiensis serovar konkukian str. 97-27
  CDS (1)..(1335): transl_table=11
atgtttaaatggctcaagccagcacctgcaattgaacgtttaccagcggatatgatcgaccgtgtatatcgattactacgtattcgcgtgttaatcggaatttcagttggatatgctgcttattatttagttcgtagtaactttacgctatcaagtacgtacttagtacaagaatatggttttagtacagctgaaattggtctactaggttcagtaatggcaattgtttatggttttagtaagttctttatggggaatttatcagataaagctttcgcccagcgctttatcgcagtcggtttatttttatcagggcttgtaaatatttgcttcggttttgcatcttcatttgggatgattgttacattacttgtcgttaacggtattgtacaaggtatgggagcacccccttgtagtattgttatgacgaaatggttctcgaagaaagaacgcggtacgaaaacaggtatttggaatatttcacataacgttggtggaatgcttgtaccaccacttgtcggaattggtgtaggtatttttggtgaaaatcattggcaaggcggcgtgtttattttcccagcgattatcgcaatggtaattgcagttcttgtttggattaatgcgaaggatacaccggaatcagaaggtcttcctccaattgatgagtatcgtaatgactatgaaaatcttgaaaaagcagacaatgctaacaagatgtcaccaaaagaaattttaatgaagtatgtagtgaaaaataaatttgtatggttcttatgtattgcaaatgcatttgtatatttaattcgtttcggtgttattaactgggttccactttatttaacgacagttaaaggtttctcaaaaaatgaagcacacgcagcgtacacaatctttgaaggtatggcaattccaagttcattaatcgttggtcttttaagtgataaattatttaaaggaaaacgtatgccattatgtatctttagtatggtcggagttgttattggtacgtttgtatattggcaagcaactagcatacttgttataagtattgcagtttctattattggttgtttaatttatgtaccacagttcttaatcggtttaagtgcaatggaattagtaccgaaatttgcagtaggtacgacagttggtatgtgtggtctgttcggttatgtgggcggaagtcttgtagcaaacgcagcaattggtgttattgttgatcgttctggctgggatggttgttttatcttactattaacaggtgccattttatcaacaatcttcttgttcatcgttcaacgtggacatgagagcaaagcttctaaagtagcataa

SEQ ID NO: 55855 - protein, 444 aa, Bacillus thuringiensis serovar konkukian str. 97-27
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKNEAHAAYTIFEGMAIPSSLIVGLLSDKLFKGKRMPLCIFSMVGVVIGTFVYWQATSILVISIAVSIIGCLIYVPQFLIGLSAMELVPKFAVGTTVGMCGLFGYVGGSLVANAAIGVIVDRSGWDGCFILLLTGAILSTIFLFIVQRGHESKASKVA

SEQ ID NO: 55856 - DNA, 1380 bp, Staphylococcus aureus subsp. aureus MRSA252
  CDS (1)..(1380): transl_table=11
atgaacttttttgatatccataagattccgaacaaaggcattccattatcggtacaacgtaaattatggcttagaaacttcatgcaagctttcttcgtagtgttctttgtttatatggctatgtatttaattcgaaacaactttaaggcggcacaaccgtttttaaaagaggaaattggattatctacattagaacttggttatatcggattagcatttagtatcacgtacggtttagggaaaacattacttggatattttgtcgatggacgtaacacaaaacgtattatctcattcttacttatcttatctgcgattacagttttaattatgggatttgttttaagttactttggttcagtaatgggattattaattgtactttggggacttaacggggtgttccaatcagttggtggacctgcaagttattcaacgatttcaagatgggcgccaagaacgaaacgtggccgatacttagggttttggaatacatcacataatatcggtggtgccattgcaggtggtgttgcactttggggtgctaatgtattcttccatggaaatgttatagggatgttcattttcccatcggtgattgcattacttattggtatcgcaacattatttatcggaaaagatgatccagaagaattaggatggaatcgtgctgaagaaatttgggaagagccggttgataaagaaaatattgattctcaaggtatgacaaaatgggagatctttaaaaaatatatcctgggaaatcctgttatatggattctatgtgtttcaaacgtctttgtatacattgtacgaatcggtattgataactgggcaccgttatatgtgtcagagcatttacactttagtaaaggcgatgcagttaatacgatattctactttgaaattggtgctttagttgcaagtttattatggggctacgtatcagacttattaaaaggtcgtcgtgcaattgtagctattggctgtatgtttatgattacatttgttgtcttattctacacaaatgctacaagtgtaatgatggttaacatttcattgtttgcattaggtgcgttaatctttggtccgcaattattaattggtgtatcattgactggttttgttcctaaaaatgccatcagtgtagcaaacggaatgacaggttcattcgcgtatctattcggtgactcaatggcaaaagttggtttggcggctattgctgatccaacacgtaacggtttaaacatctttggatatacattaagtggatggacagatgttttcatcgtcttctatgttgcattattcctaggcatgattctattaggaatcgttgctttctatgaagaaaagaaaattagaagtttaaaaatctaa

SEQ ID NO: 55857 - protein, 459 aa, Staphylococcus aureus subsp. aureus MRSA252
MNFFDIHKIPNKGIPLSVQRKLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSLKI

SEQ ID NO: 55858 - DNA, 1359 bp, Staphylococcus aureus subsp. aureus MRSA252
  CDS (1)..(1359): transl_table=11
atgaattttcttaaacctgcaaagcatattaagcctttgccagaaaatcagatagatgatacctataaacgattacgtctccaagtatttcttggtattttcatcggttacgctgggtactatttattacgtaaaaacttttcattagcgatgccggcattgcaagagcaaggttttacaaaagcagaactaggttttgcgctttctgctgtttccatcgcatatggatttagtaagttctttatgggtactgtaagtgatcggagcaatgcacggatattcttagttcttggattagtactcactgctatcgtcaatttgttaatgggatttgtaccgttctttacatcaggtatcggtattatgtttgtcctattattcttaaatggatggtttcaaggtatgggctggccaccttcaggccgtgttctcgttcactggtttagtgtaagtgaacgcggaagtaagactgctctttggaacgttgcgcataatgttggtggaggtattatggcacctattgctgcttggggtattacaacaacagcatttatcaactttggttatttaaaaggttttgaaggtgtattcatttaccctgcactcttagcacttatcattgccgcaatttcatatatattgattagagacacacctcaatctcaaggtttacctccaatcgaaatttataaaaatgactttgctacaagcgataagaaaacattagaaacagaattaactacaaaagaaattttatttaaatatgtactgaacaataaatgggtatgggcaattgcctttgcaaatatatttgtttatttcgtgcgttatggtgtacttgattgggcgccagtctacttaagtgaagaaaaacatttcgacttaaaagcatcaggttgggcatacttcttatacgaatgggctggaattcctggtacattattatgtggttacatttctgataaattattcaaaggtcgccgtggacctgctggtttcttctttatgttaggtgtcacagtatttgtattaatttattggttaaatcctccaggcaatgcttggttagacaatgtctcattaattgccattggtttcttaatatatggaccagttatgttaattggtttacaagcattagattatgtacctaaaaaagcagctggcacagcagctggattaactggattatttggttatctgtttggtgctgtaatggccaacatcgtcttaggtgctgtagttgataaattcggatgggatgtcggttttattttattaacagcaatcagtgtgtttgcaatgttgagctttatcctcacttggaataaagtaggacaagaaactgttcatcattaa

SEQ ID NO: 55859 - protein, 452 aa, Staphylococcus aureus subsp. aureus MRSA252
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLVLTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYILIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNAWLDNVSLIAIGFLIYGPVMLIGLQALDYVPKKAAGTAAGLTGLFGYLFGAVMANIVLGAVVDKFGWDVGFILLTAISVFAMLSFILTWNKVGQETVHH

SEQ ID NO: 55860 - DNA, 1326 bp, Erwinia carotovora subsp. atroseptica SCRI1043
  CDS (1)..(1326): transl_table=11
atgcaagcacccatgtttccaaagggacagctttcaccaacacaaatcagtcagcgctatcgctactggcgaccgcggttgttgatttccatggttatcgggtacgccacgttttacctgacgcgtaaaagcatcaacttcgtcatgccggtgatgcagttggaattagggttaagcaaaggcgatatcggtctgctggggacgctgttttacctctgttatggcgcgtctaaatttatctccggcatcgtgtgcgatcgcactcaggtgcgctggtttatgggtgtcggactgatgattaccggcgtgctgaacattctgttcatgtactgccagtcactcaccggtttgctgattgtctgggcgctgaacggtttctttcagggctggggttggcccccttgcgccagactgctgagcagttggtattcgcgtaatgagcgcggcctctggtggggatgctggaatacgtcgatcaacatcggcggcgcggcggttcccttactcgcaggctatctggcctccgaatgggggtggcaagcggcgctgctggtgccgggcattatcgggattgtgatcgggctgtggctgtgttggcagttgtgcgacaaaccgcagcagcaagggttgccaagcgtcggtcagtggcgacgcgacgcgctggagcttcgtcaggagcagcagagcccgccgatgccgatgcgtcagattctgcgcgatgcgattttgcgtaaccgtaccatctggctgctcgggttttcctacattctggtgtacctgattcgtatcgcactgaatgactggggaaacatctggctgtcggagagccacggattcaacctactcagcgctaacgccacgctgtcgctatttgaactgggtggattgctgggagcgctgtttgctggttggggttcggatctgctgtttcgtggtcaacgcgcaccgatgattttgctgttcgcacttgggctgtttttaaccatgaccgcgctgtggctggcaccgattcaccactattcactgctcgcagcctgtttcttcagtatcggtttttttgtttttggaccacagatgttgatcggtctggctgcgacggaatacagccataaggatgccgcaggcacggtgacaggttttctggcgttgtttgcctatctgggggcggcgctggcgggctggccgctggcacaggtgctgcaacactacggatggtcgggattttttactctgctggcgttggcctcagcctgcatcggactgttattgatgccgctgctgatggcaggtgtcagccgccgggaacgtttgatgacatcaaaatag

SEQ ID NO: 55861 - protein, 441 aa, Erwinia carotovora subsp. atroseptica SCRI1043
MQAPMFPKGQLSPTQISQRYRYWRPRLLISMVIGYATFYLTRKSINFVMPVMQLELGLSKGDIGLLGTLFYLCYGASKFISGIVCDRTQVRWFMGVGLMITGVLNILFMYCQSLTGLLIVWALNGFFQGWGWPPCARLLSSWYSRNERGLWWGCWNTSINIGGAAVPLLAGYLASEWGWQAALLVPGIIGIVIGLWLCWQLCDKPQQQGLPSVGQWRRDALELRQEQQSPPMPMRQILRDAILRNRTIWLLGFSYILVYLIRIALNDWGNIWLSESHGFNLLSANATLSLFELGGLLGALFAGWGSDLLFRGQRAPMILLFALGLFLTMTALWLAPIHHYSLLAACFFSIGFFVFGPQMLIGLAATEYSHKDAAGTVTGFLALFAYLGAALAGWPLAQVLQHYGWSGFFTLLALASACIGLLLMPLLMAGVSRRERLMTSK

SEQ ID NO: 55862 - DNA, 1350 bp, Erwinia carotovora subsp. atroseptica SCRI1043
  CDS (1)..(1350): transl_table=11
atgctgagtatttttaggcccgccgcccaccagccacgcgtgtcgcaagatcacgtcgatcccgtctatcgtcgcctgcgttggcagattttcatggggatcttttttggctacgccgcctactatctggtacgcaaaaacttcacactggcgatgccttatctgattgaacagggcttctcgcgtggtgaccttggctttgcgctgtccggtatctccatcgcctacggcttttccaaattcatcatgggatcgatatccgaccgttctaacccgcgagtgttcctgcccgccggtctgattctgtcagctgcggtcatgctgttcatgggcttcgtaccgtgggcaacgtccagcattgcgattatgttcgtcctgctgttcctgtgcggatggttccagggcatgggctggccgccgtgcggacgtactatggttcactggtggtcacagaaagaacgtggtggcatcgtatctgtatggaactgtgcgcataacgtcggtggtgggcttccccctctgctgttcctgctgggtatggcctggttcaacgactggaaagcggcgctctatatgccggcattcgccgccattctggttgccatgatcgcttttgcactgatgcgtgacacaccgcaatcttgtggtctgccaccgattgaagagtacaaaaacgattatccggttgattacaatgaaaaagcagaagaagagctgaccgctaagcagatcttcatgcagtacgttttcccgaacaaactgctgtggtatatcgctatcgccaacgtgttcgtttacctgctgcgttacggcatcctcgactggtcaccaacttacctgaaagaagttaaacacttcgcactggataagtcgtcctgggcgtacttcctgtacgaatacgcgggtattccgggcacgctgctgtgcggttggatgtctgataaggtgttcaaaggtaaccgtggtgcaacgggcgtattcttcatggtacttgtcaccatcgccaccgtcgtttactggatgaacccagccggtaatccgggtgtggacatggcctgtatgatcatcatcggcttcctgatttacggtccggttatgcttattggtctacacgcgctggaactggcaccgaagaaagcagctggtaccgcggcgggcttcaccggcctgttcggctacctcggtggctccgttgccgccagcgccatcgtcggctacaccgttgacttcttcggttgggacggcggtttcatggtgatgatcggcggcagcattatggctgtgcttctgctggttgttgttatgctgaatgagaaaaagcataaagcagagttagccaatcgcgcctaa

SEQ ID NO: 55863 - protein, 449 aa, Erwinia carotovora subsp. atroseptica SCRI1043
MLSIFRPAAHQPRVSQDHVDPVYRRLRWQIFMGIFFGYAAYYLVRKNFTLAMPYLIEQGFSRGDLGFALSGISIAYGFSKFIMGSISDRSNPRVFLPAGLILSAAVMLFMGFVPWATSSIAIMFVLLFLCGWFQGMGWPPCGRTMVHWWSQKERGGIVSVWNCAHNVGGGLPPLLFLLGMAWFNDWKAALYMPAFAAILVAMIAFALMRDTPQSCGLPPIEEYKNDYPVDYNEKAEEELTAKQIFMQYVFPNKLLWYIAIANVFVYLLRYGILDWSPTYLKEVKHFALDKSSWAYFLYEYAGIPGTLLCGWMSDKVFKGNRGATGVFFMVLVTIATVVYWMNPAGNPGVDMACMIIIGFLIYGPVMLIGLHALELAPKKAAGTAAGFTGLFGYLGGSVAASAIVGYTVDFFGWDGGFMVMIGGSIMAVLLLVVVMLNEKKHKAELANRA

SEQ ID NO: 55864 - DNA, 1188 bp, Desulfotalea psychrophila LSv54
  CDS (1)..(1188): transl_table=11
atgacacgacaacagaagaaagcgctttttatcctctggtttggctatgccaatttttatctgttgcgactcaactatggtatagctatgccgggaatcatggccgaatatggctatagcagaggagaacttggcctgggggcaagtttcttttttatgctctatgcccttggcctggtggtaagtggggtgctcagtgacagactaggaccgaaaaggattttggtctttggcctgctctgctccattcttgttaatctggcctttccgtctattgctggtagcctcttcggcattgtttttctttggtctataaatggtttttttcaggcaatgggctgggcgcctacggtgaagatgacttcaccgtggtttgaggaggggcagaagggtcgggcctcggcgattcttggtacctcatatattatcggcagtgctctgagttggcttcttgccggttatctggcccaaaactactcctggcgtcttgtcttctatggcccaaccctcatcgccgcagtcatcttagctctctacctgatctatatagagcaatatccacaggccactacccctgccagacagtctatcttgaagaccttgggcgctgttttggctgagagggaaatttggtatgtgggttttacccttttagggcttaatatcgtgatctatggatttatgacctgggcacccatatactattttgagcagggtggagatattcaggaggcgacccataaggccctcctttttcccatagccggagccctgggtagcctttttataggctggctttgtgataagttctttgccaagaggcgactctttgtcggcgtcatggccatggttgttcttctcttctctgtccttctttttccctatagcaccgatcctcttgtctcgctgacctgtcttgttttcgtcggggccacagcctatggtacagaggttcttctggtttctcagtttcccatgatatttggcaagcaaaagaatatggcaaccattgttggcgttattgatagtataggttatctgggagcagccataaccagtgtgacaagcggctttttgactgatatttggggctggtcagcggccttctatttctggataggaggtggcttgttcgctatgatcttcctccttatctgtcagcgacagctggggcatacccttcggtaa

SEQ ID NO: 55865 - protein, 395 aa, Desulfotalea psychrophila LSv54
MTRQQKKALFILWFGYANFYLLRLNYGIAMPGIMAEYGYSRGELGLGASFFFMLYALGLVVSGVLSDRLGPKRILVFGLLCSILVNLAFPSIAGSLFGIVFLWSINGFFQAMGWAPTVKMTSPWFEEGQKGRASAILGTSYIIGSALSWLLAGYLAQNYSWRLVFYGPTLIAAVILALYLIYIEQYPQATTPARQSILKTLGAVLAEREIWYVGFTLLGLNIVIYGFMTWAPIYYFEQGGDIQEATHKALLFPIAGALGSLFIGWLCDKFFAKRRLFVGVMAMVVLLFSVLLFPYSTDPLVSLTCLVFVGATAYGTEVLLVSQFPMIFGKQKNMATIVGVIDSIGYLGAAITSVTSGFLTDIWGWSAAFYFWIGGGLFAMIFLLICQRQLGHTLR

SEQ ID NO: 55866 - DNA, 1290 bp, Rickettsia typhi str. Wilmington
  CDS (1)..(1290): transl_table=11
atgacaaatatagagtctaaaattaaaacgccaagatcgccatatgcaaaaaaatataatagttggcgaataaggattttatattctattgttataggttatgcgactttttatttttgtcgtcagaattttaatatagcgacccctgctatcagagaatattttggtgttactaaaacacaaattggttggatcttaactgctgcatctattatgtatggagtgagtaaagcttgtaatgggtttattagcgataaagttaatgctcgagtatttatggttttgggtcttttatttgttgggattattactattctaataggtttttcagattttttatggcttataggaattttatggatagcaagcaattggtttcagtcaatgggatggcctcctgcaacaaaaatgctcactcactggtttgctgcaaaagaacttggcacgaaatgggctatcggtgcaacttctaatcaactaggtggcgctcttgctatgataagctgcggttatttaattgataaatttgactggagagctgctttttttgttccaggtttagttgcgtgtgtagcatcactttttttatataataggctacgtaattctccaaaagaagttggtttatctacagtagaggaatataaagaatatccacctgaagctataggcaattatgagcgattattaactacacaattacttaagatggtcttttgtaataagctaatatggtatgtttgtttagcaaacatgtttgtttatatcattcgttccggagtaatttattgggctccaacatttttaagagatttatgtaatataagctttgtaaatgcaggtttacaaattggtttatatgagatgataggtataccaggagcattaatagcaggtattttatctgacaagctatttcaaggtcgtagaggtcctattgcatctatatgtatgatactgctgaccttgttgttagttttgttttggaaagtccctattcaaagtgaattattaagtatagtaattctttcattaataggtttttttgtttcaggacctcagctcctcgtaggtatagcagctgctgatttcagtactcgtcaagctgttggtactgctaatgggttatcaggattatttggttatttaggcgctgcgattgcgggagtaggagtaggatggattagcgataattacggttggaatggagtatttatattttttagtatttctgctcttttaggaggaggattatttgctttgacatggaatcattcagctaaaaaatag

SEQ ID NO: 55867 - protein, 429 aa, Rickettsia typhi str. Wilmington
MTNIESKIKTPRSPYAKKYNSWRIRILYSIVIGYATFYFCRQNFNIATPAIREYFGVTKTQIGWILTAASIMYGVSKACNGFISDKVNARVFMVLGLLFVGIITILIGFSDFLWLIGILWIASNWFQSMGWPPATKMLTHWFAAKELGTKWAIGATSNQLGGALAMISCGYLIDKFDWRAAFFVPGLVACVASLFLYNRLRNSPKEVGLSTVEEYKEYPPEAIGNYERLLTTQLLKMVFCNKLIWYVCLANMFVYIIRSGVIYWAPTFLRDLCNISFVNAGLQIGLYEMIGIPGALIAGILSDKLFQGRRGPIASICMILLTLLLVLFWKVPIQSELLSIVILSLIGFFVSGPQLLVGIAAADFSTRQAVGTANGLSGLFGYLGAAIAGVGVGWISDNYGWNGVFIFFSISALLGGGLFALTWNHSAKK

SEQ ID NO: 55868 - DNA, 1359 bp, Bacillus licheniformis ATCC 14580
  CDS (1)..(1359): transl_table=11
atgttaaaactgtttaagccagcaccgccgattgagcggctgccggaagatcaaattgattcggaatataagaaattcagactgcaagtttttctcggcatcttcatcggttatgcggcatactatttaattcgcaaaaatttctcgcttgccatgccttatttgatcgaagagggcttttcaaagtcggcgctcggctttgccttgtccgctctatccatctcttacgggctgagcaagttcgtgatggccacgatatcggaccggagcaatccgaggatgttcctgcccgccggtttgatcctttccgctgtcatcagcctcttgatggggtttgttccttttttcacctcatcgatcgccattatgtttatcatgctgttcttaaacggctggttccagggcatgggatggccgccgtcagggcgtgtccttgtccactggttcagcgtcagcgaaaggggaaataaaaccgccatatggaatgtcgcccacaatgtcggcgggggactgatggcgccgattgccgttgccggcgtcgccatcttctcaggcataacgggatctgctacaggctatgaaggtgtgtttattttgccggccttggtcgccatcgccgttgccgtcatttcttactggctgatccgggatacgccgcagtctgtcggacttcctccaatcgaggaataccgcaacgattattcaagcaaatcgaagaaaacctttgaaaaggaattatcaacgaaagaaatccttttcaaacatgtattaaataataaatgggtgtgggcgatcgcacttgccaacattttcgtgtacttcgtccgctacggcgttctggattgggctccaacctatttaagcgaagaaaaaggctttgacatgagcaaatcaagcgtcgcttattttctgtatgaatgggcggggattccggggacattgctgtgcggctggatctctgacaaatggtttaaaggacgccgcggaccggcaggctttgtctttatggcaggtgttttgatcgcggtgcttgtgtactggttcaacccagccggcaatccgatgatcgacatggcatcattgatcgcgatcggattcctcatttacggtcccgtcatgctgatcggccttcaagcgcttgactttgttcctaaaaaagcggccggcacggctgcaggattgaccggtctgttcggttacctgggcggaaccttgacggcgaatgcgctgatgggtgttatcgtcgatgcatccggctggaatgcgggctttacgcttttaaccgcttcatgtgcaatcgcagcactcatatttgcgatgacttggaatgtgcggggacaggaagttgtgaagcattaa

SEQ ID NO: 55869 - protein, 452 aa, Bacillus licheniformis ATCC 14580
MLKLFKPAPPIERLPEDQIDSEYKKFRLQVFLGIFIGYAAYYLIRKNFSLAMPYLIEEGFSKSALGFALSALSISYGLSKFVMATISDRSNPRMFLPAGLILSAVISLLMGFVPFFTSSIAIMFIMLFLNGWFQGMGWPPSGRVLVHWFSVSERGNKTAIWNVAHNVGGGLMAPIAVAGVAIFSGITGSATGYEGVFILPALVAIAVAVISYWLIRDTPQSVGLPPIEEYRNDYSSKSKKTFEKELSTKEILFKHVLNNKWVWAIALANIFVYFVRYGVLDWAPTYLSEEKGFDMSKSSVAYFLYEWAGIPGTLLCGWISDKWFKGRRGPAGFVFMAGVLIAVLVYWFNPAGNPMIDMASLIAIGFLIYGPVMLIGLQALDFVPKKAAGTAAGLTGLFGYLGGTLTANALMGVIVDASGWNAGFTLLTASCAIAALIFAMTWNVRGQEVVKH

SEQ ID NO: 55870 - DNA, 1350 bp, Bacillus cereus E33L
  CDS (1)..(1350): transl_table=11
atgttttttacacaattctttaaacctgcgccccacgcggaacgcttaccagctgaccgcgttgatagtgaataccgtaaactacgtttacaagtattcttaggtatcttcatcggctatgcaggttattactttgttcgaaaaaacttttcactagcaatgccatacttaattgaacaaggctttagtaaaggggagcttggggttatcctttcagcagtttctatcgcttacggattaagtaaatttcttatgggtatcgtatccgatcgttgtaatcctcgctactttttagcagctgggctatttttatcaggtatcattaatattattttcggctcattttctttcattacaacgagtattatacttatgtttgtacttcagtttttaaatggatgggtacaaggtatgggatggcctccttgtggtcgtacaatggttcactggttctctattagtgaacgtggtacaaaaatgtctatttggaacgtcgctcataacgtcggcggagcgcttatgccttctcttgtaacattaggcttatacttctttgcgaatgactggaaaagtattttttacttcccaggtattctttcaattttagttggtatttatgtattaattacgatgagagatacacctcaatcttgtggattaccttctattgaagaacatactggagaatatccaccagatgaaaaagtacaagatcgtgaacgcgaactttcggtaaaagaaattttatttacatacgtactaaacaataaatttttatggtacatcgcgattgcgaacgttttcgtatatttcgtacgttacggtgttgtagactgggctcctacttatttagtagaagaaaaaagctttactcatagtagttcacgtacagcttatgctctatatgaatgggctggtattccaggtacacttctttgcggctggatgagtgataaactatttaaaggacgccgcgcacctgctggtattttatttatggttggtgtatttatcgccgttcttgtgtactggctaaaccctcctggtaatccaatggttgatagtatcgcacttgttgcaattggatttttaatttacggacctgttatgttaattggtctacacgctcttgacttagcaccaaagaaagcggctggaactgcagcgggcttaactggcttcttcggttacttaggcggagcagctttcgctagtgctgctatgggctttatcgtcgatgcatttggatgggatggcggattcatcttattacttgcatcttgtgtacttgcaatgttcttccttgctcttactttaaagacaggatctgcaaaaccaaagaaagcttaa

SEQ ID NO: 55871 - protein, 449 aa, Bacillus cereus E33L
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMRDTPQSCGLPSIEEHTGEYPPDEKVQDRERELSVKEILFTYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSAKPKKA

SEQ ID NO: 55872 - DNA, 1335 bp, Bacillus cereus E33L
  CDS (1)..(1335): transl_table=11
atgtttaaatggctcaagccagcacctgcaattgaaagattgcctgcggatatgatcgaccgtgtgtatcgattactacgtattcgtgtgttaatcggaatttcagttggatatgctgcttattatttagttcgtagtaactttacgttatcaagtacgtacttagtacaagaatatggttttagtacagctgaaattggtctactaggttcagtaatggcaattgtttatggttttagtaagttctttatggggaatttatcagataaagctttcgcccagcgctttatcgcagtcggtttatttttatcagggcttgtaaatatttgcttcggttttgcatcttcatttgggatgattgttacattacttgtcgttaacggtattgtacaaggtatgggagcaccaccttgtagtattgttatgacgaaatggttctcgaagaaagagcgcggtacgaaaacaggtatttggaatatttcacataacgttggtggaatgcttgtaccaccacttgttgggattggtgtaggtatttttggtgaaaatcattggcaaggcggcgtgtttattttcccggcgattatcgcaatgataatttcagttcttgtttggattaatgcgaaggatacaccggaatcagaaggtcttcctccaattgatgagtatcgtaatgactatgaaaatcttgaaaaagcagacaacgctaacaagatgtcaccaaaagaaattttaatgaagtatgtagtgaaaaataaatttgtatggttcttatgtattgcaaatgcatttgtatatttaattcgcttcggtgttattaactgggttccactgtatttaacgacagttaaaggtttctcaaaaaatgaagcacacgcggcgtacgcaatctttgaaggtatggcaattccaagttcattaatcgttggtcttttaagtgataaattatttaaaggaaaacgtatgccattatgtatcattagtatggtcggagttgttattggtacgtttgtatattggcaagcaactagcatacttgttgtaagtattgcagtttctattatcggttgtttaatttatgtaccacagttcttaatcggtttaagtgcgatggaattagtaccgaaatttgcagtaggtacgacagttggtatgtgtggtctgttcggttatgtaggcggaagtcttgtagcaaacgcagcaatcggtgttattgttgatcgttctggctgggatggttgtttcatcttactattaacaggtgccattttatcaacaatcttcttgttcatcgttcaacgtggacatgagagcaaagcttctaaagtagcataa

SEQ ID NO: 55873 - protein, 444 aa, Bacillus cereus E33L
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMIISVLVWINAKDTPESEGLPPIDEYRNDYENLEKADNANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKASKVA

SEQ ID NO: 55874 - DNA, 1458 bp, Mannheimia succiniciproducens MBEL55E
  CDS (1)..(1458): transl_table=11
ttggagaattttatgtttggtcctttcaaaccggctcctgctatcgcagagctgccggcagataaaatagactctacataccgccgcttacgctggcaggtatttatggggattttctttggttacgccgcattctacttcgttcgtgcgaatttcgatttagcacaaaaaggtttaattgaagcgggcatgtatacaaaaacggaactcggtattatcggtaccggcgcaggtcttgcttacgggttatctaaatttgtgatggccggtatgtctgaccgttccaacccgaaagtattcttacctttcggtttattactttcaggtttatgtatgaccttgatgggcttaattccatgggcgacatcaggcattttaattatgttcgtgctgatcttcctaaacggttggttccaaggtatgggttggcctccttgcggacgtacaatggttcactggtggtcaaaatccgaacgaggtaccatcgtttcaatttggaactgcgcccataacgtcggcggtatggttccgggtatgatggtattattggcaagcgccgtttatttcagtaataccggcgttcaggcaacagccaaagacgtatggcaacaagcgttatattatccgggtattgccgcgatgatcgcagccattccggtttatttcgtgatgaaagatacgccgcaatcctgcggtttaccgccgattgaaaaatggcgtaacgattatcctgacgactataacgaaaaaacatacgaacacgatttgactacaaaagaaattttcgtgaactatgtattaaaaaacaaattgttatggtacatcgctattgctaacgtattcgtttatttaatccgctacggcgtattaaaatggtctccggtatatttgggtgaagtaaaacactttaatatcaaaggtaccgcatgggcatatacaatttatgaattagccgcaattccgggcacattattgtgcggttgggtatcggataaaatcttcaaaggtaaacgcggtttaaccggtttcatcttcatgattttaaccactattgcggtatttgccttatggaaaaacccggctacaccggaagcggaactcgcgcaatacgcaggcttaccgttctataaaaatccgtaccaattgatggacttcattttaatgacaaccgttggtttcttaatctatggtcctgtaatgttaatcggtttacacgcacttgaacttgcaccgaaaaaagcggcgggtacttcagcaggtttcaccggcttattcggttacttgggcggtacggtttccgcatcagccgttgtcggttgggctgccgataaattcggttgggacggcggtttttacgtcatgatcaccggcggtatcttagcggttatcttaatgttcatcgttatggttgccgaaggaaaacacaaagccaaattgagcgatcattacggaaaataa

SEQ ID NO: 55875 - protein, 485 aa, Mannheimia succiniciproducens MBEL55E
MENFMFGPFKPAPAIAELPADKIDSTYRRLRWQVFMGIFFGYAAFYFVRANFDLAQKGLIEAGMYTKTELGIIGTGAGLAYGLSKFVMAGMSDRSNPKVFLPFGLLLSGLCMTLMGLIPWATSGILIMFVLIFLNGWFQGMGWPPCGRTMVHWWSKSERGTIVSIWNCAHNVGGMVPGMMVLLASAVYFSNTGVQATAKDVWQQALYYPGIAAMIAAIPVYFVMKDTPQSCGLPPIEKWRNDYPDDYNEKTYEHDLTTKEIFVNYVLKNKLLWYIAIANVFVYLIRYGVLKWSPVYLGEVKHFNIKGTAWAYTIYELAAIPGTLLCGWVSDKIFKGKRGLTGFIFMILTTIAVFALWKNPATPEAELAQYAGLPFYKNPYQLMDFILMTTVGFLIYGPVMLIGLHALELAPKKAAGTSAGFTGLFGYLGGTVSASAVVGWAADKFGWDGGFYVMITGGILAVILMFIVMVAEGKHKAKLSDHYGK

SEQ ID NO: 55876 - DNA, 1380 bp, Mannheimia succiniciproducens MBEL55E
  CDS (1)..(1380): transl_table=11
atgcttagttttttaaatgaagtgagaaaaccgacacttgatttgccggtggaagaacgtcgtaaaatgtggtttaaaccctttatgcaatcttatttggttgtgtttttcggttatatggcgatgtatttagtgcgtaaaaatttcaatatcgcgcaaaacgatatgattgaaacctacggtttgaccaaaacccaacttgggatgatcggtcttggattttccatcacctacggcttgggtaaaactatcgtttcttactatgccgacggcaaaaacaccaaacaattcgtgccgtttatgctgattctttccgcactttgtatgcttggttttagcgcaagcatgggtggcagtagcattgccttgttcttaatggtggcgttctatgccttgagcggtttcttccaaagtaccggtggttcttcaagttattccaccattaccaaatggacgccgcgtaaaaaacgcggtactttcctcggtttctggaatctgtctcataatgtaggcggagctgcggcagccggtgtagcgctattcggtgcgcacgtattctttaacggtcatgttatcggtatgtttattttcccttctattattgccttgattatcggctttatcggtttgcgttacggcagcgattcgcccgaagcttacggtttaggcaaagcggaagaattattcggtgaagaaatttcggaagaggacaaagacgccgaacaaaatcaattaacgaaaaaacaaatttttgtgcaatatgttttgaaaaacaaagtaatctggttgttatgttttgccaacatcttcctttacattgtgcgtatcggtatcgaccaatggtcgccggtttatgcctaccaagaattaggcttctctaaagatgcggcaatatcgggctttgccctatttgaagtgggcgccttagtgggaactttcctgtggggttatttatccgatctggcaaacgggcgccgcggtttattagcttgtgtggcattagtattaatcgtcttcactcttgagttttatcaatttgccaacaacgaaaccatgtatttagtggcgttattcgctttaggtttcttagtgttcggtccgcaattattgattggtgtggcggcagtaggtttcgtgccgaaaaaggccatcgccgtagcggacggtgtgaaaggcaccttcgcttacttaatcggtgacagctttgctaaactcggtttaggtatgattgctgacggtacgccgattttcggtttgacaggttgggacggcaccttcgcggccttaaactcatccgccttaatctgcattggattacttgcttttgttgcgattgccgaagagaaaaaaatccgtcgcttaaaaaaagcggaagcttaa

SEQ ID NO: 55877 - protein, 459 aa, Mannheimia succiniciproducens MBEL55E
MLSFLNEVRKPTLDLPVEERRKMWFKPFMQSYLVVFFGYMAMYLVRKNFNIAQNDMIETYGLTKTQLGMIGLGFSITYGLGKTIVSYYADGKNTKQFVPFMLILSALCMLGFSASMGGSSIALFLMVAFYALSGFFQSTGGSSSYSTITKWTPRKKRGTFLGFWNLSHNVGGAAAAGVALFGAHVFFNGHVIGMFIFPSIIALIIGFIGLRYGSDSPEAYGLGKAEELFGEEISEEDKDAEQNQLTKKQIFVQYVLKNKVIWLLCFANIFLYIVRIGIDQWSPVYAYQELGFSKDAAISGFALFEVGALVGTFLWGYLSDLANGRRGLLACVALVLIVFTLEFYQFANNETMYLVALFALGFLVFGPQLLIGVAAVGFVPKKAIAVADGVKGTFAYLIGDSFAKLGLGMIADGTPIFGLTGWDGTFAALNSSALICIGLLAFVAIAEEKKIRRLKKAEA

SEQ ID NO: 55878 - DNA, 1275 bp, Mannheimia succiniciproducens MBEL55E
  CDS (1)..(1275): transl_table=11
atgaatacaacattttcgcccgaaattaaccgcacttatcgctattggcgtattcacctgatgatcgctatgtatatcggctatgccggtttttacttaacccgtaaaagctttaactttgccgtgccggaaatgatcaataatctcggcattgataaaaatgacatcggtatgatggcgacgcttttttatatcacctatggagtgtcaaaattcttttcgggaattttttccgacaaatccaatccgcgccattttatggctgtcgggctgattatgaccggggtggcgaatattttcttcggtttatccagctccgtattgatatttaccgccgtgtggattatcaatgcctggttccaaggttggggctggcccgcttgttcaaaattattaaccacctggtattcccgtaacgagcgcggacgttggtggtctatttggaacaccgcccataatgctggcggggcgctgattccgctgcttataggttatgtaactattcattacagctggcgttacggctttgctattgccggcattgtggccatttctatcggtttgtttttattctggcgattgcgtaatacgcccgaatccctcggtttacccagcatcgggcattggcgaaatgacgaattagagcttgctcaagaggcggaagcaccaaatttaagctggcgtgaaaccttaaaccgttatgtattcttaaataaatatatctggttactcgcattaagctataccttggtttatattgtacgtaccgccattaatgactggggtaatatttatctcaccgaaaaatatcattatgatttggtgtccgccaacagtgctttagcggtttttgaaatcggcggtttctttggctctctggttgcgggttggggatccgatcgtcttttctccagcaatcgcgggccgatggcgctaattttcgctattgggattttcttttcaattaccgctctttggctgttaccgacagaaaattacattttacagaccgcactttttttcgtagtcggttttttcgtattcggtccgcaaatgttaataggtatggcggcggcagaatgttcccataaaaaaacaccgggttcagcaaccggctttgttggtctgttcgcctatttaggcgctgccattgcaggctatccgctggcgcttattatgcagcatttccactggacgggcttttttgtcttcattgcctgttcggcttccggtattgctctgttgctgcttccgtttttaaaggcgcaaaactaa

SEQ ID NO: 55879 - protein, 424 aa, Mannheimia succiniciproducens MBEL55E
MNTTFSPEINRTYRYWRIHLMIAMYIGYAGFYLTRKSFNFAVPEMINNLGIDKNDIGMMATLFYITYGVSKFFSGIFSDKSNPRHFMAVGLIMTGVANIFFGLSSSVLIFTAVWIINAWFQGWGWPACSKLLTTWYSRNERGRWWSIWNTAHNAGGALIPLLIGYVTIHYSWRYGFAIAGIVAISIGLFLFWRLRNTPESLGLPSIGHWRNDELELAQEAEAPNLSWRETLNRYVFLNKYIWLLALSYTLVYIVRTAINDWGNIYLTEKYHYDLVSANSALAVFEIGGFFGSLVAGWGSDRLFSSNRGPMALIFAIGIFFSITALWLLPTENYILQTALFFVVGFFVFGPQMLIGMAAAECSHKKTPGSATGFVGLFAYLGAAIAGYPLALIMQHFHWTGFFVFIACSASGIALLLLPFLKAQN

SEQ ID NO: 55880 - DNA, 1368 bp, Legionella pneumophila subsp. pneumophila str. Philadelphia 1
  CDS (1)..(1368): transl_table=11
atggcattattgagttttctaaaacctgctccatatcttgatgaaattcaggataaaaacgttgttaaacggcaatatcgttattggcgtattcgcaccttttatgcaatgtatatagggtatgcgttgttttattttacgcgaaagagttttaccttcgtgatgcctgcgttacaaagcaccttggggatgactaaaactgaactgggaatgatcgccagcattttgagtttaagttatggtatcagcaaatttttgagtggaattcttggtgataaatctaatcctcgttatttaatggcgatcggactgattttgacaggtgtttttaatattttgtttggattgtcttctacctggtggttattcgctattttttggggattgaatggttggtttcaagggtggggctggccaggatgtactaaattattaacacattggtattctcaatcggagcgtggccgttggtggagtctttggaatacatcacacaacgttggtggtgcattaattcctttgattgttgctgtgtgcgcgcaatacttcggctggcgttcagccatgtttgtgcctgggatcatttgcattttaggaggtgtttttttaatcaatcgtttaagagataccccacaatcacttggtttacccgcgatagagcaatatcatgaagatttttctggttccacaaatcaccaccaggagaaaacagaactctcagtcaaagaaattctttggaattatgtgttgtgcaaccaatatatttggatactgtccatttcttatttgtttatttacattgtccgaacggccattaatgattggagcatgttgtatttaacggaagtgaaagagtattccttaatcactgcaggcagttgtgtcatatggtttgaagttggtggcttttttggaaatctggttgccggctggtcttctgataaaatatttcaaggtaaacgcaatccaatcaacgttctttttactgcaggcgtatttgccactttattgctgtttacgttaaccagggcatatacaccgttcctcgatgctttgtttctttttttctttggtttttttatctttggaccacaaatgatgatcggtatggcctgtgcggaattagcacataaaaaagcagcggcgactgcaactggctttgccggattttttgcttattgtttaggtgctgttctggccggtgctcctttgggtgcaattatcaaaaattacggctgggataatttcttcctcacattgtttgtttgctgcttgattccattacttttgatgctgccgctctggcatgtgaaagttaatccaaagtatcgtcaatcagaattttcaggcaaatccgaatttgcttag

SEQ ID NO: 55881 - protein, 455 aa, Legionella pneumophila subsp. pneumophila str. Philadelphia 1
MALLSFLKPAPYLDEIQDKNVVKRQYRYWRIRTFYAMYIGYALFYFTRKSFTFVMPALQSTLGMTKTELGMIASILSLSYGISKFLSGILGDKSNPRYLMAIGLILTGVFNILFGLSSTWWLFAIFWGLNGWFQGWGWPGCTKLLTHWYSQSERGRWWSLWNTSHNVGGALIPLIVAVCAQYFGWRSAMFVPGIICILGGVFLINRLRDTPQSLGLPAIEQYHEDFSGSTNHHQEKTELSVKEILWNYVLCNQYIWILSISYLFIYIVRTAINDWSMLYLTEVKEYSLITAGSCVIWFEVGGFFGNLVAGWSSDKIFQGKRNPINVLFTAGVFATLLLFTLTRAYTPFLDALFLFFFGFFIFGPQMMIGMACAELAHKKAAATATGFAGFFAYCLGAVLAGAPLGAIIKNYGWDNFFLTLFVCCLIPLLLMLPLWHVKVNPKYRQSEFSGKSEFA

SEQ ID NO: 55882 - DNA, 1368 bp, Legionella pneumophila str. Paris
  CDS (1)..(1368): transl_table=11
atggcattattgagttttctaaaacctgctccatatcttgatgaaattcaggataaaaacgttgttaaacagcaatatcgttattggcgtattcgcaccttttatgcaatgtatatagggtatgcgttgttttattttacgcgaaaaagttttaccttcgtgatgcctgcattgcaaagcaccttggggatgactaaaactgaactggggttgatcgccagcattttgagtttaagttatggcatcagcaaatttttgagcggaattctaggtgataaatctaatcctcgttatttaatggcgatcggactgattttgacaggtgtttttaatattttgtttggattgtcttccacctggtggttattcgctattttttggggattaaatggttggtttcaagggtggggctggccaggatgtactaaattattaacacattggtactcccaatcggagcgtggccgttggtggagtctttggaatacatcgcacaacgttggtggtgcattaattcctttgattgttgctgtgtgcgcgcaatatttcggctggcgttcagccatgtttgtgcctgggatcatctgcattttaggaggtatttttttaatcaatcgtttaagagatactccacaatcgcttggcttgcccgcgatagagcaatatcatgaagatttttctggttccgcaaatcaccaccaggagaaaacagaactctcagtcaaagaaattctttggaattatgtgttgtgcaaccaatatatttggatattgtccatttcttatttgtttatttacattgtccgaacggccattaatgattggagcatgttgtacttaacggaagtgaaggagtattccttaatcacagcaggcagttgtgtcatatggtttgaggttggcggtttttttggaaatctggttgccggctggtcttctgataaaatatttcaaggtaaacgcaacccaatcaatgttctttttaccgcaggagtatttgccactttgttactgtttacgttaaccagggcatatacaccgttcctcgactctttgtttctttttttctttggtttttttatctttggcccacaaatgatgattggtatggcttgtgcggaattagcacataagaaagcagcggcgactgcaactggctttgccggattttttgcctattgtttaggcgctgttctggcaggcgctcctttgggtgcaattatcaaaaattacggctgggataatttcttcctcacattatttatttgctgcttgattccattatttttgatgctgccgctctggcatgtgaaagtcaatccaaaatatcgtcaatcagaattttcaggcaaatccgagtttgcttag

SEQ ID NO: 55883 - protein, 455 aa, Legionella pneumophila str. Paris
MALLSFLKPAPYLDEIQDKNVVKQQYRYWRIRTFYAMYIGYALFYFTRKSFTFVMPALQSTLGMTKTELGLIASILSLSYGISKFLSGILGDKSNPRYLMAIGLILTGVFNILFGLSSTWWLFAIFWGLNGWFQGWGWPGCTKLLTHWYSQSERGRWWSLWNTSHNVGGALIPLIVAVCAQYFGWRSAMFVPGIICILGGIFLINRLRDTPQSLGLPAIEQYHEDFSGSANHHQEKTELSVKEILWNYVLCNQYIWILSISYLFIYIVRTAINDWSMLYLTEVKEYSLITAGSCVIWFEVGGFFGNLVAGWSSDKIFQGKRNPINVLFTAGVFATLLLFTLTRAYTPFLDSLFLFFFGFFIFGPQMMIGMACAELAHKKAAATATGFAGFFAYCLGAVLAGAPLGAIIKNYGWDNFFLTLFICCLIPLFLMLPLWHVKVNPKYRQSEFSGKSEFA

SEQ ID NO: 55884 - DNA, 1368 bp, Legionella pneumophila str. Lens
  CDS (1)..(1368): transl_table=11
atggcattattgagttttctaaaacctgctccatatcttgatgaaattcaggataagaacattgttaaacggcaatatcgttattggcgtattcgcaccttttatgcaatgtatatagggtatgcgttgttttattttacgcgaaagagctttaccttcgtgatgcctgcgttacaaagcaccttggggatgactaaaactgaactgggaatgatcgccagcattttgagtttaagttatggtatcagcaaatttttgagtggaattcttggtgataaatctaatcctcgttatttaatggcaatcgggctgattttgacaggtgtttttaatattttgtttggattgtcttctacctggtggttattcgctattttttggggattgaatggttggtttcaagggtggggctggccaggatgtactaaattattaacacattggtattcccaatccgaacgtggccgttggtggagtctttggaatacatcacacaacgttggtggtgcattaattcctttgattgttgctgtgtgcgcgcaatacttcggttggcgttcagccatgtttgtgcctgggatcatttgcattttaggaggtatttttttaatcaatcgtttaagagataccccacaatcacttggtttacccgcgatagagcaatatcatgaagactgttctggttccgcaaatcaccaccaggagaaaacagaactctcagtcaaagaaattctttggaattatgtgttgtgcaaccaatatatttggatattgtcgatttcttatttgtttatttacattgtccgaacggccattaatgattggagcatgttgtatttaacggaagtgaaagagtattccttaatcactgcaggcagttgtgtcatatggtttgaagttggtggcttttttggaaatctggttgccggctggtcttctgacaaaatatttcaaggcaaacgcaatccaatcaacgttctttttactgcaggcgtatttgccactttattgctgtttacgttaaccagggcatatacaccgttcctcgatgccttgtttctttttttctttggtttttttatctttggaccacaaatgatgattggtatggcctgtgcggaattagcacataagaaagcagcggcgactgcaactggctttgccggattttttgcttattgtttaggtgctgttctggccggcgctcctttgggcgcaattatcaaaaattacggctgggataatttcttcatcacattatttatttgctgcttgattccattatttttgatgctgccgctctggcatgtgaaagtcaatccaaaatatcgtcaatcagaattttcaggcaaatcagaatttgcttag

SEQ ID NO: 55885 - protein, 455 aa, Legionella pneumophila str. Lens
MALLSFLKPAPYLDEIQDKNIVKRQYRYWRIRTFYAMYIGYALFYFTRKSFTFVMPALQSTLGMTKTELGMIASILSLSYGISKFLSGILGDKSNPRYLMAIGLILTGVFNILFGLSSTWWLFAIFWGLNGWFQGWGWPGCTKLLTHWYSQSERGRWWSLWNTSHNVGGALIPLIVAVCAQYFGWRSAMFVPGIICILGGIFLINRLRDTPQSLGLPAIEQYHEDCSGSANHHQEKTELSVKEILWNYVLCNQYIWILSISYLFIYIVRTAINDWSMLYLTEVKEYSLITAGSCVIWFEVGGFFGNLVAGWSSDKIFQGKRNPINVLFTAGVFATLLLFTLTRAYTPFLDALFLFFFGFFIFGPQMMIGMACAELAHKKAAATATGFAGFFAYCLGAVLAGAPLGAIIKNYGWDNFFITLFICCLIPLFLMLPLWHVKVNPKYRQSEFSGKSEFA

SEQ ID NO: 55886 - DNA, 1371 bp, Photobacterium profundum SS9
  CDS (1)..(1371): transl_table=11
atgtttggcatctttaaacccgcggttcatactgcgaaactgtctggtggacaaatagaccctgtctataaacgtctacgttggcaactctttatgggcattttctttggctatgccgggtattatctggtccgtaaaaacttcactctggctatgcctttcttgattgaagaatacggctatagtcgtggtgatttaggtgttgctctggctgctgtttctattgcctatggcttatcaaagttcttaatggggagtgtgtcagaccgttctaatccgcgctatttcatggcggcaggtttgaccatgtcggcgttggtgatgctgtgctttggctttatgccttgggcaacaggcagtattagtgccatgtttatcttattgttcttgaacggttggtttcagggcatgggatggccagcttgtggccgaacaatggtgcactggtggtcacgcaaagaacgtggtgaattagtgtctgtttggaacgtcgcgcataacgtgggtggcggtttaatcggtccaatgttcttattgggtttgtgggcctttaacgatgactggcgtacggcattttatgtacctgcattcttcgcgttgttggttgctgctttcacattaatcgccatgcgtgatacgccgcaatcttgtggtttgcctgccattgaagaatacaaaaacgattacccagataactacgatgaatcacatgaaaaagagatgaccggtaaggaaatcttcttcaagtatatatttaacaacaaattattgtggtttatcgcaattgcgaacgcatttgtttacttgattcgttatggcgtacttgattgggctccagtgtacttaagtgaagtaaaagatttttcagtagataaatcgtcttgggcatatttcctttatgagtgggcgggtattcctggcacattactgtgtggttggatgtcagataaattctttaaaggtcgtcgtgcacctgctggcatcttatttatgtcacttgtaacgattgcggtattggtttactggtttaatccaccgggcaacccaatgatcgatatggcagcactggttgctatcggcttccttatttatggtccggtaatgcttattggcctgtatgcattagagctagcaccgaagaaagcggcgggtacggcagctggccttactggtctgtttggataccttggtggtgcggttgtagcaaatatcgtattaggctataccgttgaccactttggttgggatggtggcttcatggtgctggtttcagcctgtggtttgtcaatcttcttcctcgtgttggcactgatgggtgaaaacaaggagcatgaaaaacgtgccattgagcgcgcgcaacaaaatgcatga

SEQ ID NO: 55887 - protein, 456 aa, Photobacterium profundum SS9
MFGIFKPAVHTAKLSGGQIDPVYKRLRWQLFMGIFFGYAGYYLVRKNFTLAMPFLIEEYGYSRGDLGVALAAVSIAYGLSKFLMGSVSDRSNPRYFMAAGLTMSALVMLCFGFMPWATGSISAMFILLFLNGWFQGMGWPACGRTMVHWWSRKERGELVSVWNVAHNVGGGLIGPMFLLGLWAFNDDWRTAFYVPAFFALLVAAFTLIAMRDTPQSCGLPAIEEYKNDYPDNYDESHEKEMTGKEIFFKYIFNNKLLWFIAIANAFVYLIRYGVLDWAPVYLSEVKDFSVDKSSWAYFLYEWAGIPGTLLCGWMSDKFFKGRRAPAGILFMSLVTIAVLVYWFNPPGNPMIDMAALVAIGFLIYGPVMLIGLYALELAPKKAAGTAAGLTGLFGYLGGAVVANIVLGYTVDHFGWDGGFMVLVSACGLSIFFLVLALMGENKEHEKRAIERAQQNA

SEQ ID NO: 55888 - DNA, 1338 bp, Photobacterium profundum SS9
  CDS (1)..(1338): transl_table=11
atgatcggttttttaaagtcggaacagcatgtacagccagtgaaagatccaaagcaaatcgatgagctttataagtactggcgctttcatattatgcttaccatgtatgcgggttatgctttgttttatttcactcgcaaaagctttaattacgcgatgccggcaatgattgctgatttagggctcgataagtcagatattggcttaatggggacacttttttatattacttacggtgtctctaagtttttatctggcatcgtgtctgatcggtcaaacccacgctattttatgggaataggattggtcatgacgggtattgtgaatattctttttggcttttctagttctatcgttatgttcaccttgctgtggatgaccaatgcgtggtttcaagggtggggctggccctcttgttctaaattgcttacaacctggtactcccgttcagagcgtggcttttggtggtctttatggaataccgcacataatgtagggggggcattgatccctttactcgtgggtgttgtgactttgcattacggctggcgatatggctttattattcccggtattttagctgtttttgtgggactatttctttgttggcgcttgcgtgataaacctgtgaccttggggctaccaactgttgggcactggcgtaacgatgcgctagagttagcgcaagaaaatgaagggttaggcttaactaacactgaaatattaaagaaatatgttttaaataataaatatatttggttactggcttttagttatgttcttgtttatatcgtgcgaactgccatcaatgattggggcaatctctatctgactgaacaacatcattacagtctaatcaccgcgaatgctgccttgtcgttattcgaagttggtggttttgttggttctttagttgcgggttgggggtcagataaaatatttgacggaaatcgtgggcccatgaacctgatttttgccattgggatctttttatcggttgcagctttatggttaatgccgatgactgggtttgtgctacaagcgggatgtttctttgcaatcggtttttttgttttcggtccccagatgttgatcggtatggctgctgcagaatgctcgcataaagactctgtaggcgctgctacaggctttgttggtctgtttgcctatatgggggcggctttagcggggtatcctctagcgttaattatggagcagtaccattgggctggcttctttacagttatttcatgtgccgctgcagtggtaggtctactgttgttaccgttcttaaaagcacaaacgtcagatgtaagtgctgcagctatacccaagtaa

SEQ ID NO: 55889 - protein, 445 aa, Photobacterium profundum SS9
MIGFLKSEQHVQPVKDPKQIDELYKYWRFHIMLTMYAGYALFYFTRKSFNYAMPAMIADLGLDKSDIGLMGTLFYITYGVSKFLSGIVSDRSNPRYFMGIGLVMTGIVNILFGFSSSIVMFTLLWMTNAWFQGWGWPSCSKLLTTWYSRSERGFWWSLWNTAHNVGGALIPLLVGVVTLHYGWRYGFIIPGILAVFVGLFLCWRLRDKPVTLGLPTVGHWRNDALELAQENEGLGLTNTEILKKYVLNNKYIWLLAFSYVLVYIVRTAINDWGNLYLTEQHHYSLITANAALSLFEVGGFVGSLVAGWGSDKIFDGNRGPMNLIFAIGIFLSVAALWLMPMTGFVLQAGCFFAIGFFVFGPQMLIGMAAAECSHKDSVGAATGFVGLFAYMGAALAGYPLALIMEQYHWAGFFTVISCAAAVVGLLLLPFLKAQTSDVSAAAIPK

SEQ ID NO: 55890 - DNA, 1326 bp, Photobacterium profundum SS9
  CDS (1)..(1326): transl_table=11
atgataggtttcctaacatcagagcaacctacaaaaataataaccgataaacaacaaatcgacgccacgtacaaatactggcgattgcatttaatgttttcaatgtatatcggttacggcatgttttattttacccgaaaaagtctcaactttgccatgccagctatgttagctgaccttggcttagagcattcagacatcgggtttctcggcaccctattctatatcacgtatggcgtatcaaaatttgtttctggtatggtcagcgaccagtctaaacccagctatttcatgggattaggtttgatcgctaccggaatcatcaatattgcatttggtttaagttcatctctggcgatgttcgccattttgtggacattgaatgcctttttccaaggctggggttggcccccctgcgctaaattgctcacaacatggtattcccgtacagagcgtggcttttggtggtcaatctggaatacttgccacaatttagggggagctttagttccgctgggtattggttttaccgccatgactttgggttggcgatatggctttattattcccggcattctggcaattttagtgggtattgtgctgtgttttcgcatgcgagataagcctacaaccatggggttaccaaccgtagggcaatggcgaaacgatgaattagagttattacaagaacaagaaggccgagggctatcttttcgccaaatattgaaaacctatgtcattggcaataaatatatctggttgttgtgtagctcgtactttttagtatatgtggtgcgcattgcaattaatgattggggaaatctctacttaattgaacgtcatggttttgatttattttcagccaatgccgccgtttcaatgttcgaagtcggaggatttctaggttcattgtttggcggctggggttcagatcgattctttcatggtaatcgtgcccccatgaacttaattttcgcattgggtattttcatttcagtggccgcattatggcttacacctatgaataacttttcagtcttggcctgttgttttttctccattggattctttatttttggcccacaaatgatgatcggaatggctgcagccgaatgctcacacaaaggtgttgctggaacagcgactggatttgtcggcttgtttggatatttaggggccgcgctggcaagctacccaatatcattggttatcgagcaatttagctgggatggtttcttcagcattattacattttcggccgcctctattggcctgctgatattgccatttgttaaggctcagcaaccttcaattactgctacctag

SEQ ID NO: 55891 - protein, 441 aa, Photobacterium profundum SS9
MIGFLTSEQPTKIITDKQQIDATYKYWRLHLMFSMYIGYGMFYFTRKSLNFAMPAMLADLGLEHSDIGFLGTLFYITYGVSKFVSGMVSDQSKPSYFMGLGLIATGIINIAFGLSSSLAMFAILWTLNAFFQGWGWPPCAKLLTTWYSRTERGFWWSIWNTCHNLGGALVPLGIGFTAMTLGWRYGFIIPGILAILVGIVLCFRMRDKPTTMGLPTVGQWRNDELELLQEQEGRGLSFRQILKTYVIGNKYIWLLCSSYFLVYVVRIAINDWGNLYLIERHGFDLFSANAAVSMFEVGGFLGSLFGGWGSDRFFHGNRAPMNLIFALGIFISVAALWLTPMNNFSVLACCFFSIGFFIFGPQMMIGMAAAECSHKGVAGTATGFVGLFGYLGAALASYPISLVIEQFSWDGFFSIITFSAASIGLLILPFVKAQQPSITAT

SEQ ID NO: 55892 - DNA, 1359 bp, Salmonella enterica subsp. enterica serovar Paratyphi A str. ATCC
  CDS (1)..(1359): transl_table=11
atgttgagtatttttaaaccagcgccgcataaagcgcgcttgccagcggcggagattgatccgacctatcgccgattacgttggcagattttcctggggatattctttggctatgccgcgtattatctggtgcgcaagaactttgccctcgcgatgccctacctggtagaacagggtttttcacgcggcgatctgggctttgcgctgtccgggatttccatcgcttatggtttttcgaaatttataatgggttcggtgtccgatcgctcgaatccgcgcgttttcctgccggcagggttgattctggccgcagcagtcatgttgtttatgggctttgtgccgtgggcgacatccagcatcgccgtgatgtttgtgctgttgttcctttgcggctggttccaggggatggggtggccgccgtgcggacgtacgatggttcactggtggtcgcagaaagagcgcggcggcattgtgtcggtctggaactgtgcgcataacgtcggcggcgggatcccgtcactgctgttcctgctggggatggcgtggtttaacgactggaaagcggcgctctatatgccagcctttggcgcgattgtggtggcgctgttcgctttcgcaatgatgcgcgatacgccgcaatcctgcggtctgccgcctatcgaagagtataaaaacgactatccggatgactacaacgaaaaagcggaagaagagctgactgcgaagcagatcttcatgcagtacgtactgccgaacaaattactgtggtatatcgctatcgccaacgtgtttgtttatctgctgcgctacggcatcctcgactggtcaccgacctacctgaaagaagtgaagcatttcgcactggataaatcctcctgggcctacttcctgtatgaatacgcgggtattccgggcacgctgctgtgtggctggatgtcggataaagtcttccgcggcaaccgtggcgcgaccggcgtattctttatgaccctggtgactatcgcgaccatcgtttactggatgaacccggcagggaacccgaacgttgatatggcttgtatgattatcatcggcttcctgatctacggcccggtaatgttgatcggtctgcacgcgctggaactggcgccgaaaaaagcggcgggtacggcggcgggctttaccggtctgtttggttacctgggcggttctgtcgctgcaagcgccattgtgggttataccgttgacttcttcggttgggatggcggctttatggtgatgattggcggcagcattctggcggtaatcctgctggtggtcgtgatgattggtgaaaaacgccatcatgatgagctgcagttaaaacgcaacggaggctaa

SEQ ID NO: 55893 - protein, 452 aa, Salmonella enterica subsp. enterica serovar Paratyphi A str. ATCC
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPSLLFLLGMAWFNDWKAALYMPAFGAIVVALFAFAMMRDTPQSCGLPPIEEYKNDYPDDYNEKAEEELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPNVDMACMIIIGFLIYGPVMLIGLHALELAPKKAAGTAAGFTGLFGYLGGSVAASAIVGYTVDFFGWDGGFMVMIGGSILAVILLVVVMIGEKRHHDELQLKRNGG

SEQ ID NO: 55894 - DNA, 1317 bp, Francisella tularensis subsp. tularensis SCHU S4
  CDS (1)..(1317): transl_table=11
atgaatttccttaaacctgcaaaagctctgcctttactagctaaagagcaaattcaaaaagcataccctcactggcgcctaagaatgttcttagtggcttatataggttactttatatactatttcggtcgtagtagttttgatgtctcaaaacaatatattacaaccctaactccagatgagcttggattaattggagctggtctaggtattgcctatggtataagtaagtttctaatgggaaatatctctgatagaagtaatgccaaagtatttttagctatcggattatttatcacaggacttataaaccttctattgccaagcttattatcattaggcgtacttgtaatgtttatcgcaatgcttgtaaacggttgggtgcaaggtatgggctggccagcatgtgctcgtataatgacacactggttttgtgctaatgagcgtggtactaaaatgggtatttggaatactgctcataacgttggagcaggttttttagctattgctgttgtgcctattggattactgctatttcatgatgactggcatggtcttttttatgttgcaggagcaatgtgtatttttgtatcaattttagtcctgatatttggtgctgacactcctcaatcagttggcttaccagcaatagaagtatataaaggttatactactgccgaagctcatcatgaacaagagttttcagctaaagaaatctttttaaaatatgtattaaataataagtgggtttggttaattgccatagcgaatgcatttgtttattgtgctaggtatggtcttcttagctggtcaacttattatcttgttaatgtaaagcatatgtctaccactaccggacttttaggttttgcattatttgaattaccagcaattccaggaactataataattggttggataacagataagtattttggtagtcgtagagccccaatgggtgtaatatgtatgcttttatttatttgtgctttatttgtatattggtatagtgatactgcttgggtattattactttcattatctgcgatgggagtactaatatatgggcctgtcgctttgatagggatattggctttggacttagtacctaaaaaagctggtgggactgcagctgggtttacaggattatttggctattttttaggtacagttggagcacaagctgtgattggtattattgccacaatgctaggatgggacgctgtatttatatttttattaggttcatgtataattgccatagcacttctagctgtttgctggaatcttagttataatcaagctttcagtgattaa

SEQ ID NO: 55895 - protein, 438 aa, Francisella tularensis subsp. tularensis SCHU S4
MNFLKPAKALPLLAKEQIQKAYPHWRLRMFLVAYIGYFIYYFGRSSFDVSKQYITTLTPDELGLIGAGLGIAYGISKFLMGNISDRSNAKVFLAIGLFITGLINLLLPSLLSLGVLVMFIAMLVNGWVQGMGWPACARIMTHWFCANERGTKMGIWNTAHNVGAGFLAIAVVPIGLLLFHDDWHGLFYVAGAMCIFVSILVLIFGADTPQSVGLPAIEVYKGYTTAEAHHEQEFSAKEIFLKYVLNNKWVWLIAIANAFVYCARYGLLSWSTYYLVNVKHMSTTTGLLGFALFELPAIPGTIIIGWITDKYFGSRRAPMGVICMLLFICALFVYWYSDTAWVLLLSLSAMGVLIYGPVALIGILALDLVPKKAGGTAAGFTGLFGYFLGTVGAQAVIGIIATMLGWDAVFIFLLGSCIIAIALLAVCWNLSYNQAFSD

SEQ ID NO: 55896 - DNA, 1359 bp, Staphylococcus epidermidis RP62A
  CDS (1)..(1359): transl_table=11
atgtttaatttcttaaaaccagctagacatatcaaatcattgccatcagaaaaagtagatgatacgtataaaagactacgctttcaagtctttttaggaatatttatcggttatgctggttactatttattaagaaagaacttctctttagcaatgccttcattaattgagcaaggctttagtaaaggggaattaggtattgcattatctgcagtatctatcgcatatggctttagtaaatttgtaatgggcactgtcagcgatcgaagtaatgctcggatgttcttaactttaggtttagtattgacagcaattattaacttattattaggatttattccattctttacttcaagcataactattatgtttatcatgctgtttttagttggatggttccaaggaatgggctggccaccatctggacgtgtgttagttcattggtttagtgtcagcgaacgtggaagcaaaacgtcaatatggaatgtagcacataatgtaggcggaggtttaatggcacctattgctacgtggggtatttccatgactgcattatacaacttcggttatttaaaagggtttgaaggtgtctttatataccctgcactattggctatcattattgccatcttgtcttacatactaattagagatacaccacaatctcagggtttaccaccaattgagcagtataaaaatgattatgccacttcaactaaacaaacaattgaaacagaactaactacgaaagaaatattatttaaatatgtacttaataacaaatgggtatgggcgattgcttttacaaacattttcgtttattttgtgcgttatggtgttttggactgggctccgacatacttaagtgaggaaaagcattttgatttaagtgcttcaggttgggcttacttcttatacgaatgggcaggaattccgggcacgctactctgtggttatctatctgacaaactatttaaaggtcgccgtggtccagcaggcttcttctttatgttaggcgtaacaatctttatccttatatattggttaaatccaccaggtcacgcatggttagataatctttcattaattggtattggtttcttaatttatggtccagtcatgttaattggtttacaagcgttagattatgttcctaaaaaagcagctggcactgcggctggtctaactggtctatttggatacttattcggtgcagttatggctaatattgtattagggtttgtagttcaacattttggatggcatattggctttgtgttattaacagtcatcagcatactcgctatgttatgtttcattttaacttggaataaacgtggtcaagaacaaatcgactag

SEQ ID NO: 55897 - protein, 452 aa, Staphylococcus epidermidis RP62A
MFNFLKPARHIKSLPSEKVDDTYKRLRFQVFLGIFIGYAGYYLLRKNFSLAMPSLIEQGFSKGELGIALSAVSIAYGFSKFVMGTVSDRSNARMFLTLGLVLTAIINLLLGFIPFFTSSITIMFIMLFLVGWFQGMGWPPSGRVLVHWFSVSERGSKTSIWNVAHNVGGGLMAPIATWGISMTALYNFGYLKGFEGVFIYPALLAIIIAILSYILIRDTPQSQGLPPIEQYKNDYATSTKQTIETELTTKEILFKYVLNNKWVWAIAFTNIFVYFVRYGVLDWAPTYLSEEKHFDLSASGWAYFLYEWAGIPGTLLCGYLSDKLFKGRRGPAGFFFMLGVTIFILIYWLNPPGHAWLDNLSLIGIGFLIYGPVMLIGLQALDYVPKKAAGTAAGLTGLFGYLFGAVMANIVLGFVVQHFGWHIGFVLLTVISILAMLCFILTWNKRGQEQID

SEQ ID NO: 55898 - DNA, 1365 bp, Vibrio fischeri ES114
  CDS (1)..(1365): transl_table=11
atgtttggtgtttttaaacctaaagcacatatcgcacaactcccaacaggagaaatcaatagcacttataaacggttacggtggcaactttttctcggcattttctttggttatgctggatactatcttgttcgaaaaaacttcagtttagcaatgccttaccttatcgaacaaggatacagtcgaggcgatttaggggttgctctagctgcggtatctatcgcttatggtttatctaaattcttaatgggaagtgtttctgaccgttccaatcctcgatattttctcagtgctggtttggtcatgtctgctctcgttatgttttgttttggctttatgccttgggcaacaggcagcattaccgccatgtttatcttgttatttttaaatggttggtttcaaggtatgggatggcctgcctgtggtagaaccatggtgcactggtggtcaagaaaagagcgtggtgaaatagtttcggtatggaacgttgcacacaacgttggaggcgggttaattggcccaatgttccttcttggtttatgggcatttaatgatgattggcgaactgcgttttacgtaccagctttctttgctcttcttgttgctttttttgtttggttaacagtaagagatactcctcaatcatgcggtcttccgccaattgaagaatttaaaaacgactacccagatgattatgattccgcatatgaaacagaaatgacggcgaaagaaatcttcttcaagtatgttttttcaaataaattattgtggtctattgcgatagccaacgcctttgtctacctaatccgttatggcgttttagattgggctcctgtttacttaaaagaagccaaagaattcactgttgataaatcttcttgggcatatttcctatatgagtgggctggtattccaggcacccttctatgtggttggatttctgataagttatttaaagggaaacgagcgcctgctgggattctatttatggcattagtgactattgcagtattggtttactggtttaaccctgcaggaaacccaaccgttgatatgatcgcattagttgctattggtttcttaatctatggtccggtaatgcttattggtttatatgcgttggaattagcacctaaaaaggcggcgggtacagcggcaggattaactggattatttggttaccttggtggagccgttgcagcgaacgcactgcttggttataccgttgaccactttggttgggatggtggctttatgatcttagttgcctcttgtgtcatctctattgtttgcctaacttatgcactaattggtgagcaaaagcatcataaagaaaagattgagaaagaaagtcacatggcttaa

SEQ ID NO: 55899 - protein, 454 aa, Vibrio fischeri ES114
MFGVFKPKAHIAQLPTGEINSTYKRLRWQLFLGIFFGYAGYYLVRKNFSLAMPYLIEQGYSRGDLGVALAAVSIAYGLSKFLMGSVSDRSNPRYFLSAGLVMSALVMFCFGFMPWATGSITAMFILLFLNGWFQGMGWPACGRTMVHWWSRKERGEIVSVWNVAHNVGGGLIGPMFLLGLWAFNDDWRTAFYVPAFFALLVAFFVWLTVRDTPQSCGLPPIEEFKNDYPDDYDSAYETEMTAKEIFFKYVFSNKLLWSIAIANAFVYLIRYGVLDWAPVYLKEAKEFTVDKSSWAYFLYEWAGIPGTLLCGWISDKLFKGKRAPAGILFMALVTIAVLVYWFNPAGNPTVDMIALVAIGFLIYGPVMLIGLYALELAPKKAAGTAAGLTGLFGYLGGAVAANALLGYTVDHFGWDGGFMILVASCVISIVCLTYALIGEQKHHKEKIEKESHMA

SEQ ID NO: 55900 - DNA, 1341 bp, Vibrio fischeri ES114
  CDS (1)..(1341): transl_table=11
atgtttggatttttacgctcaaccacatcaaatgacaacacacttagtgatactcaagtaaacgaaagttatcgctattggcgtttacatatcatgatcggcatgtacattggttatgctggtttttactttactcgtaaaacctttaactatgccgctcctgctatgatcacagatttagggcttgataaaggtgatctcggtttaatcggcactcttttctatatctcgtacggcttatcaaaatttctttcaggcaccatttctgatcgctctaaccctcgttattttatggggctaggattaattgccaccggactgattaatattgcttttggcttctctagttcattagcggcttttatctctctgtgggtacttaatgcatggtttcaaggatggggttggccttcatgttcaaagctcctcaccacttggtactctcgatctgaaagagggttccgttgggcaatatggaacacagcacacaacatcggtggagcgctaatccctattcttgtgggctatttaacccttcattacagttggcgagaaggttttatcttaccgggtattattggtgtcgcaattggacttattgtatgttggcgtctacgtgataaacccaccaccatgggcttacctagtgtaggaaaatggcgtaatgatccactagagctcgcacaagaaaaccatggccaaggattaagctatcgagagattttaaaaacctatgtgtttagtaataagtacatttggttactcgcttttagctatgtattggtttacatcgtaagaaccgcagtcaatgactggggaaacctgtatctcacagaagaacacaactacagcttaattaatgcaaatgccgcattatccctatttgaaattggcggttttgtgggctctcttgttgctggatggggttctgacaagctctttgggggcaatcgtggacctatgaatattttgttcgctattggtatttttctttccgtttcagcgttatggcttatgccgttaaccaattttgtgtttcaagctgctgggctattttctgttggtttctttgtttttggaccacaaatgttaattggtatggctgcggctgaatgctcacacaaagactcggcaggcgccgctacagggtttgttggattatttgcttatatgggggcagcgctttcaggctacccattagcggtgattttagaaacctatggatggacagggttctttatcaccatttcgacttgtgctgctgtcatagggttactgcttctgccctttttacaagctcaatcacctcaaaaaccgattgaaacaagagtacgcttataa

SEQ ID NO: 55901 - protein, 446 aa, Vibrio fischeri ES114
MFGFLRSTTSNDNTLSDTQVNESYRYWRLHIMIGMYIGYAGFYFTRKTFNYAAPAMITDLGLDKGDLGLIGTLFYISYGLSKFLSGTISDRSNPRYFMGLGLIATGLINIAFGFSSSLAAFISLWVLNAWFQGWGWPSCSKLLTTWYSRSERGFRWAIWNTAHNIGGALIPILVGYLTLHYSWREGFILPGIIGVAIGLIVCWRLRDKPTTMGLPSVGKWRNDPLELAQENHGQGLSYREILKTYVFSNKYIWLLAFSYVLVYIVRTAVNDWGNLYLTEEHNYSLINANAALSLFEIGGFVGSLVAGWGSDKLFGGNRGPMNILFAIGIFLSVSALWLMPLTNFVFQAAGLFSVGFFVFGPQMLIGMAAAECSHKDSAGAATGFVGLFAYMGAALSGYPLAVILETYGWTGFFITISTCAAVIGLLLLPFLQAQSPQKPIETRVRL

SEQ ID NO: 55902 - DNA, 1395 bp, Vibrio fischeri ES114
  CDS (1)..(1395): transl_table=11
atgttaaagttcttagatcaggttagaaaaccaacattagatcttccggtagaagtacgaagaaaaatgtggtttaagcctttcctacaatcttacctagttgtatttattggttatttaaccatgtatctgatccgtaaaaacttcaatgtcgcacaaaacgacatgatttcaacttacggattatcaatgactgacttaggtctgattggtcttggcttttcaattacttatggtattggtaaaaccgttgtgtcttactatgctgatggtaaaaacaccaaacaattcttacctttcatgctgattctttctggtttagctatgctaggttttagcttcagtatgggtggcggcagcgcgagtctattcatgatggtcgctttctatgcgttaagtggttttttccaaagtacaggtggtccttcaagttactcaaccatcactaaatggacgcctcgtaataaacgtggttcatatttaggtctttggaatatgtcacacaacgttggtggtgctggtgcggctggtgttgctctatttggtgcaaactacctatttgatggcaacgttatcggtatgttcgtattcccatctatcattgcaatcattgttggctttattggtatgcgttttggtagtgactcaccagaagcttatggcctaggtaaagttgaagaactttttgatgaagagatcagtgaagaagatactgctgctgaagaaaatcaaatgacgaaaaaagagatctttgttgagtatgtacttaaaaacaaagtgatctggttactctgctttgcgaatattttcttatacattgttcgtattggtatcgatcaatggtctacggtttacgcttatcaagaattaggtctatcaaaagaaactgctatttcaggctttactctatttgaagtcggcgctcttgttggcacattaatgtggggttatttatctgaccttgctaacggtcgtcgtgctttggttgcttgtgtttctcttggcttaatcattgtgtcactagagttttaccaacacgcgaccagtgagttcatgtatcttgcttctctgtttgtacttggtttcttagtgtttggtcctcagttattaattggtgttgctgcggttggttttgttcccaaaaaagccatcagtgttgccgatggtgtgaaaggtactttcgcttacttaattggtgacagctttgcaaaactaggccttggtatgattgcagatggtactcctatctttggcttaaccggttggaaaggcacatttgcggcgttagatacttctgctgcaatctgtattttcttacttgtgtttgtcgctatcgccgaagagaagaaaatccgtcacgctaaaaaaatgcacctagctgcaaaacaagcgtaa

SEQ ID NO: 55903 - protein, 464 aa, Vibrio fischeri ES114
MLKFLDQVRKPTLDLPVEVRRKMWFKPFLQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFMMVAFYALSGFFQSTGGPSSYSTITKWTPRNKRGSYLGLWNMSHNVGGAGAAGVALFGANYLFDGNVIGMFVFPSIIAIIVGFIGMRFGSDSPEAYGLGKVEELFDEEISEEDTAAEENQMTKKEIFVEYVLKNKVIWLLCFANIFLYIVRIGIDQWSTVYAYQELGLSKETAISGFTLFEVGALVGTLMWGYLSDLANGRRALVACVSLGLIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAAICIFLLVFVAIAEEKKIRHAKKMHLAAKQA

SEQ ID NO: 55904 - DNA, 1392 bp, Salmonella enterica subsp. enterica serovar Choleraesuis str
  CDS (1)..(1392): transl_table=11
atgttaacaatattaaaaacagggcaatcggcgcataaagtcccaccggaaaaagtccaggctacgtatggtcgatatcgtatacaggcattgttaagcgtatttctgggatatctcgcttactatatagtcagaaacaacttcacattatcgacgccttatttaaaagagcaattggatctcagcgctacgcaaatcggcctgctgagtagctgtatgcttattgcttacggaatcagtaaaggcgtaatgagcagtctggcggataaagccagcccaaaagtcttcatggcgtgcggtctggtactctgcgcgattgttaacgttgggctgggattcagtagcgcattctggatatttgccgctctggtggtcttcaatggcctttttcagggcatgggcgtcggcccctcgtttattactattgcaaactggttccctcgtcgggaacgcggacgcgtaggcgccttctggaatatctcgcataacgttggcggcgggatcgtcgcgcctatcgtcggtgcggcttttgcgatattgggcagcgaacactggcaaagcgccagttatatcgttccggcctgcgtcgccgtcatttttgccttaattgttctggtcttgggaaaaggttcgccgcgcgaagaaggtcttccctccctggaacagatgatgccggaagaaaaagtcgtactgaaaacgaagaatacggcaaaagcgccggaaaatatgagcgcatggcaaatcttctgtacttatgtgctgcgcaataaaaatgcctggtatatttcgctggtggatgtcttcgtctatatggtgcggtttggcatgattagctggttgcctatctatctgttgacagtaaaacacttttcaaaagaacagatgagcgtcgcgtttctctttttcgagtgggcggcgattccctccacgctactggcaggctggctgtcagataaactgtttaagggccgcagaatgccgttagccatgatttgcatggcgctgatttttgtctgtctgatcggatactggaaaagtgaatctttgctgatggtaacgattttcgccgccattgtaggttgtctgatttacgtcccgcagttcctcgcgtccgtacagacaatggagatagtccccagctttgccgtaggttccgccgtcggtttacgtgggttcatgagctatattttcggcgcctcgttgggcaccagcctgtttggtgtaatggtggataaacttggctggtacggcggattttatcttctgatgggcggcatcgtgtgctgcattctattctgttacctctcccatcgcggcgcgctggaactggaacgccagcgccagaatgcgttacataatcaggactcactgcagcttgcggacgcgcaataa

SEQ ID NO: 55905 - protein, 463 aa, Salmonella enterica subsp. enterica serovar Choleraesuis str
MLTILKTGQSAHKVPPEKVQATYGRYRIQALLSVFLGYLAYYIVRNNFTLSTPYLKEQLDLSATQIGLLSSCMLIAYGISKGVMSSLADKASPKVFMACGLVLCAIVNVGLGFSSAFWIFAALVVFNGLFQGMGVGPSFITIANWFPRRERGRVGAFWNISHNVGGGIVAPIVGAAFAILGSEHWQSASYIVPACVAVIFALIVLVLGKGSPREEGLPSLEQMMPEEKVVLKTKNTAKAPENMSAWQIFCTYVLRNKNAWYISLVDVFVYMVRFGMISWLPIYLLTVKHFSKEQMSVAFLFFEWAAIPSTLLAGWLSDKLFKGRRMPLAMICMALIFVCLIGYWKSESLLMVTIFAAIVGCLIYVPQFLASVQTMEIVPSFAVGSAVGLRGFMSYIFGASLGTSLFGVMVDKLGWYGGFYLLMGGIVCCILFCYLSHRGALELERQRQNALHNQDSLQLADAQ

SEQ ID NO: 55906 - DNA, 1368 bp, Chlamydophila abortus S26/3
  CDS (1)..(1368): transl_table=11
atgaatatttggaccaaattctttcagcctcccaagcacattaaagaacttgatgatccagaattagtcaaaaaacaatacaagtattggagaatccgcatcttctatagcatgtttatagggtatgtcttctattatttcacaaggaagagttttacctttgccatgcccacactaatgacagatcttggctttgataaagcgcaactggggatcatcggaagtactttatacatcagttacggtgtgagcaaatttgttagtggtgtgatatctgaccagtccaatcctcgttattttatggcgctgggtttaattgttacaggattcactaatatcttcttcggaatgtcttcctcgatcttgttatttgcattatggtgggggcttaacggttggtttcaaggctggggctggcctccatgtgcccgtttactcactcactggtattcgaaatctgaaagaggaacatggtggagtgtgtggagcacttcgcacaatattggtggggcattaattcctattctcacaggatttgctattgattgttgtggttggcgcggggcgatgtttgtccccggtatactctgtattctcatgggattagttttaattaatcgccttcgtgatacgccacaatccctaggtcttccttccattgaaaaattccgaaaaaaacaggaatctcaaaaacacgaagaaaccactgtagatattttagaagaagaagcagaaaaagagctttctactagagaaatcctctttacttatgtgttgaaaaacaaatggatctggttattgtcctttgcttcatttttcatttatgttgtccgtatggccgtcaatgattggagcgctttattcttgattgaaacaaagcgttacgtagctgttaaagccaatttctgtgtttctctatttgagattggcggactttttggcatgttaattgctggatggttatctgataaaatttccaaaggcaaacgcggtcctatgaatgttgtattttctttaggattgctattctccattttaggcatgtggtacagccgtaatcaagatatgtggtggttagatggctcccttctttttgttattggctttttcttgtttggtcctcaaatgatgatagggttagcagctgctgaactatcacataaaaaagctgcaggtacggctagcggctttgcaggatggtttgcgtattttggagcagcgtttgcaggttatccgttaggaaaaatagctcaagattggggctggagaggtttctttattgcccttctgggttgcgctttaatagctttggttttgttccttcctacatggaatgcctcagagagaagtttacaaactagaaaataa

SEQ ID NO: 55907 - protein, 455 aa, Chlamydophila abortus S26/3
MNIWTKFFQPPKHIKELDDPELVKKQYKYWRIRIFYSMFIGYVFYYFTRKSFTFAMPTLMTDLGFDKAQLGIIGSTLYISYGVSKFVSGVISDQSNPRYFMALGLIVTGFTNIFFGMSSSILLFALWWGLNGWFQGWGWPPCARLLTHWYSKSERGTWWSVWSTSHNIGGALIPILTGFAIDCCGWRGAMFVPGILCILMGLVLINRLRDTPQSLGLPSIEKFRKKQESQKHEETTVDILEEEAEKELSTREILFTYVLKNKWIWLLSFASFFIYVVRMAVNDWSALFLIETKRYVAVKANFCVSLFEIGGLFGMLIAGWLSDKISKGKRGPMNVVFSLGLLFSILGMWYSRNQDMWWLDGSLLFVIGFFLFGPQMMIGLAAAELSHKKAAGTASGFAGWFAYFGAAFAGYPLGKIAQDWGWRGFFIALLGCALIALVLFLPTWNASERSLQTRK

SEQ ID NO: 55908 - DNA, 1350 bp, Pseudomonas syringae pv. syringae B728a
  CDS (1)..(1350): transl_table=11
atgtttgggtttttccgtcctgccaggcatcaggcaccccttcccgaagaaaaggtcgacagcacctatcggcgtctgcgctggcagatcttcgcaggcatctttatcggctatgcgggttactacctgctgcgcaagaatttctcgctggcgatgccgtatctgatcgacgaaggctatacgcgtggccagctgggcgtggcgatgtctgccattgccattgcctacggcttgtcgaaattcctcatgggcatcgtttcggatcgctccaacccgcgttacttcctgccgttcggcctgctggtctctgccgggatcatgttcatcttcggcttcgcgccgtgggcgacgtccagtgtcacgatcatgttcgtgctgctgttcatcaatggctgggcacagggcatgggctggccgccgagcgggcggacaatggttcactggtggtcgcagaaagagcgcggcggtgtggtgtcggtgtggaacgtggcgcacaacgtcggcggcggcctgatcggcccgctgttcctgctcggcatgggctggaccaacgactggcatgcggcgttctacgtgccggcggcggttgcgttgctggtcgcggtgttcgccttcgcgaccatgcgtgacaccccgcaatcggtcggcctgccgcctatcgagcactacaagaacgattacccggaaggctacgatgccagccacgaggaagaattcagcgcccgggagatcttcgtcaagtacgtgctgcgcaacaagttcctgtggtacatcgccatggccaacgtgttcgtttatctgctgcgctatggcgtactggactgggcaccgacctatctcaaggaagccaaacacttcacggtcgacaagacctcctgggcttactttctgtacgagtgggcgggcattccgggcacgctgctgtgcggctggatgtcggacaagatcttcaagggcaatcgcggcctgaccggcatggtgttcatgtttctggtgaccatcgccacgctggtgtactggctgaaccctgaaggcaatccgaccgtcgacatgatcgcgctggtgtccatcggtttcctgatctacggaccggtgatgctgatcggcctgcaggcgctggaactggcaccgaagaaggcagcaggcacggccgccggctttaccgggctgttcggctatctgggcgggtcggtcgcggccagcgcagcgatgggctacacggttgaccacttcggctgggatggcggcttcgtgctgttgatcggcgcgtgcattctggcgatggtgttccttgcgccgacgctgcggcacaaacaggtcgccagcacatctcgcgacaccaaaggctga

SEQ ID NO: 55909 - protein, 449 aa, Pseudomonas syringae pv. syringae B728a
MFGFFRPARHQAPLPEEKVDSTYRRLRWQIFAGIFIGYAGYYLLRKNFSLAMPYLIDEGYTRGQLGVAMSAIAIAYGLSKFLMGIVSDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDASHEEEFSAREIFVKYVLRNKFLWYIAMANVFVYLLRYGVLDWAPTYLKEAKHFTVDKTSWAYFLYEWAGIPGTLLCGWMSDKIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMVFLAPTLRHKQVASTSRDTKG

SEQ ID NO: 55910 - DNA, 1326 bp, Pseudomonas fluorescens Pf-5
  CDS (1)..(1326): transl_table=11
atgaacaagcagatcggcaccatcaaacgttggcgcgtgcagattttcgccatcacctggatcgcctacgcggcgttctacttcacccgcaaagccttttccgtcgccaagcttgggatcgccgacgatcccgacttcaccctcgacaagatggccatggccaacctcgacgccatctacctggcggcctacgccgtggggcagttcacctggggcatcttcgccgaccgcttcggcccgcgggtggtggtgctgggcggcttgctgatttccgccgctgcggcgctggtgatgggcagcttcgccaccttgccggtgttcgccacctgcatgctggtccaggggctggcgcagtccacgggctggtcggggctgtgcaagaacatcggcagtttctttcccgccgggcagcgcggcagggtgctggggctgtggagttcctgctacgccttcggcggcctggtggcctcgccctttgccggctggtgggcctatacgctgatcggcacctggcacgcggcgttcatttccagcgcggtggtggtgggcttgaccgcggtgctgttcttcatcttccagcgcaataccccggaggacgtgggcctgccggccgtggagccattgcccccgcagagcgccgaagaagacgccgccggacggcgcatgagcgtctgggaaccgctgcgcgagatcctgcgcaaccgcacggtgctgatcctcgggctgtcgtacttcctgctcaagccggcgcgttacgcgatcctgctgtgggggccggtgatcgtttacgaacagatgccctcggtgggcaaggtgggggcggcgatcgtgcccaccagcttcgagctggccgggctgttggggccggtgatgatcggcctggcctcggacaagctgttcggcgcccggcgcatgccggcatgtgtcatcagcctgctggcgctgaccctgtccctggcgctgttcatgggcgctctgcataccggcagcgtcgtgctggtgatggccctgctgtttttcatgggcctgaccctgtacgggccggactcgatgatctgtggcgctgcagccatcgacttcggctcggccaaggccggggccaccgcggccggtttcgtcaatggctgcggctcggtgggcgcggtgctgggtggcctgctgccgggttacttcgacacggtcacggtgttcatcgtgtttgccgcctgcgccctggtctcggccctggtgctggtgccgtactggaacagccggccccaagggctcgagccggtgcgcgcactcgttcccaatggacctttgctgatcaaaccgctgcgtacctga

SEQ ID NO: 55911 - protein, 441 aa, Pseudomonas fluorescens Pf-5
MNKQIGTIKRWRVQIFAITWIAYAAFYFTRKAFSVAKLGIADDPDFTLDKMAMANLDAIYLAAYAVGQFTWGIFADRFGPRVVVLGGLLISAAAALVMGSFATLPVFATCMLVQGLAQSTGWSGLCKNIGSFFPAGQRGRVLGLWSSCYAFGGLVASPFAGWWAYTLIGTWHAAFISSAVVVGLTAVLFFIFQRNTPEDVGLPAVEPLPPQSAEEDAAGRRMSVWEPLREILRNRTVLILGLSYFLLKPARYAILLWGPVIVYEQMPSVGKVGAAIVPTSFELAGLLGPVMIGLASDKLFGARRMPACVISLLALTLSLALFMGALHTGSVVLVMALLFFMGLTLYGPDSMICGAAAIDFGSAKAGATAAGFVNGCGSVGAVLGGLLPGYFDTVTVFIVFAACALVSALVLVPYWNSRPQGLEPVRALVPNGPLLIKPLRT

SEQ ID NO: 55912 - DNA, 1350 bp, Pseudomonas syringae pv. phaseolicola 1448A
  CDS (1)..(1350): transl_table=11
atgtttgggttcttccgccccgccaggcatcaggcaccccttcccgaagaaaaggtcgatagcacctatcggcgtctgcgctggcagatcttcgcaggcatctttatcggttatgccggttactacctgctgcgcaagaatttctcgctggcgatgccgtatctgatcgacgaaggctatacgcgtggccagctgggcgtggcgatgtcggccatcgcgattgcctatggcctgtcgaaattcctcatggggatcgtttcagaccgctccaatccgcggtacttcctgccgttcggcctgctggtgtctgccgggatcatgttcatcttcggcttcgcgccgtgggcgacgtccagtgtcacgatcatgttcgtgctgctgttcatcaatggctgggcacagggcatgggctggccgccgagcgggcggacgatggtccactggtggtcgcagaaagagcgcggcggcgtggtgtcggtgtggaacgtggcgcacaacgttggcggcggcctgattggcccgctgttcctgcttggcatgggctggaccaacgactggcacgcagcattctatgtgccggcggccgttgcgctgctggtggcggtctttgctttcgccaccatgcgcgacaccccgcaatcggtgggcctgccgcctatcgagcactacaagaacgattacccggaaggctacgatgccagccacgaagaggaattcagcgcccgggaaatcttcgtcaaatacgtgctgcgcaacaagttcctgtggtacatcgcgatggccaacgtgttcgtttatctgctgcgctacgacgtgctggactgggccccgacctacctgaaagaagccaagcatttcacggtcgacaagacctcatgggcctattttctttacgagtgggcaggtattccgggcacgctgctgtgcggctggatgtcggacaggatcttcaagggtaatcgcggcctgaccggcatggtgttcatgtttctggtgaccattgccacgctggtgtattggctgaaccctgaaggcaacccgaccgtcgacatgatcgcgctggtgtctatcggtttcctgatctacggcccggtcatgctgatcggcctgcaggcgctggaactggcaccgaagaaggcagcgggtacggcagccggctttaccgggctgttcggctacctgggcgggtcggtcgcggcgagtgctgcgatgggctacacggtcgaccacttcggctgggacggcggctttgtgctgctgatcggcgcgtgcattctggcgatggcattccttgcgccgacgctgcggcacaaacaggtcgccagcacctcgcgcgataccaaggactga

SEQ ID NO: 55913 - protein, 449 aa, Pseudomonas syringae pv. phaseolicola 1448A
MFGFFRPARHQAPLPEEKVDSTYRRLRWQIFAGIFIGYAGYYLLRKNFSLAMPYLIDEGYTRGQLGVAMSAIAIAYGLSKFLMGIVSDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDASHEEEFSAREIFVKYVLRNKFLWYIAMANVFVYLLRYDVLDWAPTYLKEAKHFTVDKTSWAYFLYEWAGIPGTLLCGWMSDRIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMAFLAPTLRHKQVASTSRDTKD

SEQ ID NO: 55914 - DNA, 1323 bp, Shigella sonnei Ss046
  CDS (1)..(1323): transl_table=11
atgatgttgccgtttctgaaagcgcctgccgatgcgccattaatggctgataaatatgaaattgatgcccgctatcgctactggcgtcggcatattctgctgaccatctggctgggttacgcgctgttttacttcacgcggaaaagttttaacgccgccgtaccagaaatccttgctaacggcgtgctcagccgtagcgatatcggcctgttagcgaccctgttttacattacctatggcgtgtcgaagtttgtctccggcattgtcagcgatcgctcaaatgcccgttattttatggggatagggcttatcgccacgggcattatcaacattctgtttggcttctcgacgtcgctatgggcgtttgccgtactctgggtgctgaacgcctttttccagggctggggttcaccggtgtgtgcgcgtctgttaacggcctggtattcacgtaccgagcgcggtggttggtgggcattatggaacacggcgcataacgtcggcggcgcactcattcccattgtgatggcagcggctgcactacattacggctggcgtgccgggatgatgattgctggttgtatggcgatcgtcgtgggaatttttctctgctggcggctgcgcgatcgcccgcaggcgttaggtttaccggcggtcggtgaatggcgacacgacgcgctggagatagctcaacaacaagaaggggcagggctgacgcgtaaagagatcctcaccaaatatgtgttgctgaatccgtatatctggctgctttcgttttgctatgtgctggtctatgtggtccgggcggcgatcaacgactggggcaatttgtatatgtccgagacgctgggcgtcgatctggtcacggcgaatacggcagtgacgatgtttgaactgggtggatttatcggtgcgctggtagcgggttggggctcggacaaattgtttaacggcaaccgagggccgatgaatttgattttcgccgccggaattttgctttcagtcggctccctgtggctgatgccatttgccagctacgtgatgcaggcaacctgcttcttcaccattggtttttttgtctttggcccacagatgttaatcggtatggcggcggcagagtgttcccacaaagaggcggcaggggcggcgacggggtttgtcggcttgtttgcttatctgggggcgtcgcttgctggttggccgctggcgaaagtactcgatacctggcactggagcggattttttgtggttatctctatcgccgccgggatttccgcactgctgttactgccctttttgaacgcccagacaccgcgcgaagcgtga

SEQ ID NO: 55915 - protein, 440 aa, Shigella sonnei Ss046
MMLPFLKAPADAPLMADKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 55916 - DNA, 1353 bp, Haemophilus somnus 2336
  CDS (1)..(1353)
ttgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgcttctatttggaactgtgcacataatatcggaggtatggtaccgggattaatggtattgttggcaagtgcgatttatttcagcgagtttggagtacaggcaactgcaaaagatatttggcaacaagcgttatattatccgggtattgccgctatgatttgtgcaattccggtctattttgtgatgaaagatacaccacagtcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgaattagctgcggtaccgggtacattattatgtggttgggtttccgacaaagtatttaagggtaaacgtggtttaaccggtttcattttcatgattttgactactattgcagtggtagcattatggatgaacccagcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataaccggtggtattttagccatcctgttaatgtttatcaccatgatagaagaaggtaaacataaagcaaaactagacgatcattacggtaaataa

SEQ ID NO: 55917 - protein, 450 aa, Haemophilus somnus 2336
MGIFFGYAAYYFVRANFDLAQKGLIEAGLYNKAELGIIGTGAGLAYGLSKFVMAGISDRSNPKVFLPFGLLLSGLCMTMMGLMPWATSGIAVMFVMIFLNGWFQGMGWPPCGRTMVHWWSKSERGTIASIWNCAHNIGGMVPGLMVLLASAIYFSEFGVQATAKDIWQQALYYPGIAAMICAIPVYFVMKDTPQSCGLPAIEKWRNDYPDDYNEKTYENNLTTKEIFVTYVLKNKLLWYIAIANVFVYLIRYGVLKWSPVYLGEVKHFNIKGTAWAYTIYELAAVPGTLLCGWVSDKVFKGKRGLTGFIFMILTTIAVVALWMNPATPEHELAQYAGKAWYQNPYQLTDFILMTTVGFLIYGPVMLIGLHALELAPKKAAGTSAGFTGLFGYLGGTVSASAVVGWAAEYYGWDGGFYVMITGGILAILLMFITMIEEGKHKAKLDDHYGK

SEQ ID NO: 55918 - DNA, 1443 bp, Haemophilus influenzae R2866
  CDS (1)..(1443)
atgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaaccaggtttaattcaagctggcttgtactcaaaagcggaactaggtgttatcggctcagcggctggtcttgcttacggtttatcaaaattcgttatggcaggtatgtctgaccgctctaaccctcgtgtattcttaccgtttggtttattgctctctggtttatgtatgaccttaatgggtctattcccatgggcaacttcaggcattgccattatgtgggtaatgatcttcttaaatggttggttccaaggtatgggttggcctccatgtggtcgtactatggtgcattggtggtctaaatctgaacgtggttctatcgtgtcaatttggaatacggcgcacaatatcggcggtatggtgccgggtgcgatggtgctattagcaagtgcaattttcttcagcactcacggtattgaagcgcaggcgaaagatgtttggcaacaatcattatacttcccaggtattgctgcaatgatctgtgcaattcctgtgtacttcgtgatgcgtgatacgccacaatcttgtggtttaccatcaatcgaaaaatggcgtaatgactacccagatgactataacgaaaaaacttacgaaaacgatttaactgcaaaagaaatctttgtcacttatgtattaaaaaacaaattgttatggtacatcgcactggctaacgtatttgtatatttaattcgctatggcgtattaaaatggtctccggtttacttaagtgaagtaaaacacttcaacatcaaaggtaccgcatgggcatacacaatctatgaattagcagcggttccaggtacgttattatgtggttgggtatcagataaagtattcaaaggtaaacgtggtttaactggtttcatcttcatgatcttaaccactgcagcagttgttgcatactggatgaatcctgcgacaccagaagctgaattagcgaactacagcgcatggtatcaaaacccataccaattaactgacttcgtattaatgactttaatcggtttcttaatctatggtcctgtaatgttaatcggtttacatgcgcttgagttagcaccgaaaaaagcagcaggtactgcagcaggtttcaccggtttattcggttacttaggtggtacagtttctgcatcagcagttatcggttgggctgctcaacattatggatgggacggtggtttcttcgtcatgatcggcggtggtgtattagcagtgttattactcttaatcgtaatggttgaagaaggaaaacacaaagcgaaattaggcgatacttacggtactaaataa

SEQ ID NO: 55919 - protein, 480 aa, Haemophilus influenzae R2866
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGSIVSIWNTAHNIGGMVPGAMVLLASAIFFSTHGIEAQAKDVWQQSLYFPGIAAMICAIPVYFVMRDTPQSCGLPSIEKWRNDYPDDYNEKTYENDLTAKEIFVTYVLKNKLLWYIALANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYQNPYQLTDFVLMTLIGFLIYGPVMLIGLHALELAPKKAAGTAAGFTGLFGYLGGTVSASAVIGWAAQHYGWDGGFFVMIGGGVLAVLLLLIVMVEEGKHKAKLGDTYGTK

SEQ ID NO: 55920 - DNA, 1350 bp, Bacillus cereus G9241
  CDS (1)..(1350): transl_table=11
atgtttttcacacaattctttaaacctgcgccccacgcggaacgcttaccagctgatcgcattgatagtgaataccgtaaattacgtttacaagtattcttaggtatcttcatcggctatgcaggttattactttgttcgaaaaaacttttcactagcaatgccatacttaattgaacaaggctttagtaaaggggaacttggggttatcctttcagcagtttctattgcttacggattaagtaaatttcttatgggtatcgtatccgatcgttgtaatcctcgctactttttagcagctgggctatttttatcaggtatcattaatattattttcggctcattttctttcattacaacaagcattatacttatgttcgtacttcagtttttaaatggatgggtacaaggtatgggatggcctccttgtggtcgtacgatggttcactggttctctattagcgaacgtggtacaaaaatgtctatttggaacgtcgctcataatgttggcggagcgcttatgccttcccttgtaacattaggcttatacttcttcgcagatgactggaaaagtattttttacttcccaggtattctttcaattttagttggtatttatgtattaattacgatgaaagatacgcctcaatcttgcggattgccttctattgaagaacatactggagaatatccaccagatgaaaaagtaaaagatcgcgaacgtgaactttcagtaaaggaaattttatttaaatacgtattaaacaataagtttttatggtacatcgctattgcgaacgttttcgtatatttcgtacgttacggcgttgtagactgggctcctacttatttagtagaagaaaaaagctttactcatagtagctcacgtacagcttacgctctatatgaatgggctggtattccaggtacacttctttgtggctggatgagtgataaactatttaaaggacgccgcgcacctgctggtattttatttatggttggtgtatttatcgccgttcttgtgtactggctaaaccctcctggtaatccaatggttgatagtatcgcacttgttgcaattggatttttaatttacggacctgttatgttaattggtctacacgctcttgacttagcaccaaagaaagctgctggaactgcagcgggcttaactggcttcttcggttacttaggcggagcagctttcgctagtgctgctatgggctttatcgtcgatgcatttggatgggatggcggattcatcttattacttgcatcttgtgtacttgcaatgttcttccttgctcttactttaaagacaggatctgcaaaacaaaagcaagcttaa

SEQ ID NO: 55921 - protein, 449 aa, Bacillus cereus G9241
MFFTQFFKPAPHAERLPADRIDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFADDWKSIFYFPGILSILVGIYVLITMKDTPQSCGLPSIEEHTGEYPPDEKVKDRERELSVKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSAKQKQA

SEQ ID NO: 55922 - DNA, 1311 bp, Pseudomonas fluorescens PfO-1
  CDS (1)..(1311)
ttgcctgaagaaaaaatcgacagcacctaccgacgcctgcgttggcagatcttcgccggcatcttctttggttacgcgggttactacctgctgcgcaagaacttctcgctggccatgccgtacctgatcgacgaaggctacagccgtggcgatctgggcctggcaatgtcggccatcgccatcgcctacggtctgtccaagttcctcatgggcctggtttccgaccgctccaacccgcgttacttcctgccgttcggcctgctggtatcggccggggtgatgttcattttcggtttcgcgccttgggcaacctccagcgtgaccatgatgttcatcctgctgttcatcaacggttgggcccagggcatgggctggccgccgagcggacgcacgatggtgcactggtggtcgcagaaggaacgtggcggcgtggtgtcggtgtggaacgtggcgcataacgtcggtggcggtctgatcggcccgctgttcctgatcggcatgggcctgttcaacgactggcacgcagcgttctacgtcccggccgccgtggctctggcagtagcggtgttcgctttcgtgaccatgcgtgacaccccgcaatcggtcggcctgccgccgatcgagaagtacaagaacgactacccggaaggctacgacgccagccacgaagacgaattcagcgccaaggaaatcttcgtcaaatacgtgctgcgcaacaaaatgctctggtacatcgccatggccaacgtcttcgtctacctgctgcgttacggcgtgctggactgggcgccgacctacctgaaagaagccaagggtttcaccgtggataaaacctcgtgggcctatttcttctacgaatgggcggggattccgggcacgctgctgtgcggctggatgtcggacaagatcttccgtggcaaccgtggcctgaccggcatggtgttcatggccctggtgaccgtcgcgacgctggtgtactggctgaacccggccggcaacccgaccatcgacatgatcgcgctgttctcaatcggcttcctgatctacggcccggtgatgctgatcggcctgcaagcgctggaactggcgccgaagaaagccgccggcactgccgcaggcttcaccggtctgttcgggtatctgggtggttcggtcgcggccagtgcagcgatgggctacaccgtggaccatttcggctgggatggtggtttcgtgctgctggtgggcgcttgcctgctgtcgatggccttcctggccccgaccctgtggcacaagcaagtcgccagtcagagccgtgaagcggtcgcctga

SEQ ID NO: 55923 - protein, 436 aa, Pseudomonas fluorescens PfO-1
MPEEKIDSTYRRLRWQIFAGIFFGYAGYYLLRKNFSLAMPYLIDEGYSRGDLGLAMSAIAIAYGLSKFLMGLVSDRSNPRYFLPFGLLVSAGVMFIFGFAPWATSSVTMMFILLFINGWAQGMGWPPSGRTMVHWWSQKERGGVVSVWNVAHNVGGGLIGPLFLIGMGLFNDWHAAFYVPAAVALAVAVFAFVTMRDTPQSVGLPPIEKYKNDYPEGYDASHEDEFSAKEIFVKYVLRNKMLWYIAMANVFVYLLRYGVLDWAPTYLKEAKGFTVDKTSWAYFFYEWAGIPGTLLCGWMSDKIFRGNRGLTGMVFMALVTVATLVYWLNPAGNPTIDMIALFSIGFLIYGPVMLIGLQALELAPKKAAGTAAGFTGLFGYLGGSVAASAAMGYTVDHFGWDGGFVLLVGACLLSMAFLAPTLWHKQVASQSREAVA

SEQ ID NO: 55924 - DNA, 1290 bp, Rickettsia akari str. Hartford
  CDS (1)..(1290)
atgacagatacaaaacccaaaattaaaactccaagatcgccatatgtaaaaaaatataatagttggcgagtaaggattttatattctattattataggttatgcgactttttatttgtgtcgtcagaattttaatatagcaactcctgctataagagaatattttggggttactaaaacgcaaattggttggatattaactgcttcatctattatgtatggagtgagtaaagcttgtaatgggtttattagcgacaaagttaatgctcggatatttatggttttgggtcttttagttgtcggaatcattactattctaataggtttttcatattctttgtggtttataggaattttatggatatccagtaactggtttcaatcgatggggtggccccctgcaacaaaaatgcttactcactggtttgcttcaaaagaacttggcactaaatgggctatgggtacaacctctaatcaaataggtggtgccattgctatgataagctgcggttatttaatcgataaatttgattggagagctgcttttttcgttcctggtgtagtcgcttgtgtagtatcgctttttttatataataggcttcgtaattccccaaaagaagtaggtttatctaccgtagaggaatataaagaatatccgcctgaatctataggagattatgagaagctattaactccacaattacttagaatggtcttttgtaataggctaatatggtatgtttgtttagcaaatatgtttgtttatataatacgttccggagtaatttattgggctccaacatttttaaaagatttacgtaatataagccttgcaaatgcaggattacaaattggtttatatgaaatgataggtattcccggggcgttgatagctggctttttatcggataaattatttcaaggacgtcgcggtcctattggagcgatatgtatggtattgcttagcttattgttagtcttgttttggacaattcctattcaaagtgaattattaagtatagtaattctatctttaataggcttttttgttgcaggacctcagctccttgtaggtatagcagctgctgatttcagtactcgtcaagctgtcggtacggctaatggattatcagggttatttggttatttaggagcctctattgcaggaatcggcgtaggatggattagcgatcattatggttggaatggagtatttatatttttcagtatttctgctcttttaggaggagggttgtttgctttaacatggaatcgttcagctaaaaaataa

SEQ ID NO: 55925 - protein, 429 aa, Rickettsia akari str. Hartford
MTDTKPKIKTPRSPYVKKYNSWRVRILYSIIIGYATFYLCRQNFNIATPAIREYFGVTKTQIGWILTASSIMYGVSKACNGFISDKVNARIFMVLGLLVVGIITILIGFSYSLWFIGILWISSNWFQSMGWPPATKMLTHWFASKELGTKWAMGTTSNQIGGAIAMISCGYLIDKFDWRAAFFVPGVVACVVSLFLYNRLRNSPKEVGLSTVEEYKEYPPESIGDYEKLLTPQLLRMVFCNRLIWYVCLANMFVYIIRSGVIYWAPTFLKDLRNISLANAGLQIGLYEMIGIPGALIAGFLSDKLFQGRRGPIGAICMVLLSLLLVLFWTIPIQSELLSIVILSLIGFFVAGPQLLVGIAAADFSTRQAVGTANGLSGLFGYLGASIAGIGVGWISDHYGWNGVFIFFSISALLGGGLFALTWNRSAKK

SEQ ID NO: 55926 - DNA, 1146 bp, Wolbachia endosymbiont of Drosophila simulans
  CDS (1)..(1146): transl_table=11
atgctgctttatttatcaagacaaagtataccaattgctctaccactgttaatagatactgaccatgtaaaattaagctatttttttgcctgcttttcttttttttatggagtatcaaaatttgttaatggaataatcatggactccaaaaataatccattatttatgtttgggctatgcaatattgcaactggattattaaccattggtataactttatcatataataatctaactttattactgttaacattaatattattagcttggacacaagggttaggttggccagctattaccaagtttatggttacaaactctagcatctcttcaattgcatcatcatggggagttatgagcgcatctcagcaacttggttcttgtattactttaattgtattaccaagtataattaaaatatataatgcaaaaagtgcatttttgtactctggtttcttatgcttactttttggaatttatataatattaaaggcatattacaaagaaagtgccaactttactacctattataaggtgcagaaatctcaaataggtatcaaggtaacaagttccatatggtttctatgttgtgctactttttgtgcttatattataaaaatgggaatcttcttttggtttcctataattttaaagaataaattacaaatttctcttgtacaatcctcactaataacaggcgtatatgatttaggtggaatccttggaactttaataacaggaagaattagtgatatgtacttctttcaaaatagaagcttgctggcatcactttatatgttgggtatagcactcacttttattgcaatgaactttggtcaaaacataattcttatgaacctttgtgcaatcttatcaggattctttatatttggagtgcaagtactgacaggtgttatagctgtagaaattgctccacaaaataatgtatgtgcaattgtaagcttaacaggattatttgggtatattgcaagttcaatattttcatgcgtgctcttaggagtacttgttaagcactgtggtaacagtattatgttttcatttttttccatttgctctgttgttgcactcgtttgcttttccatactatcaagcaaagatctaaaaaaactaagtaaagcggtgtaa

SEQ ID NO: 55927 - protein, 381 aa, Wolbachia endosymbiont of Drosophila simulans
MLLYLSRQSIPIALPLLIDTDHVKLSYFFACFSFFYGVSKFVNGIIMDSKNNPLFMFGLCNIATGLLTIGITLSYNNLTLLLLTLILLAWTQGLGWPAITKFMVTNSSISSIASSWGVMSASQQLGSCITLIVLPSIIKIYNAKSAFLYSGFLCLLFGIYIILKAYYKESANFTTYYKVQKSQIGIKVTSSIWFLCCATFCAYIIKMGIFFWFPIILKNKLQISLVQSSLITGVYDLGGILGTLITGRISDMYFFQNRSLLASLYMLGIALTFIAMNFGQNIILMNLCAILSGFFIFGVQVLTGVIAVEIAPQNNVCAIVSLTGLFGYIASSIFSCVLLGVLVKHCGNSIMFSFFSICSVVALVCFSILSSKDLKKLSKAV

SEQ ID NO: 55928 - DNA, 1605 bp, Arabidopsis thaliana
  CDS (1)..(1605)
atggcgatgaattcgaagaggaaaacaccacctgggattgcgcttctgaggagagtcagaggaagaaattggagtccaaagacgtttcggtacgcgattttgtttattactttcatcgcatatgcttgttaccatgcttctcgtaaaccaagcagcatagtgaagagcgttttacacccagactcaagcactaagccacctcaagaacataacagcgacaaaatttatccttggcctatgggtaacgtgtttgtgaagagagaaattggtgatatagatgaggttttgttgcatcgtaagtctaaaggatgggaaccgtttaatgggaaagatgggacgtctaggttgggagagattgatgtggcgtttcttgcttgttactctataggaatgtatgttgctggtcatttgggtgatagtttggatctgagattgtttctgacttggggaatgattgggagtgggttctttgttgggttgtttggtatgggttatttctggaacattcatgcgttttggttctttttggttatgcaaatggcggctgggttgtttcaggcgacaggatggccatctgttgtggctgttgttgggaattggtttgggaaaaggaagagaggtcttataatggggatttggaatgctcatacttctgttgggaacatttgtggttctttaattgctgctggtgttcttgaatatggttggggatggtcttttatagctcctggttttgtcatgtctttaggaggagttcttgtttatttgttcttggctgcgtatcctgaggatgttgggtttccagatatcaattctaattcagggaagtttattaagaggaagagagatgttgaagaggaagaagaggaagtagaagaagatttagggacagatgttgaaggggatggggagggatcatcagggtcaggttcagggtatgagaataaaagaagtgttggacttttgcaagcttgtatgatccctggtgttataccgtttgcgttgtgtctctttttctcgaagctggtcgcgtacacgttcttgtactggttaccgttttacttgagccaaacaactattggtggagagtacgtgtctgtgaaaacagcagggaatctctccacactatttgatgttggaggcattgtaggagggattctttgtggttacatttcagacaaattcaaagcaagggctacaactgcagctgcattcatgtacgctgcgattccggcaatgcttgtgtaccattcctatggaggtgtctctcagacagtcaacatcctcctcatgatggttgctggtttgtttgtcaatggtccttatgcactcatcacaaccgcagtctctgcggatctgggaacgcacaagtctttacaaggcgattcaagggcgcttgcgactgttactgctatcattgacgggactggatctgccggtgcggctttaggtccgcttttgacagggtttctttctactctgggttggcaagctgtgttctatatgttggtcgttggagctctctgtgctggtttgcttttgacccgtctggttattgctgaaattagagagaaacttggatatgttgatgaagaaggtaaataa

SEQ ID NO: 55929 - protein, 534 aa, Arabidopsis thaliana
MAMNSKRKTPPGIALLRRVRGRNWSPKTFRYAILFITFIAYACYHASRKPSSIVKSVLHPDSSTKPPQEHNSDKIYPWPMGNVFVKREIGDIDEVLLHRKSKGWEPFNGKDGTSRLGEIDVAFLACYSIGMYVAGHLGDSLDLRLFLTWGMIGSGFFVGLFGMGYFWNIHAFWFFLVMQMAAGLFQATGWPSVVAVVGNWFGKRKRGLIMGIWNAHTSVGNICGSLIAAGVLEYGWGWSFIAPGFVMSLGGVLVYLFLAAYPEDVGFPDINSNSGKFIKRKRDVEEEEEEVEEDLGTDVEGDGEGSSGSGSGYENKRSVGLLQACMIPGVIPFALCLFFSKLVAYTFLYWLPFYLSQTTIGGEYVSVKTAGNLSTLFDVGGIVGGILCGYISDKFKARATTAAAFMYAAIPAMLVYHSYGGVSQTVNILLMMVAGLFVNGPYALITTAVSADLGTHKSLQGDSRALATVTAIIDGTGSAGAALGPLLTGFLSTLGWQAVFYMLVVGALCAGLLLTRLVIAEIREKLGYVDEEGK

SEQ ID NO: 55930 - DNA, 1374 bp, Streptococcus agalactiae A909
  CDS (1)..(1374): transl_table=11
atgttgaaaaaactatttgcaccccctcagaaaagagaacgtttatcagctgaggaaattaagcataaatatcctcgttatcgtgtacaagtccttatttctatttttgtaggttatatgggatactattttgttcgtaatacgacttcaattctatctggtatccttaatatgtctgctactgagattggtattattacctgtgctagctacattgcttatggtctctctaaatttatttctggtttgatttcagatgaatcgaattctaaaattttccttccagttggtttgtttcttacaggactagttaatgtgttaatcggtgttattccctctgtaattactagtatttggctctttactatcatgtatcttattaatggttggttacaagggatgggataccctcctggagcgcgtacattagtctattggtatgataataaagaaagaattaaatatgccaccatttggaatttatctcacaattttggtggagcaatagcgccgattttaactggtgtaggtctagctcttgctggtaatgattctcttaatcaagcgcgtgctgcttattggtttccaggggtggtggcttgtcttttggctattcttgtttactttttacaagaagatactccagaatctatcggacttccgcctatagaagagtatcataaagagcaatatactaatgttgtggattcaagtaacattttagaagagcctgaagttttgggtatgggcgaaattataaaaaaatatattctaccaaatactaaactgatgtgggcatccttgtattcaatatttgtatatattttacgttacggtattgtctcatggactcctaagtttttagcgacgagtgtgcaagatggtggaaaaggtattactgcaacagctggtatgggtggtttttcactttttgaaataggtggtattattgggatgctaacagcaggatatctatctgccaaagtgtttaaaaactctaaacctttaaccaatgtagccttcttagttgtagcaatcttattactagctgcctattggtttattccagcaggacctcaatatatggcattagacttcattattttactaggtttgggggcatcaatctacggccctgttatgatggttggcctgtatgctatggagttggttccaaaagcagcagctggagcagcttcaggattgactggcacatttagttatgtcggaggagcaacaatcgctactctagctatcggtattattattgaccactttggttggggagtagcatttataatatttggtatttctggatttgcggctattgtctgtaccttgctttcaagagataagagtctagagtattggtga

SEQ ID NO: 55931 - protein, 457 aa, Streptococcus agalactiae A909
MLKKLFAPPQKRERLSAEEIKHKYPRYRVQVLISIFVGYMGYYFVRNTTSILSGILNMSATEIGIITCASYIAYGLSKFISGLISDESNSKIFLPVGLFLTGLVNVLIGVIPSVITSIWLFTIMYLINGWLQGMGYPPGARTLVYWYDNKERIKYATIWNLSHNFGGAIAPILTGVGLALAGNDSLNQARAAYWFPGVVACLLAILVYFLQEDTPESIGLPPIEEYHKEQYTNVVDSSNILEEPEVLGMGEIIKKYILPNTKLMWASLYSIFVYILRYGIVSWTPKFLATSVQDGGKGITATAGMGGFSLFEIGGIIGMLTAGYLSAKVFKNSKPLTNVAFLVVAILLLAAYWFIPAGPQYMALDFIILLGLGASIYGPVMMVGLYAMELVPKAAAGAASGLTGTFSYVGGATIATLAIGIIIDHFGWGVAFIIFGISGFAAIVCTLLSRDKSLEYW

SEQ ID NO: 55932 - DNA, 1350 bp, Pseudomonas fluorescens PfO
  CDS (1)..(1350): transl_table=11
atgtttgctttctttcgtcctgccgcacatcaggctccattgcctgaagaaaaaatcgacagcacctaccgacgcctgcgttggcagatcttcgccggcatcttctttggttacgcgggttactacctgctgcgcaagaacttctcgctggccatgccgtacctgatcgacgaaggctacagccgtggcgatctgggcctggcaatgtcggccatcgccatcgcctacggtctgtccaagttcctcatgggcctggtttccgaccgctccaacccgcgttacttcctgccgttcggcctgctggtatcggccggggtgatgttcattttcggtttcgcgccttgggcaacctccagcgtgaccatgatgttcatcctgctgttcatcaacggttgggcccagggcatgggctggccgccgagcggacgcacgatggtgcactggtggtcgcagaaggaacgtggcggcgtggtgtcggtgtggaacgtggcgcataacgtcggtggcggtctgatcggcccgctgttcctgatcggcatgggcctgttcaacgactggcacgcagcgttctacgtcccggccgccgtggctctggcagtagcggtgttcgctttcgtgaccatgcgtgacaccccgcaatcggtcggcctgccgccgatcgagaagtacaagaacgactacccggaaggctacgacgccagccacgaagacgaattcagcgccaaggaaatcttcgtcaaatacgtgctgcgcaacaaaatgctctggtacatcgccatggccaacgtcttcgtctacctgctgcgttacggcgtgctggactgggcgccgacctacctgaaagaagccaagggtttcaccgtggataaaacctcgtgggcctatttcttctacgaatgggcggggattccgggcacgctgctgtgcggctggatgtcggacaagatcttccgtggcaaccgtggcctgaccggcatggtgttcatggccctggtgaccgtcgcgacgctggtgtactggctgaacccggccggcaacccgaccatcgacatgatcgcgctgttctcaatcggcttcctgatctacggcccggtgatgctgatcggcctgcaagcgctggaactggcgccgaagaaagccgccggcactgccgcaggcttcaccggtctgttcgggtatctgggtggttcggtcgcggccagtgcagcgatgggctacaccgtggaccatttcggctgggatggtggtttcgtgctgctggtgggcgcttgcctgctgtcgatggccttcctggccccgaccctgtggcacaagcaagtcgccagtcagagccgtgaagcggtcgcctga

SEQ ID NO: 55933 - protein, 449 aa, Pseudomonas fluorescens PfO
MFAFFRPAAHQAPLPEEKIDSTYRRLRWQIFAGIFFGYAGYYLLRKNFSLAMPYLIDEGYSRGDLGLAMSAIAIAYGLSKFLMGLVSDRSNPRYFLPFGLLVSAGVMFIFGFAPWATSSVTMMFILLFINGWAQGMGWPPSGRTMVHWWSQKERGGVVSVWNVAHNVGGGLIGPLFLIGMGLFNDWHAAFYVPAAVALAVAVFAFVTMRDTPQSVGLPPIEKYKNDYPEGYDASHEDEFSAKEIFVKYVLRNKMLWYIAMANVFVYLLRYGVLDWAPTYLKEAKGFTVDKTSWAYFFYEWAGIPGTLLCGWMSDKIFRGNRGLTGMVFMALVTVATLVYWLNPAGNPTIDMIALFSIGFLIYGPVMLIGLQALELAPKKAAGTAAGFTGLFGYLGGSVAASAAMGYTVDHFGWDGGFVLLVGACLLSMAFLAPTLWHKQVASQSREAVA

SEQ ID NO: 55934 - DNA, 1299 bp, Xenopus tropicalis
  CDS (1)..(1299)
atggcagcgcagggacagggttatggctactaccgtacagttattttttccgcaatgtttgtgggatacacactgtattacttcaatcggaagaccttttcctttgtcatgccatctgtaatgcaggagataaaactggataaagatgatctaggtctgatcaccagcagccagtctgcagcatatgccatcagtaagtttattagtggagttctgtctgatcagatgagcgctcgctggctgttttcctctggcctttgcttggtgggtctggtaaacgtggtattttcctggagttccagtgtgtcagtttttgccattctttggttttttaatggactagctcaaggactcggctggccaccatgtggaaaagtcctgcgcaagtggtttgaaccttcccagttcggcacttggtgggcagtgctctccactagtatgaacttggcaggcagtcttggccccatcatagctactctggtagctgccagttacagttggagatccacattatccctttctggtctgatctgtgtgggagcctctgtcctttgccttatacttataaagaatgagccttctgatgtggggctgaaaaacatagaacctgggcccaaaaaaggaaaacaagcttcccagtctggtgatgaaacaactctaaaggagttcttgctttccccgtacctttggctactgtgtgctggatacctagtggtatttggagtaaaaacctgctgtacagactggggacagctttttctcattcaggacaaaggacagtctgccctgataggcagctcatacatgagcgccctggaggttggtggcttggtgggcagtattgcagctggtttgttgtctgatcgagctgtggctaagatgggattgagaaatcatggtaatcctcgccatggcctgctcctctctatgatggctggaatggctgtgtccttgtacttgttccgtgttactgtcactgcaggatcttcaaaggtctggatcttgattctgggagctgtatttggattttcttcgtatggacctattgcactttttggagtcattgccaatgagagcgccccttccaatttctgtgggacatcacatgctattgtggccctctctgcaaatgtgggtggtttcctcgccggactcccatttagcactattgccaaacactatggttggaacacagcatttcaagcagctgagattacctgcttagctgttacaatcatatttttccttctaaggaatattcaaaccaagatgggccgtctgccgaagaaagcggactga

SEQ ID NO: 55935 - protein, 432 aa, Xenopus tropicalis
MAAQGQGYGYYRTVIFSAMFVGYTLYYFNRKTFSFVMPSVMQEIKLDKDDLGLITSSQSAAYAISKFISGVLSDQMSARWLFSSGLCLVGLVNVVFSWSSSVSVFAILWFFNGLAQGLGWPPCGKVLRKWFEPSQFGTWWAVLSTSMNLAGSLGPIIATLVAASYSWRSTLSLSGLICVGASVLCLILIKNEPSDVGLKNIEPGPKKGKQASQSGDETTLKEFLLSPYLWLLCAGYLVVFGVKTCCTDWGQLFLIQDKGQSALIGSSYMSALEVGGLVGSIAAGLLSDRAVAKMGLRNHGNPRHGLLLSMMAGMAVSLYLFRVTVTAGSSKVWILILGAVFGFSSYGPIALFGVIANESAPSNFCGTSHAIVALSANVGGFLAGLPFSTIAKHYGWNTAFQAAEITCLAVTIIFFLLRNIQTKMGRLPKKAD

SEQ ID NO: 55936 - DNA, 1290 bp, Homo sapiens
  CDS (1)..(1290)
atggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgtgtggttgtctccttcctctgtctcctgctcatccacaatgaacctgctgatgttggactccgcaacctggaccccatgccctctgagggcaagaagggctccttgaaggaggagagcaccctgcaggagctactgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacagctgccttcttcctcctacgaaacatccgcaccaagatgggccgagtgtccaagaaggctgattaa

SEQ ID NO: 55937 - protein, 429 aa, Homo sapiens [sequence omitted]

SEQ ID NO: 55938 - DNA, 1365 bp, Escherichia coli
  CDS (1)..(1365): transl_table=11
atgttatcaatatttaaaacggggcaagcggcggatagtgttccggcggagaaaattcaggtgacatatcgtcgctatcgtatgcaggcgttacttagtgtatttctggggtatcttgcatactatatcgtgcgtaataatttcaccttatcgacgccttatcttaaagagcaattagatctcagcgccacacaaattggcgtactgagtagctgtatgcttatcgcctatggtatcagcaaaggagtgatgagtagccttgccgataaagccagtccgaaagtctttatggcgtgtgggctggtgttatgtgccatcgttaacgttggcctgggattcagcaccgcattctggatttttgcggtattggttattctgaatggtcttttccagggaatgggcgttggtccttctttcatcactattgctaactggttccctcgccgggagcgtggtcgggttggtgctttctggaatatctctcataacgtcggtggtggtattgttgcacccattgttggtgccgcttttgccctactcggcagcgagcactggcaaagtgcgagctatatcgttccggcctgcgtggccatcgtttttgcggtaattgtgctgattctcggtaaaggttccccacgtcaggaaggtctaccctctctggaagagatgatgccggaagaaaaagtcgtcctgaatacccgacagacggtaaaagcaccagaaaacatgagtgcctttcagattttctgcacttatgtattacgcaataaaaatgcttggtatgtctcactggttgacgtatttgtatacatggtacgcttcgggatgattagctggttgcctatttatctgctgacggtgaaacatttttctaaagaacaaatgagcgtcgcgtttttattttttgaatgggccgcaatcccttccacgctacttgccggttggttgtcagacaaactgtttaaagggcgtcgtatgccattggcgatgatttgtatggcgctgattttcatttgcctgattggctactggaaaagtgaatcactgtttatggtgacaatttttgctgccattgttggttgtctgatttacgttccacaatttctggcttctgttcagactatggagatcgtgcccagctttgctgttggctccgcggtaggtttacgtggttttatgagctatatcttcggtgcatctctgggcaccagcctgtttggtattatggtcgatcatattggctggcatggcggattttatcttcttggctgcggtattatttgttgcatcattttttgctggttatcacatcgtggtgcaattgaacttgaacgtcacagagccgcatatataaaagaacactga

SEQ ID NO: 55939 - protein, 454 aa, Escherichia coli
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAVLVILNGLFQGMGVGPSFITIANWFPRRERGRVGAFWNISHNVGGGIVAPIVGAAFALLGSEHWQSASYIVPACVAIVFAVIVLILGKGSPRQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 55940 - DNA, 1386 bp, Borrelia hermsii
  CDS (1)..(1386): transl_table=11
atggagtattcaattatgaaaaaattattcaattttctaaaaccagcacctcatataaagagagtacacaaagaattagaagaatcattatataaaaaatatagatttcaaatatttatgtcaatatttataggatatgctggattttatttaacgagaaaaatctttgcatttgctatgccagctcttgaaaaagacggttttagcaaagggcaattaggaacaattttatctggggtttcaattgcatatggattttctaaatttattatgggaaacgtctcagatcgaagtaatcccaggtatttcttagcgctagggctatttctaacagcaataattaccattatatttggattattcccgtggaaatcaattgaaagcaccataattgcagcaatattaatgttcattctaatgtttgtaaatggatgggttcaaggcatgggatggcctgcgtgtggacgaactatggttcactggtggtcaagaaaagaaagaggactaactgttgccacatggaatttatctcacaatataggagggggagcagctggaataatatcctcttgggctctgttttattttaaggaatggcaagctatactttatgtaccaacaggactagtaataggaattgcaatatttgttttgcttgcactaagggatacacctcaatctgtaggattaccaccaattgaagaatataaaaatgattatcctgataactatacagaaaaggcagaagaagaacttaatacaaaagatatatttgtaaaatatgtccttaacaataatctgctatggtatatagctattgctaatgcatttatatattttgtaagatacggggtcctagattgggcaccatcatacctcttgcaagtaaaacacttttccataaaaaactcaggatgggcatattcactttatgaattttcagctattcctggaacaatagcttgcggatggatatctgataaaatttttaaaggaagaagatcggagactggaataattttcataaccgccactcttattgcaataattatatattggcaattaccagaaaataatccaacactcacaactgttatcttggcaataataggattcctaatctacggccctgttatgcttattggtcttcatgctcttgatcttgcaccaaaaaaagctgcaggaactgctgcagggtttacaggattatttggatacatagggggttctgttactgctagtgccattacaggaattgtattgcaacactttaattgggacgtctacttctatctattaataactgcatgcatatttgcaataatatttatgagtttaacattaaagaaagagaaaaaaattaatgacactaataaactacaatag

SEQ ID NO: 55941 - protein, 461 aa, Borrelia hermsii
MEYSIMKKLFNFLKPAPHIKRVHKELEESLYKKYRFQIFMSIFIGYAGFYLTRKIFAFAMPALEKDGFSKGQLGTILSGVSIAYGFSKFIMGNVSDRSNPRYFLALGLFLTAIITIIFGLFPWKSIESTIIAAILMFILMFVNGWVQGMGWPACGRTMVHWWSRKERGLTVATWNLSHNIGGGAAGIISSWALFYFKEWQAILYVPTGLVIGIAIFVLLALRDTPQSVGLPPIEEYKNDYPDNYTEKAEEELNTKDIFVKYVLNNNLLWYIAIANAFIYFVRYGVLDWAPSYLLQVKHFSIKNSGWAYSLYEFSAIPGTIACGWISDKIFKGRRSETGIIFITATLIAIIIYWQLPENNPTLTTVILAIIGFLIYGPVMLIGLHALDLAPKKAAGTAAGFTGLFGYIGGSVTASAITGIVLQHFNWDVYFYLLITACIFAIIFMSLTLKKEKKINDTNKLQ

SEQ ID NO: 55942 - DNA, 2945 bp, Mus musculus
  CDS (58)..(1578)
gacgcgcgccggctctgcaccctccatagtctcagcttcgagtgccggcgcctcaagatgcggtcctccctggctcctggtgtctggttccttcgcgccttctctagggacagctggttccgtggcttcatcctgctgctcaccttcctcatttatgcctgttatcacatgtccagaaagcccatcagcatcgtcaagagccgcctgcaccagaactgctcagagatggtcagacctgttaatgacacccacgatctcaatgataccacctggtgcagctggagtccattcgacaaagatgactacaaggagttactaggagctgtggacaatgccttcctagtggcttatgccattggcatgtttattagtggaatctttggggagcggctgcccctgcgttactacctctcggctggaatggtgctaagtggcctattcacctccctctttggcctggggtacttctggaatatccacatgctctggtactttgtgctcatccagatctgcaacgggcttgtgcagactacaggctggccatctgtggtgacctgtgttggcaactggtttgggaagggaaagcggggattcatcatgggcatctggaactctcacacatctgtgggcaacattctgggctctctgattgctggagtctgggtgaaccagcactggggcctgtcattcatcgtgcctggcattatcactgctatcatgggtgtcatcaccttcctctttcttattgaatatccagaagatgtggactgtacccctcctcggcatcatgatgacccggagaaggaacaggacaaccctgaggatcctgtgaatagtccctacagcagcagggagagtaatgtggacattgcagccagctcctccaaggagcagggccctgagcctgaagccatcagtttcctgggggcactcagaattccgggagtgatcgagttctctttatgtctgctctttgccaagttggtcagctatacctttctctactggctgcccttgtacatcttcaatgtggctcactttagtgccaaggaggctggggacctatccacgctttttgatgttggtggcatcataggtggcatcatggcagggctcatcagcgactacaccaatagcagggccaccacttgctgcatcatgctgatcttggctgctcccatgatgttcctgtacaactacattggccagaatgggataaccagttccatagtgatgttaattatctgtggggtcctggtcaatggcccttacgcactcatcacgacagcggtctctgctgacctgggcacacatgagagcctgaagggtaacgccaaggccctctccactgtcacggccattatcgacggcactggttccataggtgcggctctggggcccctactggccgggctcatttccccgacaggctggaacaatgtgttctacatgctcatctctgccgacgtcttggcttgcttgctcctctgcaggttggtgtacaaagagatcctggcctggaagacggcctgcggcagaagcagtggctctagtctggccctaacccacccgcgatagtattttcctcaagtcccatgacttttgtacaaacaaatttgaggcctcaattggaagagcaacatgggccacccctgctgggtacccaacttatgagcaagagaatggaagcttccatcacagggagaggcaaagcctcctgatctaactggtctagccccaagctacattgccactaaggaagggtacagaaaactctatgggaaggggctgctgagcaccaagcatgggaacatggcagacttcaaggcctgagctctgggaactgcaatcagaaggaatgggctgaaagcagaaaggaaggacaggttcagactcttgcttgtttggattccaaggcctggaaaaggtgcatctctccttcccatgttaaattataaacctctgtaattatcctgtacctatgagggatttcaccttgtttcaaaggtgctgggcctctctctctctctgtttctgtctctgtgtctgtctctgtctatgaactattctttctgtatttctccaagtaggaccctgttgatctatcctccactcgatcctgttgataactcagccactttgaagcattagtgctgcctttgcagagtcaaggcttggatggggtacgggagctgtcataagtactaaatgtaggggaacttgctctcgggctcttgaccgtgtccaccctcagagcccagtaccttccttgcctcactcttaagatgcctcagtggatgaagacatcagggtcagtttggtgaagactaaggtgttgtatacaactgcaaatgccagtgtgaattaagcactgggtgctcaagtcatgacagctgtcctttaagaacaaacaggaagtggctatgggaagaacttaaccctgaacataggtgccaagtttagcaagaaatgaagataccactggaaacatctgcgtaactgctactgagcagttgctaggagacaccttgcagccaccctctgcctggtgttctgatgccccttccttccgctcttgagtcctggttcacgacatgccaggctgactcctggcatttccgcctgacctctaagctgcccatcagcaccaatacagatttcctttgccaactgtgccactgcttatccttggtagggcctggcatagcagcagccatggggctcgtgaggggcagtaaagcattgtcacatgaacaacaaagattggtgttctggggctgcgacagctgtctttcccagagggcattgctcatgacattgataacactgtgcaatccagcaggagcctagacccccatacaagatacatccattgcatttactaggatgttgtgtcagtcagtgtgttagctagatacactggcctcagcaataaaatataaagc

SEQ ID NO: 55943 - protein, 506 aa, Mus musculus
MRSSLAPGVWFLRAFSRDSWFRGFILLLTFLIYACYHMSRKPISIVKSRLHQNCSEMVRPVNDTHDLNDTTWCSWSPFDKDDYKELLGAVDNAFLVAYAIGMFISGIFGERLPLRYYLSAGMVLSGLFTSLFGLGYFWNIHMLWYFVLIQICNGLVQTTGWPSVVTCVGNWFGKGKRGFIMGIWNSHTSVGNILGSLIAGVWVNQHWGLSFIVPGIITAIMGVITFLFLIEYPEDVDCTPPRHHDDPEKEQDNPEDPVNSPYSSRESNVDIAASSSKEQGPEPEAISFLGALRIPGVIEFSLCLLFAKLVSYTFLYWLPLYIFNVAHFSAKEAGDLSTLFDVGGIIGGIMAGLISDYTNSRATTCCIMLILAAPMMFLYNYIGQNGITSSIVMLIICGVLVNGPYALITTAVSADLGTHESLKGNAKALSTVTAIIDGTGSIGAALGPLLAGLISPTGWNNVFYMLISADVLACLLLCRLVYKEILAWKTACGRSSGSSLALTHPR

SEQ ID NO: 55944 - DNA, 1578 bp, Oryza sativa
  CDS (1)..(1578)
atggcgaagccaccgccggcgcctcaccgcgcccaccgcgcgccgccgggcctctgcgccctgccggccatctcctacaactcccaccggggcctcgtcctgggcctcaccttcgtcgcctacgcgctctaccacgcctcccgcaagccgcccagcatcgtcaagcgcgcgctctccgaggcgtggccgcccttccacgacccggcgctcctcggcgagaccgacgtcgcgttcctcgccttctactccctcggcatgttcgtcgcgggccacctcggcgaccgcctcgacctccgcctcttcctcgccgtcggcatgatcgggagcggcaccgccgtcgcgctcttcggcgtcgggtacttcctctccctccactccctcgccttctacctcgccgcccaggtgatcgccggattgctccagtccaccggctggccctccgtcgtcgccatcgtcggcaactggttccgtgggcggaggcgcggcctcatcatggggatatggaacgcgcacacctccatcgggaacatcagcggctccctcatcgccgccgccgtgctccgctacgggtgggggtggtcgttcatcgtgccaggcctgctcatcgcgttcggtggcgttctcgtgttcttcttcctcgcgccttacccggaggaccttggcttctctccgacgacgctgcccaaggcagtgagtgaggcgagcaccgacgaggaggacagcagcagcagcgcgagcgccgccggtggcgccgggaaggaggagaggagggacgccgtggggatgtggaaggcgttcgcgattcctggcgtcatcaccttcgcgctctgcctcttcttcgcgaagctggtcgcctacacgttcttgtactggcttcctttctacctgagccagacggctattggaggcaaggaaatgtcagtcacgtctgctgggtatctctcagctttgtttgatgtaggtggaatcattggtggaattcttgcagggttcatatctgatcatctcaatgcaagggccaccacggcagcaatcttcatgtacttggctattccatctctttacgccttccatgcatatggcagtacttcagaagtggcaaacattggcttgatgatgatcagtggcttgtttgttaatggaccttatgctctcataacaactgcagtttctgccgatctgggaacccacaaatctcttaagggggattcccgtgcgttggccaccgtcacatcaattatagatggaacaggatcgcttggtgctgccttaggtccattcattaccggttttatttcaaaacgtggatgggattcagttttcacaatgcttatattttgtgcattagctgccggcgtcttattgtcacgtattgtgaagtctgaaattgttcatatcattcagaatcggagaaatcacacacttgacatgcataacagaactgcaggtgaggacttaaaacacactaatgttgcatctttctccattttggatatgtcaaacaatggtctgctaatgttttccttcctgttcctcatagattctggtgctcaaccacttttagaaggagacacttga

SEQ ID NO: 55945 - protein, 525 aa, Oryza sativa
MAKPPPAPHRAHRAPPGLCALPAISYNSHRGLVLGLTFVAYALYHASRKPPSIVKRALSEAWPPFHDPALLGETDVAFLAFYSLGMFVAGHLGDRLDLRLFLAVGMIGSGTAVALFGVGYFLSLHSLAFYLAAQVIAGLLQSTGWPSVVAIVGNWFRGRRRGLIMGIWNAHTSIGNISGSLIAAAVLRYGWGWSFIVPGLLIAFGGVLVFFFLAPYPEDLGFSPTTLPKAVSEASTDEEDSSSSASAAGGAGKEERRDAVGMWKAFAIPGVITFALCLFFAKLVAYTFLYWLPFYLSQTAIGGKEMSVTSAGYLSALFDVGGIIGGILAGFISDHLNARATTAAIFMYLAIPSLYAFHAYGSTSEVANIGLMMISGLFVNGPYALITTAVSADLGTHKSLKGDSRALATVTSIIDGTGSLGAALGPFITGFISKRGWDSVFTMLIFCALAAGVLLSRIVKSEIVHIIQNRRNHTLDMHNRTAGEDLKHTNVASFSILDMSNNGLLMFSFLFLIDSGAQPLLEGDT

SEQ ID NO: 55946 - DNA, 1290 bp, Mus musculus
  CDS (1)..(1290)
atggcagcccaaggctacggctactatcgcactgtcatatttgcggccatgtttggaggctacagcctgtactatttcaaccgcaaaaccttctcctttgtcatgccctccttggtggatgagatcgctctggacaaggacgatttggggctcatcacaagcagccagtcggcagcctacgccatcagcaagtttgtgagcggggttctgtcagaccagatgagcgcccgctggctcttctcctctgggctgctcctggttggtctggtcaacgtagtcttctcatggagctccacagtgtcagcctttgctgctccttggtttcttaatggtctggcacaggggctgggctggcccccctgtgggaagatcctgaggaagtggtttgagccatcccagtttggcacttggtgggctgtgttgtcaaccagcatgaacctggctggaagtttgggacctatcttggcaacgatcctcgcccagagctacagctggcgcagcacactggccctgtctggggcactgtgtgtggttgtctccttcttctgtctgctgctcatccacaatgaacctgctgatgttggactccgaaatctggaccctctgccctctgagggcaagaagggctccttgaaggaggagagcaccctacaggagctgctgctgtccccctatctctgggtgctgtccactggctaccttgtggtcttcggagtaaagacttgctgtacagactggggccagttcttccttatccaggagagagggcagtccgcccttgtgggtagctcctacatcagtgccctcgaggtcggaggccttgtaggaagcattgcagctggttacctgtcagacagggccatggcgaaggcagggctgtctctgtatgggaaccctcgccacggcctattgctactcatgatggctgggatggcagcatccacgtatctcttccgagtaacggtgaccagtgactcacccaagatctggatcctggttttgggagccgtgtttggtttctcttcttatggtcccattgccttgtttggagtcatagccaatgagagtgcacctcccaacttgtgtggaacctctcatgctattgtgggacttatggccaatgtgggtggatttctggctggcttacccttcagcaccattgccaagcactatagctggagcacagccttctgggtggcagaagtggtttgtggagccagcacagttgtcttcttcttgcttcgaaatatccgcaccaagatgggccgagtatccaagaagggagagtga

SEQ ID NO: 55947 - protein, 429 aa, Mus musculus
MAAQGYGYYRTVIFAAMFGGYSLYYFNRKTFSFVMPSLVDEIALDKDDLGLITSSQSAAYAISKFVSGVLSDQMSARWLFSSGLLLVGLVNVVFSWSSTVSAFAAPWFLNGLAQGLGWPPCGKILRKWFEPSQFGTWWAVLSTSMNLAGSLGPILATILAQSYSWRSTLALSGALCVVVSFFCLLLIHNEPADVGLRNLDPLPSEGKKGSLKEESTLQELLLSPYLWVLSTGYLVVFGVKTCCTDWGQFFLIQERGQSALVGSSYISALEVGGLVGSIAAGYLSDRAMAKAGLSLYGNPRHGLLLLMMAGMAASTYLFRVTVTSDSPKIWILVLGAVFGFSSYGPIALFGVIANESAPPNLCGTSHAIVGLMANVGGFLAGLPFSTIAKHYSWSTAFWVAEVVCGASTVVFFLLRNIRTKMGRVSKKGE

SEQ ID NO: 55948 - DNA, 1335 bp, Bacillus subtilis
  CDS (1)..(1335): transl_table=11
atgcttaatatatttaaaccggctcctcatattgagagactggatgattcaaagatggatgcggcatacaaacggctcagactgcaagtattcattggtattttcattggctacgcaggctactacctgctgcggaaaaactttgcctttgccattccttatctgcaggaacagggattttcgaaaacagaactgggtttggtgctggccgctgtgtccattgcgtacggcttcagcaaattcatcatgggaatggtgtctgaccgctgtaatccgagatattttctggcgacaggcctatttttatcagcaatcgttaatattctattcgtttcaatgccttgggtgacttcgagcgtcaccatcatgtttatttttatgtttatcaacggatggtttcaaggaatgggctggccgccatgcggcaggacgatggcccattggttctccataagtgaacgcggcacaaaaatgtcgatctggaatgtcgcccataacataggcggcggtattcttgctccgcttgtcactcttgggatcgcgatgttcgtcacttggaaaagcgtgtttttcttccctgccatcatcgccattatcatttcatttttaattgttttattggttcgtgatacgcctcaatcctgcggactcccgccaattgaagagtatcggaatgactatccaaaacacgcttttaaaaatcaggaaaaagaattaacaacaaaagaaattctttttcaatatgtgctgaacaacaaatttctttggtacatcgcttttgccaatgtatttgtttatttcgtgcgatacggcgtggttgactgggcgcctacttacttaacagaagccaaaggcttttctcctgaagactcacgctggtcgtattttctttacgaatacgcaggcataccgggaacgatcttgtgcggctggatcagtgaccgattcttcaaaagccgccgggcaccggcaggcgttttgtttatggcgggtgttttcattgccgtattggtgtactggctgaatccggccggcaatccgctcgtggacaatatcgccctgatcagcattggcttcttaatctacggacctgttatgctgatcggccttcaagcaattgacctagcaccgaaaaaagcagccggaactgcagccggtttgaccggatttttcggatacatcggcggatccgccttcgcaaacgccattatgggctttgtcgtggaccgttttaactggaacggcggctttatcatgctgatctcatcctgcattcttgccatcgtcttcttggctttgacgtggaatacaggaaaacgggcagagcatgtttaa

SEQ ID NO: 55949 - protein, 444 aa, Bacillus subtilis
MLNIFKPAPHIERLDDSKMDAAYKRLRLQVFIGIFIGYAGYYLLRKNFAFAIPYLQEQGFSKTELGLVLAAVSIAYGFSKFIMGMVSDRCNPRYFLATGLFLSAIVNILFVSMPWVTSSVTIMFIFMFINGWFQGMGWPPCGRTMAHWFSISERGTKMSIWNVAHNIGGGILAPLVTLGIAMFVTWKSVFFFPAIIAIIISFLIVLLVRDTPQSCGLPPIEEYRNDYPKHAFKNQEKELTTKEILFQYVLNNKFLWYIAFANVFVYFVRYGVVDWAPTYLTEAKGFSPEDSRWSYFLYEYAGIPGTILCGWISDRFFKSRRAPAGVLFMAGVFIAVLVYWLNPAGNPLVDNIALISIGFLIYGPVMLIGLQAIDLAPKKAAGTAAGLTGFFGYIGGSAFANAIMGFVVDRFNWNGGFIMLISSCILAIVFLALTWNTGKRAEHV

SEQ ID NO: 55950 - DNA, 1443 bp, Haemophilus influenzae
  CDS (1)..(1443): transl_table=11
atgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaataa

SEQ ID NO: 55951 - protein, 480 aa, Haemophilus influenzae
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGTIVSIWNTAHNIGGMVPGAMVLLASAIFFSTHGIEAQAKDVWQQSLYFPGIAAMIFAIPVYFVMRDTPQSCGLPSIEKWRNDYPDDYNEKTYENDLTAKEIFVTYVLKNKLLWYIAIANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYENPYQLTDFVLMTLIGFLIYGPVMLIGLHALELAPKKAAGTAAGFTGLFGYLGGTVSASAVIGWAAQHYGWDGGFYVMIGGGVLAVLLLLIVMVEEGKHKAKLGDTYGTK

SEQ ID NO: 55952 - DNA, 1392 bp, Salmonella typhimurium
  CDS (1)..(1392): transl_table=11
atgttaacaatattaaaaacagggcaatcggcgcataaagtcccaccggaaaaagtccaggccacatatggtcgatatcgtatacaggcattgttaagtgtatttctgggatatctcgcttactatatagtcagaaacaacttcacattatcgacgccttatttaaaagagcaattggatctcagcgctacgcaaatcggcctgctgagtagctgtatgcttattgcttacggaatcagtaaaggcgtaatgagcagtctggcggataaagccagcccaaaagtcttcatggcgtgcggtctggtactctgcgcgattgttaacgttgggctgggattcagtagcgcattctggatatttgccgctctggtggtcttcaatggcctttttcagggcatgggcgtcggcccctcgtttattactattgcaaactggttccctcgtcgggagcgcggacgcgtaggcgccttctggaatatctcgcataacgttggcggcgggatcgtcgcgcctatcgtcggtgcggcttttgcgatattgggcagcgaacactggcaaagcgccagttatatcgttccggcctgcgtcgccgtcatttttgccttaattgttctggtcttgggaaaaggttcgccgcgcaaagaaggtcttccctccctggaacagatgatgccggaagaaaaagtcgtactgaaaacgaagaatacggcaaaagcgccggaaaatatgagcgcatggcaaatcttctgtacttatgtgctgcgcaataaaaatgcctggtatatttcgctggtggatgtcttcgtctatatggtgcggtttggcatgattagctggttgcctatctatctgttgacagtaaaacacttttcaaaagaacagatgagcgtcgcgtttctctttttcgagtgggcggcgattccctccacgctactggcaggctggctgtcagataaactgtttaagggccgcagaatgccgttagccatgatttgcatggcgctgatttttgtctgtctgatcggatactggaaaagtgaatctttgctgatggtaacgattttcgccgccattgtaggttgtctgatttacgtcccgcagttcctcgcgtccgtacagacaatggaaatagtccccagctttgccgtaggttccgccgtcggtttacgtgggttcatgagctatattttcggcgcctcgttgggcaccagcctgtttggtgtaatggtggataaacttggctggtacggcggattttatcttctgatgggcggcatcgtgtgctgcattctattctgttacctctcccatcgcggcgcgctggaactggaacgccagcgccagaatgcgttacataatcaggactcactgcagcttgcggacgcgcaataa

SEQ ID NO: 55953 - protein, 463 aa, Salmonella typhimurium
MLTILKTGQSAHKVPPEKVQATYGRYRIQALLSVFLGYLAYYIVRNNFTLSTPYLKEQLDLSATQIGLLSSCMLIAYGISKGVMSSLADKASPKVFMACGLVLCAIVNVGLGFSSAFWIFAALVVFNGLFQGMGVGPSFITIANWFPRRERGRVGAFWNISHNVGGGIVAPIVGAAFAILGSEHWQSASYIVPACVAVIFALIVLVLGKGSPRKEGLPSLEQMMPEEKVVLKTKNTAKAPENMSAWQIFCTYVLRNKNAWYISLVDVFVYMVRFGMISWLPIYLLTVKHFSKEQMSVAFLFFEWAAIPSTLLAGWLSDKLFKGRRMPLAMICMALIFVCLIGYWKSESLLMVTIFAAIVGCLIYVPQFLASVQTMEIVPSFAVGSAVGLRGFMSYIFGASLGTSLFGVMVDKLGWYGGFYLLMGGIVCCILFCYLSHRGALELERQRQNALHNQDSLQLADAQ

SEQ ID NO: 55954 - DNA, 1371 bp, Chlamydia muridarum
  CDS (1)..(1371): transl_table=11
atgaatctatggaccaaaatttttcagcctcctcgccacattaaagaaatcagtgatccggagttggttaaaaagcaatataaatactggagagtgcgtatcttttacagcatgttttttggttacgtgttcttctattttacaaggaaaagctttacctttgctatgccaactctaattgcagatcttggatttgataaggcgcaactagggattattggcagtacactctacattacttacggcattagtaaatttgtaagcggtgtgatgtcagaccaatccaaccctcgctatttcatggcgaccggattaattattactggcctctctaatatcttctttggcctatcgtctaccgtgcctttgtttgtgctgttttggggaattaatggttggttccaaggatggggctggcctccttgtgcacgtctactgactcactggtattctaaatcagaaagaggaacttggtggagcgtctggagtacttctcacaatattggaggagctttaatccctgttttgactggaatcgctatcgattatgcaggatggcgaggagctatgtttatcccaggaattatttgcattatcatgggatttatcttaattgaccgtttgcgagacactccacaatcgctagggcttccggctatagaaaagtttaaaaaagaagacctttctcatccgcatgaggaaactaccgcggatattttggaagaggaggccgaaagagagctttccactaaagaaattttatttacttacgtgttatcaaataaatggttatggttcctatccttcgcttccttcttcatttacgtagtccgcatggcagtgaacgattggagcgctctttatctcattgagacaaagaattattccacagtaaaagcgaatctctgcgtatctttgtttgaaattggcggattatttggtatgctattagcgggctggttatccgacaccatttctaaaggaaagcgagggccaatgaatgtagtcttctcgctgggattactattctctatcttgggattatggggaactcatgatcgttctatatggtgggcagatggagcatttctatttatcatcggctttttcctttttggaccacaaatgatgatcggattagcagccgcagaattatcacataaaaaagccgctggaacggccagtggttttacaggatggttcgcctatttcggagctgcttttgctggatatcctctaggaaaagttgcccaagattggggatggcatggattctttgttgctctcttagcctgtgctttgattgcactcctgttcttcttgccaacatggaatgcatccgagcagagtttaagaaaacatagtcactaa

SEQ ID NO: 55955 - protein, 456 aa, Chlamydia muridarum
MNLWTKIFQPPRHIKEISDPELVKKQYKYWRVRIFYSMFFGYVFFYFTRKSFTFAMPTLIADLGFDKAQLGIIGSTLYITYGISKFVSGVMSDQSNPRYFMATGLIITGLSNIFFGLSSTVPLFVLFWGINGWFQGWGWPPCARLLTHWYSKSERGTWWSVWSTSHNIGGALIPVLTGIAIDYAGWRGAMFIPGIICIIMGFILIDRLRDTPQSLGLPAIEKFKKEDLSHPHEETTADILEEEAERELSTKEILFTYVLSNKWLWFLSFASFFIYVVRMAVNDWSALYLIETKNYSTVKANLCVSLFEIGGLFGMLLAGWLSDTISKGKRGPMNVVFSLGLLFSILGLWGTHDRSIWWADGAFLFIIGFFLFGPQMMIGLAAAELSHKKAAGTASGFTGWFAYFGAAFAGYPLGKVAQDWGWHGFFVALLACALIALLFFLPTWNASEQSLRKHSH

SEQ ID NO: 55956 - DNA, 1368 bp, Chlamydia pneumoniae
  CDS (1)..(1368): transl_table=11
atgaacgtttggactaaatttttccaacctccaaagcacattaaagaaattgaagaccaagaagtggtcaagaaaaaatacaaatactggcgtattcgtattttctatagcatgttcatcggctacattttctattatttcacaagaaaaagctttacctttgcgatgcccacgctaattgctgatttgggttttgataaagcgcaattagggatcataggaagtaccttatatttttcttatggaatcagtaagtttgttagcggagtcatgtccgaccaatccaatcctagatatttcatggctataggattgatgattacagggctcactaacatctttttcgggatgtcatcctctattgtattatttgctctttggtggggactaaacggatggttccaagggtggggctggcctccatgtgctcgtctactcacccactggtatgcgaaatcagaacggggcacttggtggagtgtgtggagtacctcccacaatattgggggagcacttattcctattctcacaggattcattattgattatagtggatggcggggagccatgtatgttccaggcattctttgtattggaatgggtttagttttaattaatcgtttacgagacacgcctcagtccttagggctacctcctatagagaagtacaagcgtgatccccatcacgcacatcacgagggcaaatcagcctcagaaggaactgaggaaatcgaacgcgagctatccactagagaaattctttttacctatgtccttacaaatcagtggctttggtttttagctgctgcctcgttctttatttatatagtacgaatggcagtcaacgattggagcgctttattccttattgagacaaaacattatgcggcagtgaaagccaatttttgcgtatctctatttgagattggtggtttattcggcatgctagttgctggttggttatctgataagatttctaagggcaatcgtgggcctatgaacgtcctcttctctttaggtttgctgtttgctattttaggcatgtggttttcacgtagtcataatcagtggtgggtggacggaaccttacttttcgttattggttttttcttatacggccctcaaatgatgatcggtctagcagcagcagaactctctcataaaaaagctgctggtactgctagcggatttactggatggttcgcttattttggagctacctttgcagggtatcctttaggaaaggttactgatgtttgggggtggaaagggtttttcattgctctcttagcctgtgcatccatagctttattgctctttttaccaacttggaacgctacggagaaaaacactcgtagtaaagcctag

SEQ ID NO: 55957 - protein, 455 aa, Chlamydia pneumoniae
MNVWTKFFQPPKHIKEIEDQEVVKKKYKYWRIRIFYSMFIGYIFYYFTRKSFTFAMPTLIADLGFDKAQLGIIGSTLYFSYGISKFVSGVMSDQSNPRYFMAIGLMITGLTNIFFGMSSSIVLFALWWGLNGWFQGWGWPPCARLLTHWYAKSERGTWWSVWSTSHNIGGALIPILTGFIIDYSGWRGAMYVPGILCIGMGLVLINRLRDTPQSLGLPPIEKYKRDPHHAHHEGKSASEGTEEIERELSTREILFTYVLTNQWLWFLAAASFFIYIVRMAVNDWSALFLIETKHYAAVKANFCVSLFEIGGLFGMLVAGWLSDKISKGNRGPMNVLFSLGLLFAILGMWFSRSHNQWWVDGTLLFVIGFFLYGPQMMIGLAAAELSHKKAAGTASGFTGWFAYFGATFAGYPLGKVTDVWGWKGFFIALLACASIALLLFLPTWNATEKNTRSKA

SEQ ID NO: 55958 - DNA, 1371 bp, Chlamydia trachomatis
  CDS (1)..(1371): transl_table=11
atgaatctatggaccaaaatttttcagcctccttgccacattaaagaaatcagtgacccggagttggttaaaaagcagtacaagtactggagaatgcgtatcttctacagcatgttcttggggtacgtgttcttctactttacaaggaaaagctttacttttgccatgccaaccttgatcgctgatctcgggtttgataaagctcagctagggattatcggtagtactctctatatcacttacggcattagtaaatttgtaagcggtgtcatgtctgaccagtccaatcctcgctatttcatggctattggattgattattactggtatctctaacatcttctttggtctctcttctacaatccctctgtttgtattgttctggggaattaacggttggttccaaggatggggatggcctccatgcgcacgattgttaactcactggtattccaaatcagagagaggaacctggtggagcgtttggagcacttctcataatatagggggagcgttgatccctgttcttaccggagttgctattgactacacggggtggcgcggcgctatgtttatcccagggattatttgcattatcatgggatttatcttaatcgatcgtttgcgagacactccgcaatcactcgggctccccgctatagaaaaatttagaaaagaagaggatgcgcatccacatgaagaaacaactgcagatatcttagaggaagaggcagaaagagagctctctacaaaagaaatcttgtttacttacgtactatctaataaatggctatggtttctgtcttttgcctccttctttatttatgtggttcgcatggcagtaaatgattggagcgctctctatctaatcgaaacaaaagattattccacagtaaaagcaaatctctgcgtatctttgtttgaaattggcggattatttggtatgctattagcgggctggctatccgacacgatttccaaaggaaaacgtggaccaatgaacgtagtcttctcgctaggattattagtttccatcttgggattatggggtactcgcgattacttcgtttggtggatagatggaacattcctatttatcattggttttttcctttttggaccacaaatgatgattggattggcagctgcagaattgtctcataaaaaagcagctggaacggccagcggctttacaggatggttcgcctacttcggagcagctttcgccggatatcctttagggaaggtggctcaggattggggctggcacggattctttgttgcgctcttagcttgtgctttgattgcgctgatccttttcttgccaacatggaatgcatccgaacagagtttgagaaaacatagtcactaa

SEQ ID NO: 55959 - protein, 456 aa, Chlamydia trachomatis
MNLWTKIFQPPCHIKEISDPELVKKQYKYWRMRIFYSMFLGYVFFYFTRKSFTFAMPTLIADLGFDKAQLGIIGSTLYITYGISKFVSGVMSDQSNPRYFMAIGLIITGISNIFFGLSSTIPLFVLFWGINGWFQGWGWPPCARLLTHWYSKSERGTWWSVWSTSHNIGGALIPVLTGVAIDYTGWRGAMFIPGIICIIMGFILIDRLRDTPQSLGLPAIEKFRKEEDAHPHEETTADILEEEAERELSTKEILFTYVLSNKWLWFLSFASFFIYVVRMAVNDWSALYLIETKDYSTVKANLCVSLFEIGGLFGMLLAGWLSDTISKGKRGPMNVVFSLGLLVSILGLWGTRDYFVWWIDGTFLFIIGFFLFGPQMMIGLAAAELSHKKAAGTASGFTGWFAYFGAAFAGYPLGKVAQDWGWHGFFVALLACALIALILFLPTWNASEQSLRKHSH

SEQ ID NO: 55960 - DNA, 1392 bp, Escherichia coli
  CDS (1)..(1392): transl_table=11
atgctggctttcctaaaccaagttcgcaagccgaccctggaccttccgctcgaagtgcggcgcaaaatgtggttcaaaccgttcatgcaatcctacctggtggtctttatcggctacctgacgatgtacctgattcgcaagaactttaacatcgcgcagaacgatatgatttcgacctacgggttgagcatgacgcagctggggatgatcggcctgggtttctccatcacttatggcgtgggtaaaacgttggtttcatactacgccgacggcaaaaacaccaaacaattcctgccgttcatgcttatcctctctgccatttgtatgctgggcttcagtgccagtatgggcagcggctcggttagcctgttcctgatgattgccttctacgccttaagcggctttttccagagtaccggcggttcgtgcagttactccaccatcaccaaatggacgccgcgtcgtaaacgcgggacattcctcggtttctggaatatttctcacaaccttggcggtgcaggcgcagcaggtgtggcgctgttcggggcaaattacctgttcgatggccatgtcatcggcatgtttatcttcccgtcgattatcgcgctgattgtcggttttatcggcctgcgttacggcagcgactccccggaatcttatggcctcggcaaagctgaagaactgttcggcgaggagatcagcgaagaggacaaagagacagaatctaccgatatgaccaagtggcagatctttgttgagtatgtgctgaaaaacaaagtgatctggctgctgtgcttcgccaacattttcctctatgtggtacgtattggtatcgaccagtggtcaaccgtatacgcgttccaggaactgaaactctctaaagcggtggcgattcagggctttacgctgtttgaagctggtgcgctggtcggtacgctgctgtggggctggctctctgacctggcgaacggtcgccgtggcctggtggcctgcatcgcgctggcgctgattatcgccacgctcggtgtgtatcaacatgccagtaacgaatatatctatctggcttctctctttgcgttgggtttcctggtctttggcccgcaattgttgattggtgtggctgctgttggctttgtacctaaaaaagcgattggcgctgccgatggtattaaaggcacctttgcttacctgattggtgacagctttgccaagttaggtctgggaatgattgccgatgggacgccggtattcggccttaccggctgggcaggcaccttcgccgcgctggatatcgccgcgattggttgtatctgcctgatggcgatagtggcggtaatggaagaacgcaaaatccgccgcgagaaaaaaattcagcagttgacagtggcataa

SEQ ID NO: 55961 - protein, 463 aa, Escherichia coli
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 55962 - DNA, 1392 bp, Salmonella typhimurium
  CDS (1)..(1392): transl_table=11
atgctggccttcttaaaccaggtgcgcaagccgaccctggatctgccgctcgatgtgcggcgtaaaatgtggttcaagccgttcatgcagtcctatctggtggtttttatcggctacctgaccatgtacctgatccgcaaaaactttaacatcgcgcagaacgacatgatctctacctacgggttgagcatgaccgagctggggatgattggcctgggcttctcgatcacctatggcgtggggaaaacgctggtttcctactacgctgacggtaaaaataccaagcagtttctaccgtttatgttgatcctctccgctatctgtatgctcggcttcagcgccagcatgggcgcggggtcaaccagtctgtttctgatgatcgctttctatgccctgagcggtttcttccagagtaccggcggatcgtgcagctactcgaccatcaccaaatggactccgcgtcgtaaacgcggcacctttctcggcttctggaatatctcccacaacctcggcggcgcgggcgcggcaggtgtggcgctgttcggcgccaactacctgttcgacggtcacgtcatcggcatgtttatcttcccgtcgattatcgcgctgattgttggctttatcggtctgcgtttcggcagcgactccccggaatcttacggtctgggtaaagctgaagaactgttcggcgaagagatcagcgaagaggataaagagactgaagaaaacgaaatgaccaagtggcagatctttgttgaatatgtgttgaaaaacaaagtgatctggctgctgtgtttctccaatatcttcctgtatgtggtacgtattggtatcgaccagtggtcaaccgtctacgccttccaggagctgaaactttctaaagaggtggcgattcagggctttaccttgtttgaagtgggcgcgctggtcggcacgttgctgtggggctggctctctgacctggcgaacggtcgtcgtgcgctggtagcctgtgtggcgctggcgttaatcatcgccaccctcggcgtctaccagcacgccagcaaccagtatgtctatctggcctcgctgttcgcgctcggtttcctggtgtttgggccgcagctattaattggcgtggcggctgtcggtttcgtaccgaaaaaagccatcggcgctgcggacggtatcaagggcaccttcgcttatcttatcggcgatagctttgccaagctgggtctgggcatgattgccgacggcacccccgtttttggtctgaccggctgggcgggcacgttcgccgcgctggacgccgccgcgatcggctgtatctgcctgatggcgatggtcgccgtgatggaagagcgcaaaatccgccgtgagaaaaaaattcagcaagtcaatatcgcttaa

SEQ ID NO: 55963 - protein, 463 aa, Salmonella typhimurium
MLAFLNQVRKPTLDLPLDVRRKMWFKPFMQSYLVVFIGYLTMYLIRKNFNIAQNDMISTYGLSMTELGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRFGSDSPESYGLGKAEELFGEEISEEDKETEENEMTKWQIFVEYVLKNKVIWLLCFSNIFLYVVRIGIDQWSTVYAFQELKLSKEVAIQGFTLFEVGALVGTLLWGWLSDLANGRRALVACVALALIIATLGVYQHASNQYVYLASLFALGFLVFGPQLLIGVAAVGFVPKKAIGAADGIKGTFAYLIGDSFAKLGLGMIADGTPVFGLTGWAGTFAALDAAAIGCICLMAMVAVMEERKIRREKKIQQVNIA

SEQ ID NO: 55964 - DNA, 25 bp, Artificial sequence
  (1)..(25): primer
atgttgagtatttttaaaccagcgc

SEQ ID NO: 55965 - DNA, 22 bp, Artificial sequence
  (1)..(22): primer
ttagcctccgttgcgttcttgc

SEQ ID NO: 55966 - protein, 542 aa, Artificial sequence
  Variant (2)..(11): xaa in position 2 to 11 is any amino acid
  Variant (14)..(14): xaa in position 14 is any amino acid
  Variant (17)..(18): xaa in position 17 to 18 is any amino acid
  Variant (21)..(22): xaa in position 21 to 22 is any amino acid
  Variant (24)..(25): xaa in position 24 to 25 is any amino acid
  Variant (27)..(32): xaa in position 27 to 32 is any amino acid
  Variant (34)..(39): xaa in position 34 to 39 is any amino acid
  Variant (40)..(90): xaa in position 40 to 90 is any or no amino acid
  Variant (93)..(99): xaa in position 93 to 99 is any amino acid
  Variant (101)..(101): xaa in position 101 is any amino acid
  Variant (105)..(105): xaa in position 105 is any amino acid
  Variant (109)..(109): xaa in position 109 is any amino acid
  Variant (111)..(111): xaa in position 111 is any amino acid
  Variant (113)..(113): xaa in position 113 is any amino acid
  Variant (115)..(118): xaa in position 115 to 118 is any amino acid
  Variant (119)..(119): xaa in position 119 is any or no amino acid
  Variant (121)..(122): xaa in position 121 to 122 is any amino acid
  Variant (124)..(125): xaa in position 124 to 125 is any amino acid
  Variant (128)..(129): xaa in position 128 to 129 is any amino acid
  Variant (133)..(137): xaa in position 133 to 137 is any amino acid
  Variant (139)..(151): xaa in position 139 to 151 is any amino acid
  Variant (152)..(160): xaa in position 152 to 160 is any or no amino acid
  Variant (162)..(162): xaa in position 162 is any amino acid
  Variant (164)..(165): xaa in position 164 to 165 is any amino acid
  Variant (167)..(168): xaa in position 167 to 168 is any amino acid
  Variant (170)..(170): xaa in position 170 is any or no amino acid
  Variant (172)..(175): xaa in position 172 to 175 is any amino acid
  Variant (176)..(176): xaa in position 176 is any or no amino acid
  Variant (178)..(179): xaa in position 178 to 179 is any amino acid
  Variant (182)..(185): xaa in position 182 to 185 is any amino acid
  Variant (187)..(192): xaa in position 187 to 192 is any or no amino acid
  Variant (194)..(197): xaa in position 194 to 197 is any amino acid
  Variant (200)..(201): xaa in position 200 to 201 is any amino acid
  Variant (203)..(203): xaa in position 203 is any amino acid
  Variant (208)..(208): xaa in position 208 is any amino acid
  Variant (210)..(212): xaa in position 210 to 212 is any amino acid
  Variant (214)..(229): xaa in position 214 to 229 is any amino acid
  Variant (230)..(242): xaa in position 230 to 242 is any or no amino acid
  Variant (244)..(244): xaa in position 244 is any amino acid
  Variant (246)..(246): xaa in position 246 is any amino acid
  Variant (249)..(249): xaa in position 249 is any amino acid
  Variant (252)..(260): xaa in position 252 to 260 is any amino acid
  Variant (262)..(264): xaa in position 262 to 264 is any amino acid
  Variant (267)..(268): xaa in position 267 to 268 is any amino acid
  Variant (270)..(275): xaa in position 270 to 275 is any amino acid
  Variant (276)..(317): xaa in position 276 to 317 is any or no amino acid
  Variant (319)..(319): xaa in position 319 is any amino acid
  Variant (320)..(322): xaa in position 320 to 322 is any or no amino acid
  Variant (324)..(325): xaa in position 324 to 325 is any amino acid
  Variant (327)..(328): xaa in position 327 to 328 is any amino acid
  Variant (331)..(331): xaa in position 331 is any amino acid
  Variant (333)..(338): xaa in position 333 to 338 is any amino acid
  Variant (341)..(341): xaa in position 341 is any amino acid
  Variant (344)..(344): xaa in position 344 is any amino acid
  Variant (347)..(348): xaa in position 347 to 348 is any amino acid
  Variant (350)..(352): xaa in position 350 to 352 is any amino acid
  Variant (355)..(370): xaa in position 355 to 370 is any amino acid
  Variant (371)..(376): xaa in position 371 to 376 is any or no amino acid
  Variant (379)..(379): xaa in position 379 is any amino acid
  Variant (383)..(383): xaa in position 383 is any amino acid
  Variant (385)..(385): xaa in position 385 is any amino acid
  Variant (388)..(388): xaa in position 388 is any amino acid
  Variant (391)..(391): xaa in position 391 is any amino acid
  Variant (394)..(397): xaa in position 394 to 397 is any amino acid
  Variant (398)..(407): xaa in position 398 to 407 is any or no amino acid
  Variant (409)..(422): xaa in position 409 to 422 is any amino acid
  Variant (424)..(441): xaa in position 424 to 441 is any amino acid
  Variant (442)..(467): xaa in position 442 to 467 is any or no amino acid
  Variant (470)..(471): xaa in position 470 to 471 is any amino acid
  Variant (476)..(477): xaa in position 476 to 477 is any amino acid
  Variant (481)..(481): xaa in position 481 is any or no amino acid
  Variant (483)..(483): xaa in position 483 is any amino acid
  Variant (485)..(485): xaa in position 485 is any amino acid
  Variant (487)..(493): xaa in position 487 to 493 is any amino acid
  Variant (494)..(494): xaa in position 494 is any or no amino acid
  Variant (496)..(496): xaa in position 496 is any amino acid
  Variant (498)..(498): xaa in position 498 is any amino acid
  Variant (500)..(501): xaa in position 500 to 501 is any amino acid
  Variant (503)..(504): xaa in position 503 to 504 is any amino acid
  Variant (508)..(508): xaa in position 508 is any amino acid
  Variant (509)..(512): xaa in position 509 to 512 is any or no amino acid
  Variant (514)..(515): xaa in position 514 to 515 is any amino acid
  Variant (516)..(516): xaa in position 516 is any or no amino acid
  Variant (519)..(525): xaa in position 519 to 525 is any amino acid
  Variant (526)..(537): xaa in position 526 to 537 is any or no amino acid
  Variant (539)..(541): xaa in position 539 to 541 is any amino acid
YXXXXXXXXXXIFXGYXXYYXXRXXFXXXXXXLXXXXXXXXXXXXXXXXXXXXXXXXXXXXXXXXXXXXXXXXXXXXXXXXXXXXXXXXXLGXXXXXXXIXYGLXKFVXGXLXDXXXXXRXXLXXGLXXSGIXXXXXGXXXXXXXXXXXXXXXXXXXXXXLXGXXQXXGXPXXXXXLXXWFXXXXRXXXXXXGXXXXIWXXSXNVGGXLXXXLXXXXXXXXXXXXXXXXXXXXXXXXXXXXXGXIXILXAIXXXXXXXXXPXXXGLXXIXXXXXXXXXXXXXXXXXXXXXXXXXXXXXXXXXXXXXXXXXXXXXXXXIXXXXVXXNXXLWXLXXXXXXVYXVRXGIXXWXXXYLXXXXXXXXXXXXXXXXXXXXXXFEXGGIXGXLLXGWXSDXXXXXXXXXXXXXXRXXXXXXXXXXXXXXLXXXXXXXXXXXXXXXXXXXXXXXXXXXXXXXXXXXXXXXXXXXXIGXXIYGPXXLIGXLXAXEXXXXXXXXGXAXGXXGXXGYLXXXXXAXXXLGXXXXXXXXXXXXXXXXXXXWXXXF

SEQ ID NO: 55967 - protein, 11 aa, Artificial sequence
  Variant (3)..(5): xaa in position 3 to 5 is any or no amino acid
  Variant (7)..(7): xaa in position 7 is Phe, Ile, Leu or Val
  Variant (8)..(8): xaa in position 8 is any amino acid
  Variant (10)..(10): xaa in position 10 is any amino acid
  Variant (11)..(11): xaa in position 11 is Asn, Ser or Thr
GYXXXYXXRXX

SEQ ID NO: 55968 - protein, 45 aa, Artificial sequence
  Variant (2)..(10): xaa in position 2 to 10 is any amino acid
  Variant (12)..(12): xaa in position 12 is Ala or Gly
  Variant (13)..(13): xaa in position 13 is any amino acid
  Variant (14)..(14): xaa in position 14 is Gly or Ser
  Variant (16)..(18): xaa in position 16 to 18 is any amino acid
  Variant (19)..(19): xaa in position 19 is Ala, Gly or Ser
  Variant (20)..(22): xaa in position 20 to 22 is any amino acid
  Variant (24)..(29): xaa in position 24 to 29 is any amino acid
  Variant (30)..(30): xaa in position 30 is Phe, Ile, Leu or Met
  Variant (31)..(31): xaa in position 31 is Phe, Ile, Leu, Met or Val
  Variant (32)..(34): xaa in position 32 to 34 is any amino acid
  Variant (36)..(37): xaa in position 36 to 37 is any amino acid
  Variant (38)..(38): xaa in position 38 is Ala, Cys, Ser, Thr or Val
  Variant (39)..(39): xaa in position 39 is Ala, Asp, Gly, Ser or Val
  Variant (40)..(44): xaa in position 40 to 44 is any amino acid
  Variant (45)..(45): xaa in position 45 is Phe, Ile, Leu, Met or Val
GXXXXXXXXXYXXXKXXXXXXXDXXXXXXXXXXXLXXXXXXXXXX

SEQ ID NO: 55969 - protein, 36 aa, Artificial sequence
  Variant (2)..(2): xaa in position 2 is Ala, Gly, Ser or Thr
  Variant (3)..(3): xaa in position 3 is any amino acid
  Variant (5)..(11): xaa in position 5 to 11 is any amino acid
  Variant (12)..(14): xaa in position 12 to 14 is any or no amino acid
  Variant (16)..(20): xaa in position 16 to 20 is any amino acid
  Variant (22)..(22): xaa in position 22 is Gly or Ile
  Variant (23)..(25): xaa in position 23 to 25 is any amino acid
  Variant (26)..(26): xaa in position 26 is Ala, Gly, Ser or Thr
  Variant (27)..(27): xaa in position 27 is any amino acid
  Variant (29)..(29): xaa in position 29 is Ala, Gly, Asn or Ser
  Variant (30)..(32): xaa in position 30 to 32 is any amino acid
  Variant (33)..(33): xaa in position 33 is Asn, Pro or Ser
  Variant (34)..(34): xaa in position 34 is any amino acid
  Variant (36)..(36): xaa in position 36 is Ala, Glu, Gly or Asn
QXXGXXXXXXXXXXWXXXXXRXXXXXXWXXXXXXGX

SEQ ID NO: 55970 - protein, 20 aa, Artificial sequence
  Variant (2)..(2): xaa in position 2 is any amino acid
  Variant (3)..(3): xaa in position 3 is Ile, Leu or Val
  Variant (4)..(4): xaa in position 4 is Ala, Cys, Gly or Ser
  Variant (5)..(15): xaa in position 5 to 15 is any amino acid
  Variant (16)..(16): xaa in position 16 is Ala, Cys, Asp or Gly
  Variant (17)..(19): xaa in position 17 to 19 is any amino acid
WXXXXXXXXXXXXXXXXXXW

SEQ ID NO: 55971 - protein, 16 aa, Artificial sequence
  Variant (2)..(3): xaa in position 2 to 3 is any amino acid
  Variant (4)..(4): xaa in position 4 is Ala or Gly
  Variant (5)..(5): xaa in position 5 is Phe, Ile, Leu or Val
  Variant (6)..(6): xaa in position 6 is any amino acid
  Variant (7)..(7): xaa in position 7 is Ala, Gly or Ser
  Variant (8)..(8): xaa in position 8 is any amino acid
  Variant (9)..(9): xaa in position 9 is Ile, Leu or Val
  Variant (10)..(11): xaa in position 10 to 11 is any amino acid
  Variant (13)..(14): xaa in position 13 to 14 is any amino acid
EXXXXXXXXXXGXXSD

SEQ ID NO: 55972 - protein, 38 aa, Artificial sequence
  Variant (2)..(5): xaa in position 2 to 5 is any amino acid
  Variant (8)..(11): xaa in position 8 to 11 is any amino acid
  Variant (12)..(19): xaa in position 12 to 19 is any or no amino acid
  Variant (21)..(26): xaa in position 21 to 26 is any amino acid
  Variant (27)..(27): xaa in position 27 is Ala, Gly, Ser or Val
  Variant (28)..(32): xaa in position 28 to 32 is any amino acid
  Variant (33)..(33): xaa in position 33 is Ala, Gly or Ser
  Variant (34)..(35): xaa in position 34 to 35 is Ala, Ser, Thr or Val
  Variant (36)..(36): xaa in position 36 is any amino acid
  Variant (37)..(37): xaa in position 37 is Ala or Gly
  Variant (38)..(38): xaa in position 38 is Phe, Ile, Leu, Met or Val
GXXXXGPXXXXXXXXXXXXGXXXXXXXXXXXXXXXXXX

SEQ ID NO: 55973 - DNA, 1338 bp, Escherichia coli; identical to SEQ ID NO: 39076
  CDS (1)..(1338)

SEQ ID NO: 55974 - protein, 445 aa, Escherichia coli; identical to SEQ ID NO: 39077

SEQ ID NO: 55975 - DNA, 1479 bp, Danio rerio; identical to SEQ ID NO: 39078
  CDS (1)..(1479)

SEQ ID NO: 55976 - protein, 492 aa, Danio rerio; identical to SEQ ID NO: 39079

SEQ ID NO: 55977 - DNA, 1395 bp, Rattus norvegicus; identical to SEQ ID NO: 39080
  CDS (1)..(1395)

SEQ ID NO: 55978 - protein, 464 aa, Rattus norvegicus; identical to SEQ ID NO: 39081

SEQ ID NO: 55979 - DNA, 1407 bp, Xenopus tropicalis; identical to SEQ ID NO: 39082
  CDS (1)..(1407)

SEQ ID NO: 55980 - protein, 468 aa, Xenopus tropicalis; identical to SEQ ID NO: 39083

SEQ ID NO: 55981 - DNA, 1380 bp, Gallus gallus; identical to SEQ ID NO: 39084
  CDS (1)..(1380)

SEQ ID NO: 55982 - protein, 459 aa, Gallus gallus; identical to SEQ ID NO: 39085

SEQ ID NO: 55983 - DNA, 1305 bp, Mesorhizobium loti MAFF303099; identical to SEQ ID NO: 39086
  CDS (1)..(1305): transl_table=11

SEQ ID NO: 55984 - protein, 434 aa, Mesorhizobium loti MAFF303099; identical to SEQ ID NO: 39087

SEQ ID NO: 55985 - DNA, 1557 bp, Mesorhizobium loti MAFF303099; identical to SEQ ID NO: 39088
  CDS (1)..(1557): transl_table=11

SEQ ID NO: 55986 - protein, 518 aa, Mesorhizobium loti MAFF303099; identical to SEQ ID NO: 39089

SEQ ID NO: 55987 - DNA, 1461 bp, Arabidopsis thaliana; identical to SEQ ID NO: 39090
  CDS (1)..(1461)

SEQ ID NO: 55988 - protein, 486 aa, Arabidopsis thaliana; identical to SEQ ID NO: 39091

SEQ ID NO: 55989 - DNA, 1824 bp, Thermotoga maritima MSB8; identical to SEQ ID NO: 39092
  CDS (1)..(1824): transl_table=11

SEQ ID NO: 55990 - protein, 607 aa, Thermotoga maritima MSB8; identical to SEQ ID NO: 39093

SEQ ID NO: 55991 - DNA, 1638 bp, Thermotoga maritima MSB8; identical to SEQ ID NO: 39094
  CDS (1)..(1638): transl_table=11

SEQ ID NO: 55992 - protein, 545 aa, Thermotoga maritima MSB8; identical to SEQ ID NO: 39095

SEQ ID NO: 55993 - DNA, 1881 bp, Thermotoga maritima MSB8; identical to SEQ ID NO: 39096
  CDS (1)..(1881): transl_table=11

SEQ ID NO: 55994 - protein, 626 aa, Thermotoga maritima MSB8; identical to SEQ ID NO: 39097

SEQ ID NO: 55995 - DNA, 1347 bp, Pseudomonas aeruginosa PAO1; identical to SEQ ID NO: 39098
  CDS (1)..(1347): transl_table=11

SEQ ID NO: 55996 - protein, 448 aa, Pseudomonas aeruginosa PAO1; identical to SEQ ID NO: 39099

SEQ ID NO: 55997 - DNA, 1893 bp, Methanothermobacter thermautotrophicus str. Delta H; identical to SEQ ID NO: 39100
  CDS (1)..(1893): transl_table=11

SEQ ID NO: 55998 - protein, 630 aa, Methanothermobacter thermautotrophicus str. Delta H; identical to SEQ ID NO: 39101

SEQ ID NO: 55999 - DNA, 1335 bp, Deinococcus radiodurans R1; identical to SEQ ID NO: 39102
  CDS (1)..(1335): transl_table=11

SEQ ID NO: 56000 - protein, 444 aa, Deinococcus radiodurans R1; identical to SEQ ID NO: 39103

SEQ ID NO: 56001 - DNA, 1335 bp, Xylella fastidiosa 9a5c; identical to SEQ ID NO: 39104
  CDS (1)..(1335): transl_table=11

SEQ ID NO: 56002 - protein, 444 aa, Xylella fastidiosa 9a5c; identical to SEQ ID NO: 39105

SEQ ID NO: 56003 - DNA, 1557 bp, Sinorhizobium meliloti 1021; identical to SEQ ID NO: 39106
  CDS (1)..(1557): transl_table=11

SEQ ID NO: 56004 - protein, 518 aa, Sinorhizobium meliloti 1021; identical to SEQ ID NO: 39107

SEQ ID NO: 56005 - DNA, 1320 bp, Caulobacter crescentus CB15; identical to SEQ ID NO: 39108
  CDS (1)..(1320): transl_table=11

SEQ ID NO: 56006 - protein, 439 aa, Caulobacter crescentus CB15; identical to SEQ ID NO: 39109

SEQ ID NO: 56007 - DNA, 1602 bp, Synechocystis sp. PCC 6803; identical to SEQ ID NO: 39110
  CDS (1)..(1602): transl_table=11

SEQ ID NO: 56008 - protein, 533 aa, Synechocystis sp. PCC 6803; identical to SEQ ID NO: 39111

SEQ ID NO: 56009 - DNA, 1635 bp, Nostoc sp. PCC 7120; identical to SEQ ID NO: 39112
  CDS (1)..(1635): transl_table=11

SEQ ID NO: 56010 - protein, 544 aa, Nostoc sp. PCC 7120; identical to SEQ ID NO: 39113

SEQ ID NO: 56011 - DNA, 1440 bp, Caenorhabditis elegans; identical to SEQ ID NO: 39114
  CDS (1)..(1440)

SEQ ID NO: 56012 - protein, 479 aa, Caenorhabditis elegans; identical to SEQ ID NO: 39115

SEQ ID NO: 56013 - DNA, 1296 bp, Ralstonia solanacearum GMI1000; identical to SEQ ID NO: 39116
  CDS (1)..(1296): transl_table=11

SEQ ID NO: 56014 - protein, 431 aa, Ralstonia solanacearum GMI1000; identical to SEQ ID NO: 39117

SEQ ID NO: 56015 - DNA, 1305 bp, Agrobacterium tumefaciens str. C58; identical to SEQ ID NO: 39118
  CDS (1)..(1305): transl_table=11

SEQ ID NO: 56016 - protein, 434 aa, Agrobacterium tumefaciens str. C58; identical to SEQ ID NO: 39119

SEQ ID NO: 56017 - DNA, 1557 bp, Agrobacterium tumefaciens str. C58; identical to SEQ ID NO: 39120
  CDS (1)..(1557): transl_table=11

SEQ ID NO: 56018 - protein, 518 aa, Agrobacterium tumefaciens str. C58; identical to SEQ ID NO: 39121

SEQ ID NO: 56019 - DNA, 1425 bp, Drosophila melanogaster; identical to SEQ ID NO: 39122
  CDS (1)..(1425)

SEQ ID NO: 56020 - protein, 474 aa, Drosophila melanogaster; identical to SEQ ID NO: 39123

SEQ ID NO: 56021 - DNA, 2109 bp, Drosophila melanogaster; identical to SEQ ID NO: 39124
  CDS (1)..(2109)

SEQ ID NO: 56022 - protein, 702 aa, Drosophila melanogaster; identical to SEQ ID NO: 39125

SEQ ID NO: 56023 - DNA, 1791 bp, Thermoanaerobacter tengcongensis MB4; identical to SEQ ID NO: 39126
  CDS (1)..(1791): transl_table=11

SEQ ID NO: 56024 - protein, 596 aa, Thermoanaerobacter tengcongensis MB4; identical to SEQ ID NO: 39127

SEQ ID NO: 56025 - DNA, 1941 bp, Streptomyces coelicolor A3(2); identical to SEQ ID NO: 39128
  CDS (1)..(1941): transl_table=11

SEQ ID NO: 56026 - protein, 646 aa, Streptomyces coelicolor A3(2); identical to SEQ ID NO: 39129

SEQ ID NO: 56027 - DNA, 1335 bp, Xanthomonas axonopodis pv. citri str. 306; identical to SEQ ID NO: 39130
  CDS (1)..(1335): transl_table=11

SEQ ID NO: 56028 - protein, 444 aa, Xanthomonas axonopodis pv. citri str. 306; identical to SEQ ID NO: 39131

SEQ ID NO: 56029 - DNA, 1386 bp, Yersinia pestis KIM; identical to SEQ ID NO: 39132
  CDS (1)..(1386): transl_table=11

SEQ ID NO: 56030 - protein, 461 aa, Yersinia pestis KIM; identical to SEQ ID NO: 39133

SEQ ID NO: 56031 - DNA, 1308 bp, Brucella suis 1330; identical to SEQ ID NO: 39134
  CDS (1)..(1308): transl_table=11

SEQ ID NO: 56032 - protein, 435 aa, Brucella suis 1330; identical to SEQ ID NO: 39135

SEQ ID NO: 56033 - DNA, 1332 bp, Leptospira interrogans serovar Lai str. 56601; identical to SEQ ID NO: 39136
  CDS (1)..(1332): transl_table=11

SEQ ID NO: 56034 - protein, 443 aa, Leptospira interrogans serovar Lai str. 56601; identical to SEQ ID NO: 39137

SEQ ID NO: 56035 - DNA, 1386 bp, Shewanella oneidensis MR-1; identical to SEQ ID NO: 39138
  CDS (1)..(1386): transl_table=11

SEQ ID NO: 56036 - protein, 461 aa, Shewanella oneidensis MR-1; identical to SEQ ID NO: 39139

SEQ ID NO: 56037 - DNA, 1446 bp, Drosophila melanogaster; identical to SEQ ID NO: 39140
  CDS (1)..(1446)

SEQ ID NO: 56038 - protein, 481 aa, Drosophila melanogaster; identical to SEQ ID NO: 39141

SEQ ID NO: 56039 - DNA, 1578 bp, Pseudomonas putida KT2440; identical to SEQ ID NO: 39142
  CDS (1)..(1578): transl_table=11

SEQ ID NO: 56040 - protein, 525 aa, Pseudomonas putida KT2440; identical to SEQ ID NO: 39143

SEQ ID NO: 56041 - DNA, 1362 bp, Pseudomonas putida KT2440; identical to SEQ ID NO: 39144
  CDS (1)..(1362): transl_table=11

SEQ ID NO: 56042 - protein, 453 aa, Pseudomonas putida KT2440; identical to SEQ ID NO: 39145

SEQ ID NO: 56043 - DNA, 1704 bp, Bradyrhizobium japonicum USDA 110; identical to SEQ ID NO: 39146
  CDS (1)..(1704): transl_table=11

SEQ ID NO: 56044 - protein, 567 aa, Bradyrhizobium japonicum USDA 110; identical to SEQ ID NO: 39147

SEQ ID NO: 56045 - DNA, 1557 bp, Bradyrhizobium japonicum USDA 110; identical to SEQ ID NO: 39148
  CDS (1)..(1557): transl_table=11

SEQ ID NO: 56046 - protein, 518 aa, Bradyrhizobium japonicum USDA 110; identical to SEQ ID NO: 39149

SEQ ID NO: 56047 - DNA, 1326 bp, Bradyrhizobium japonicum USDA 110; identical to SEQ ID NO: 39150
  CDS (1)..(1326): transl_table=11

SEQ ID NO: 56048 - protein, 441 aa, Bradyrhizobium japonicum USDA 110; identical to SEQ ID NO: 39151

SEQ ID NO: 56049 - DNA, 1395 bp, Bos taurus; identical to SEQ ID NO: 39152
  CDS (1)..(1395)

SEQ ID NO: 56050 - protein, 464 aa, Bos taurus; identical to SEQ ID NO: 39153

SEQ ID NO: 56051 - DNA, 1335 bp, Xylella fastidiosa Temecula1; identical to SEQ ID NO: 39154
  CDS (1)..(1335): transl_table=11

SEQ ID NO: 56052 - protein, 444 aa, Xylella fastidiosa Temecula1; identical to SEQ ID NO: 39155

SEQ ID NO: 56053 - DNA, 1359 bp, Pseudomonas syringae pv. tomato str. DC3000; identical to SEQ ID NO: 39156
  CDS (1)..(1359): transl_table=11

SEQ ID NO: 56054 - protein, 452 aa, Pseudomonas syringae pv. tomato str. DC3000; identical to SEQ ID NO: 39157

SEQ ID NO: 56055 - DNA, 1908 bp, Bacteroides thetaiotaomicron VPI-5482; identical to SEQ ID NO: 39158
  CDS (1)..(1908): transl_table=11

SEQ ID NO: 56056 - protein, 635 aa, Bacteroides thetaiotaomicron VPI-5482; identical to SEQ ID NO: 39159

SEQ ID NO: 56057 - DNA, 1254 bp, Enterococcus faecalis V583; identical to SEQ ID NO: 39160
  CDS (1)..(1254): transl_table=11

SEQ ID NO: 56058 - protein, 417 aa, Enterococcus faecalis V583; identical to SEQ ID NO: 39161

SEQ ID NO: 56059 - DNA, 1269 bp, Coxiella burnetii RSA 493; identical to SEQ ID NO: 39162
  CDS (1)..(1269): transl_table=11

SEQ ID NO: 56060 - protein, 422 aa, Coxiella burnetii RSA 493; identical to SEQ ID NO: 39163

SEQ ID NO: 56061 - DNA, 1824 bp, Streptomyces avermitilis MA-4680; identical to SEQ ID NO: 39164
  CDS (1)..(1824): transl_table=11

SEQ ID NO: 56062 - protein, 607 aa, Streptomyces avermitilis MA-4680; identical to SEQ ID NO: 39165

SEQ ID NO: 56063 - DNA, 1350 bp, Streptomyces avermitilis MA-4680; identical to SEQ ID NO: 39166
  CDS (1)..(1350): transl_table=11

SEQ ID NO: 56064 - protein, 449 aa, Streptomyces avermitilis MA-4680; identical to SEQ ID NO: 39167

SEQ ID NO: 56065 - DNA, 1278 bp, Nitrosomonas europaea ATCC 19718; identical to SEQ ID NO: 39168
  CDS (1)..(1278): transl_table=11

SEQ ID NO: 56066 - protein, 425 aa, Nitrosomonas europaea ATCC 19718; identical to SEQ ID NO: 39169

SEQ ID NO: 56067 - DNA, 1338 bp, Candidatus Blochmannia floridanus; identical to SEQ ID NO: 39170
  CDS (1)..(1338): transl_table=11

SEQ ID NO: 56068 - protein, 445 aa, Candidatus Blochmannia floridanus; identical to SEQ ID NO: 39171

SEQ ID NO: 56069 - DNA, 1368 bp, Bordetella parapertussis 12822; identical to SEQ ID NO: 39172
  CDS (1)..(1368): transl_table=11

SEQ ID NO: 56070 - protein, 455 aa, Bordetella parapertussis 12822; identical to SEQ ID NO: 39173

SEQ ID NO: 56071 - DNA, 1581 bp, Bordetella bronchiseptica RB50; identical to SEQ ID NO: 39174
  CDS (1)..(1581): transl_table=11

SEQ ID NO: 56072 - protein, 526 aa, Bordetella bronchiseptica RB50; identical to SEQ ID NO: 39175

SEQ ID NO: 56073 - DNA, 1368 bp, Bordetella bronchiseptica RB50; identical to SEQ ID NO: 39176
  CDS (1)..(1368): transl_table=11

SEQ ID NO: 56074 - protein, 455 aa, Bordetella bronchiseptica RB50; identical to SEQ ID NO: 39177

SEQ ID NO: 56075 - DNA, 1296 bp, Chromobacterium violaceum ATCC 12472; identical to SEQ ID NO: 39178
  CDS (1)..(1296): transl_table=11

SEQ ID NO: 56076 - protein, 431 aa, Chromobacterium violaceum ATCC 12472; identical to SEQ ID NO: 39179

SEQ ID NO: 56077 - DNA, 1365 bp, Photorhabdus luminescens subsp. laumondii TTO1; identical to SEQ ID NO: 39180
  CDS (1)..(1365): transl_table=11

SEQ ID NO: 56078 - protein, 454 aa, Photorhabdus luminescens subsp. laumondii TTO1; identical to SEQ ID NO: 39181

SEQ ID NO: 56079 - DNA, 1557 bp, Rhodopseudomonas palustris CGA009; identical to SEQ ID NO: 39182
  CDS (1)..(1557): transl_table=11

SEQ ID NO: 56080 - protein, 518 aa, Rhodopseudomonas palustris CGA009; identical to SEQ ID NO: 39183

SEQ ID NO: 56081 - DNA, 1326 bp, Rhodopseudomonas palustris CGA009; identical to SEQ ID NO: 39184
  CDS (1)..(1326): transl_table=11

SEQ ID NO: 56082 - protein, 441 aa, Rhodopseudomonas palustris CGA009; identical to SEQ ID NO: 39185

SEQ ID NO: 56083 - DNA, 1287 bp, Rhodopseudomonas palustris CGA009; identical to SEQ ID NO: 39186
  CDS (1)..(1287): transl_table=11

SEQ ID NO: 56084 - protein, 428 aa, Rhodopseudomonas palustris CGA009; identical to SEQ ID NO: 39187

SEQ ID NO: 56085 - DNA, 1776 bp, Geobacter sulfurreducens PCA; identical to SEQ ID NO: 39188
  CDS (1)..(1776): transl_table=11

SEQ ID NO: 56086 - protein, 591 aa, Geobacter sulfurreducens PCA; identical to SEQ ID NO: 39189

SEQ ID NO: 56087 - DNA, 1713 bp, Geobacter sulfurreducens PCA; identical to SEQ ID NO: 39190
  CDS (1)..(1713): transl_table=11

SEQ ID NO: 56088 - protein, 570 aa, Geobacter sulfurreducens PCA; identical to SEQ ID NO: 39191

SEQ ID NO: 56089 - DNA, 1272 bp, Geobacter sulfurreducens PCA; identical to SEQ ID NO: 39192
  CDS (1)..(1272): transl_table=11

SEQ ID NO: 56090 - protein, 423 aa, Geobacter sulfurreducens PCA; identical to SEQ ID NO: 39193

SEQ ID NO: 56091 - DNA, 1362 bp, Mycobacterium avium subsp. paratuberculosis K-10; identical to SEQ ID NO: 39194
  CDS (1)..(1362): transl_table=11

SEQ ID NO: 56092 - protein, 453 aa, Mycobacterium avium subsp. paratuberculosis K-10; identical to SEQ ID NO: 39195

SEQ ID NO: 56093 - DNA, 1254 bp, Wolbachia endosymbiont of Drosophila melanogaster; identical to SEQ ID NO: 39196
  CDS (1)..(1254): transl_table=11

SEQ ID NO: 56094 - protein, 417 aa, Wolbachia endosymbiont of Drosophila melanogaster; identical to SEQ ID NO: 39197

SEQ ID NO: 56095 - DNA, 1293 bp, Bdellovibrio bacteriovorus HD100; identical to SEQ ID NO: 39198
  CDS (1)..(1293): transl_table=11

SEQ ID NO: 56096 - protein, 430 aa, Bdellovibrio bacteriovorus HD100; identical to SEQ ID NO: 39199

SEQ ID NO: 56097 - DNA, 1473 bp, Candida albicans SC5314; identical to SEQ ID NO: 39200
  CDS (1)..(1473): transl_table=12

SEQ ID NO: 56098 - protein, 490 aa, Candida albicans SC5314; identical to SEQ ID NO: 39201

SEQ ID NO: 56099 - DNA, 1332 bp, Leptospira interrogans serovar Copenhageni str. Fiocruz L1-130; identical to SEQ ID NO: 39202
  CDS (1)..(1332): transl_table=11

SEQ ID NO: 56100 - protein, 443 aa, Leptospira interrogans serovar Copenhageni str. Fiocruz L1-130; identical to SEQ ID NO: 39203

SEQ ID NO: 56101 - DNA, 1317 bp, Thermus thermophilus HB27; identical to SEQ ID NO: 39204
  CDS (1)..(1317): transl_table=11

SEQ ID NO: 56102 - protein, 438 aa, Thermus thermophilus HB27; identical to SEQ ID NO: 39205

SEQ ID NO: 56103 - DNA, 1299 bp, Parachlamydia sp. UWE25; identical to SEQ ID NO: 39206
  CDS (1)..(1299): transl_table=11

SEQ ID NO: 56104 - protein, 432 aa, Parachlamydia sp. UWE25; identical to SEQ ID NO: 39207

SEQ ID NO: 56105 - DNA, 1308 bp, Bartonella quintana str. Toulouse; identical to SEQ ID NO: 39208
  CDS (1)..(1308): transl_table=11

SEQ ID NO: 56106 - protein, 435 aa, Bartonella quintana str. Toulouse; identical to SEQ ID NO: 39209

SEQ ID NO: 56107 - DNA, 1308 bp, Bartonella henselae str. Houston-1; identical to SEQ ID NO: 39210
  CDS (1)..(1308): transl_table=11

SEQ ID NO: 56108 - protein, 435 aa, Bartonella henselae str. Houston-1; identical to SEQ ID NO: 39211

SEQ ID NO: 56109 - DNA, 1332 bp, Acinetobacter sp. ADP1; identical to SEQ ID NO: 39212
  CDS (1)..(1332): transl_table=11

SEQ ID NO: 56110 - protein, 443 aa, Acinetobacter sp. ADP1; identical to SEQ ID NO: 39213

SEQ ID NO: 56111 - DNA, 1350 bp, Erwinia carotovora subsp. atroseptica SCRI1043; identical to SEQ ID NO: 39214
  CDS (1)..(1350): transl_table=11

SEQ ID NO: 56112 - protein, 449 aa, Erwinia carotovora subsp. atroseptica SCRI1043; identical to SEQ ID NO: 39215

SEQ ID NO: 56113 - DNA, 1335 bp, Propionibacterium acnes KPA171202; identical to SEQ ID NO: 39216
  CDS (1)..(1335): transl_table=11

SEQ ID NO: 56114 - protein, 444 aa, Propionibacterium acnes KPA171202; identical to SEQ ID NO: 39217

SEQ ID NO: 56115 - DNA, 1905 bp, Desulfotalea psychrophila LSv54; identical to SEQ ID NO: 39218
  CDS (1)..(1905): transl_table=11

SEQ ID NO: 56116 - protein, 634 aa, Desulfotalea psychrophila LSv54; identical to SEQ ID NO: 39219

SEQ ID NO: 56117 - DNA, 1653 bp, Desulfotalea psychrophila LSv54; identical to SEQ ID NO: 39220
  CDS (1)..(1653): transl_table=11

SEQ ID NO: 56118 - protein, 550 aa, Desulfotalea psychrophila LSv54; identical to SEQ ID NO: 39221

SEQ ID NO: 56119 - DNA, 1266 bp, Rickettsia typhi str. Wilmington; identical to SEQ ID NO: 39222
  CDS (1)..(1266): transl_table=11

SEQ ID NO: 56120 - protein, 421 aa, Rickettsia typhi str. Wilmington; identical to SEQ ID NO: 39223

SEQ ID NO: 56121 - DNA, 1278 bp, Symbiobacterium thermophilum IAM 14863; identical to SEQ ID NO: 39224
  CDS (1)..(1278): transl_table=11

SEQ ID NO: 56122 - protein, 425 aa, Symbiobacterium thermophilum IAM 14863; identical to SEQ ID NO: 39225

SEQ ID NO: 56123 - DNA, 1857 bp, Symbiobacterium thermophilum IAM 14863; identical to SEQ ID NO: 39226
  CDS (1)..(1857): transl_table=11

SEQ ID NO: 56124 - protein, 618 aa, Symbiobacterium thermophilum IAM 14863; identical to SEQ ID NO: 39227

SEQ ID NO: 56125 - DNA, 1287 bp, Legionella pneumophila subsp. pneumophila str. Philadelphia 1; identical to SEQ ID NO: 39228
  CDS (1)..(1287): transl_table=11

SEQ ID NO: 56126 - protein, 428 aa, Legionella pneumophila subsp. pneumophila str. Philadelphia 1; identical to SEQ ID NO: 39229

SEQ ID NO: 56127 - DNA, 1566 bp, Burkholderia mallei ATCC 23344; identical to SEQ ID NO: 39230
  CDS (1)..(1566): transl_table=11

SEQ ID NO: 56128 - protein, 521 aa, Burkholderia mallei ATCC 23344; identical to SEQ ID NO: 39231

SEQ ID NO: 56129 - DNA, 1311 bp, Burkholderia mallei ATCC 23344; identical to SEQ ID NO: 39232
  CDS (1)..(1311): transl_table=11

SEQ ID NO: 56130 - protein, 436 aa, Burkholderia mallei ATCC 23344; identical to SEQ ID NO: 39233

SEQ ID NO: 56131 - DNA, 1311 bp, Burkholderia pseudomallei K96243; identical to SEQ ID NO: 39234
  CDS (1)..(1311): transl_table=11

SEQ ID NO: 56132 - protein, 436 aa, Burkholderia pseudomallei K96243; identical to SEQ ID NO: 39235

SEQ ID NO: 56133 - DNA, 1284 bp, Methylococcus capsulatus str. Bath; identical to SEQ ID NO: 39236
  CDS (1)..(1284): transl_table=11

SEQ ID NO: 56134 - protein, 427 aa, Methylococcus capsulatus str. Bath; identical to SEQ ID NO: 39237

SEQ ID NO: 56135 - DNA, 1551 bp, Methylococcus capsulatus str. Bath; identical to SEQ ID NO: 39238
  CDS (1)..(1551): transl_table=11

SEQ ID NO: 56136 - protein, 516 aa, Methylococcus capsulatus str. Bath; identical to SEQ ID NO: 39239

SEQ ID NO: 56137 - DNA, 1686 bp, Methylococcus capsulatus str. Bath; identical to SEQ ID NO: 39240
  CDS (1)..(1686): transl_table=11

SEQ ID NO: 56138 - protein, 561 aa, Methylococcus capsulatus str. Bath; identical to SEQ ID NO: 39241

SEQ ID NO: 56139 - DNA, 1833 bp, Methylococcus capsulatus str. Bath; identical to SEQ ID NO: 39242
  CDS (1)..(1833): transl_table=11

SEQ ID NO: 56140 - protein, 610 aa, Methylococcus capsulatus str. Bath; identical to SEQ ID NO: 39243

SEQ ID NO: 56141 - DNA, 1326 bp, Nocardia farcinica IFM 10152; identical to SEQ ID NO: 39244
  CDS (1)..(1326): transl_table=11

SEQ ID NO: 56142 - protein, 441 aa, Nocardia farcinica IFM 10152; identical to SEQ ID NO: 39245

SEQ ID NO: 56143 - DNA, 1278 bp, Legionella pneumophila str. Lens; identical to SEQ ID NO: 39246
  CDS (1)..(1278): transl_table=11

SEQ ID NO: 56144 - protein, 425 aa, Legionella pneumophila str. Lens; identical to SEQ ID NO: 39247

SEQ ID NO: 56145 - DNA, 1293 bp, Anaplasma marginale str. St. Maries; identical to SEQ ID NO: 39248
  CDS (1)..(1293): transl_table=11

SEQ ID NO: 56146 - protein, 430 aa, Anaplasma marginale str. St. Maries; identical to SEQ ID NO: 39249

SEQ ID NO: 56147 - DNA, 1758 bp, Azoarcus sp. EbN1; identical to SEQ ID NO: 39250
  CDS (1)..(1758): transl_table=11

SEQ ID NO: 56148 - protein, 585 aa, Azoarcus sp. EbN1; identical to SEQ ID NO: 39251

SEQ ID NO: 56149 - DNA, 1314 bp, Azoarcus sp. EbN1; identical to SEQ ID NO: 39252
  CDS (1)..(1314): transl_table=11

SEQ ID NO: 56150 - protein, 437 aa, Azoarcus sp. EbN1; identical to SEQ ID NO: 39253

SEQ ID NO: 56151 - DNA, 1704 bp, Silicibacter pomeroyi DSS-3; identical to SEQ ID NO: 39254
  CDS (1)..(1704): transl_table=11

SEQ ID NO: 56152 - protein, 567 aa, Silicibacter pomeroyi DSS-3; identical to SEQ ID NO: 39255

SEQ ID NO: 56153 - DNA, 1683 bp, Silicibacter pomeroyi DSS-3; identical to SEQ ID NO: 39256
  CDS (1)..(1683): transl_table=11

SEQ ID NO: 56154 - protein, 560 aa, Silicibacter pomeroyi DSS-3; identical to SEQ ID NO: 39257

SEQ ID NO: 56155 - DNA, 1299 bp, Silicibacter pomeroyi DSS-3; identical to SEQ ID NO: 39258
  CDS (1)..(1299): transl_table=11

SEQ ID NO: 56156 - protein, 432 aa, Silicibacter pomeroyi DSS-3; identical to SEQ ID NO: 39259

SEQ ID NO: 56157 - DNA, 1275 bp, Francisella tularensis subsp. tularensis SCHU S4; identical to SEQ ID NO: 39260
  CDS (1)..(1275): transl_table=11

SEQ ID NO: 56158 - protein, 424 aa, Francisella tularensis subsp. tularensis SCHU S4; identical to SEQ ID NO: 39261

SEQ ID NO: 56159 - DNA, 1605 bp, Synechococcus elongatus PCC 6301; identical to SEQ ID NO: 39262
  CDS (1)..(1605): transl_table=11

SEQ ID NO: 56160 - protein, 534 aa, Synechococcus elongatus PCC 6301; identical to SEQ ID NO: 39263

SEQ ID NO: 56161 - DNA, 1278 bp, Ehrlichia ruminantium str. Welgevonden; identical to SEQ ID NO: 39264
  CDS (1)..(1278): transl_table=11

SEQ ID NO: 56162 - protein, 425 aa, Ehrlichia ruminantium str. Welgevonden; identical to SEQ ID NO: 39265

SEQ ID NO: 56163 - DNA, 1254 bp, Dehalococcoides ethenogenes 195; identical to SEQ ID NO: 39266
  CDS (1)..(1254): transl_table=11

SEQ ID NO: 56164 - protein, 417 aa, Dehalococcoides ethenogenes 195; identical to SEQ ID NO: 39267

SEQ ID NO: 56165 - DNA, 1872 bp, Dehalococcoides ethenogenes 195; identical to SEQ ID NO: 39268
  CDS (1)..(1872): transl_table=11

SEQ ID NO: 56166 - protein, 623 aa, Dehalococcoides ethenogenes 195; identical to SEQ ID NO: 39269

SEQ ID NO: 56167 - DNA, 1923 bp, Dehalococcoides ethenogenes 195; identical to SEQ ID NO: 39270
  CDS (1)..(1923): transl_table=11

SEQ ID NO: 56168 - protein, 640 aa, Dehalococcoides ethenogenes 195; identical to SEQ ID NO: 39271

SEQ ID NO: 56169 - DNA, 1803 bp, Thermococcus kodakarensis KOD1; identical to SEQ ID NO: 39272
  CDS (1)..(1803): transl_table=11

SEQ ID NO: 56170 - protein, 600 aa, Thermococcus kodakarensis KOD1; identical to SEQ ID NO: 39273

SEQ ID NO: 56171 - DNA, 1278 bp, Ehrlichia ruminantium str. Gardel; identical to SEQ ID NO: 39274
  CDS (1)..(1278): transl_table=11

SEQ ID NO: 56172 - protein, 425 aa, Ehrlichia ruminantium str. Gardel; identical to SEQ ID NO: 39275

SEQ ID NO: 56173 - DNA, 1278 bp, Ehrlichia ruminantium str. Welgevonden; identical to SEQ ID NO: 39276
  CDS (1)..(1278): transl_table=11

SEQ ID NO: 56174 - protein, 425 aa, Ehrlichia ruminantium str. Welgevonden; identical to SEQ ID NO: 39277

SEQ ID NO: 56175 - DNA, 1275 bp, Wolbachia endosymbiont strain TRS of Brugia malayi; identical to SEQ ID NO: 39278
  CDS (1)..(1275): transl_table=11

SEQ ID NO: 56176 - protein, 424 aa, Wolbachia endosymbiont strain TRS of Brugia malayi; identical to SEQ ID NO: 39279

SEQ ID NO: 56177 - DNA, 1335 bp, Xanthomonas oryzae pv. oryzae KACC10331; identical to SEQ ID NO: 39280
  CDS (1)..(1335): transl_table=11

SEQ ID NO: 56178 - protein, 444 aa, Xanthomonas oryzae pv. oryzae KACC10331; identical to SEQ ID NO: 39281

SEQ ID NO: 56179 - DNA, 1302 bp, Neisseria gonorrhoeae FA 1090; identical to SEQ ID NO: 39282
  CDS (1)..(1302): transl_table=11

SEQ ID NO: 56180 - protein, 433 aa, Neisseria gonorrhoeae FA 1090; identical to SEQ ID NO: 39283

SEQ ID NO: 56181 - DNA, 1308 bp, Brucella abortus biovar 1 str. 9-941; identical to SEQ ID NO: 39284
  CDS (1)..(1308): transl_table=11

SEQ ID NO: 56182 - protein, 435 aa, Brucella abortus biovar 1 str. 9-941; identical to SEQ ID NO: 39285

SEQ ID NO: 56183 - DNA, 1359 bp, Pseudomonas syringae pv. syringae B728a; identical to SEQ ID NO: 39286
  CDS (1)..(1359): transl_table=11

SEQ ID NO: 56184 - protein, 452 aa, Pseudomonas syringae pv. syringae B728a; identical to SEQ ID NO: 39287

SEQ ID NO: 56185 - DNA, 1335 bp, Xanthomonas campestris pv. campestris str. 8004; identical to SEQ ID NO: 39288
  CDS (1)..(1335): transl_table=11

SEQ ID NO: 56186 - protein, 444 aa, Xanthomonas campestris pv. campestris str. 8004; identical to SEQ ID NO: 39289

SEQ ID NO: 56187 - DNA, 1269 bp, Rickettsia felis URRWXCal2; identical to SEQ ID NO: 39290
  CDS (1)..(1269): transl_table=11

SEQ ID NO: 56188 - protein, 422 aa, Rickettsia felis URRWXCal2; identical to SEQ ID NO: 39291

SEQ ID NO: 56189 - DNA, 1560 bp, Pseudomonas fluorescens Pf-5; identical to SEQ ID NO: 39292
  CDS (1)..(1560): transl_table=11

SEQ ID NO: 56190 - protein, 519 aa, Pseudomonas fluorescens Pf-5; identical to SEQ ID NO: 39293

SEQ ID NO: 56191 - DNA, 1356 bp, Pseudomonas fluorescens Pf-5; identical to SEQ ID NO: 39294
  CDS (1)..(1356): transl_table=11

SEQ ID NO: 56192 - protein, 451 aa, Pseudomonas fluorescens Pf-5; identical to SEQ ID NO: 39295

SEQ ID NO: 56193 - DNA, 1425 bp, Psychrobacter arcticum 273-4; identical to SEQ ID NO: 39296
  CDS (1)..(1425): transl_table=11

SEQ ID NO: 56194 - protein, 474 aa, Psychrobacter arcticum 273-4; identical to SEQ ID NO: 39297

SEQ ID NO: 56195 - DNA, 1530 bp, Candidatus Pelagibacter ubique HTCC1062; identical to SEQ ID NO: 39298
  CDS (1)..(1530): transl_table=11

SEQ ID NO: 56196 - protein, 509 aa, Candidatus Pelagibacter ubique HTCC1062; identical to SEQ ID NO: 39299

SEQ ID NO: 56197 - DNA, 1332 bp, Candidatus Pelagibacter ubique HTCC1062; identical to SEQ ID NO: 39300
  CDS (1)..(1332): transl_table=11

SEQ ID NO: 56198 - protein, 443 aa, Candidatus Pelagibacter ubique HTCC1062; identical to SEQ ID NO: 39301

SEQ ID NO: 56199 - DNA, 1605 bp, Colwellia psychrerythraea 34H; identical to SEQ ID NO: 39302
  CDS (1)..(1605): transl_table=11

SEQ ID NO: 56200 - protein, 534 aa, Colwellia psychrerythraea 34H; identical to SEQ ID NO: 39303

SEQ ID NO: 56201 - DNA, 1614 bp, Colwellia psychrerythraea 34H; identical to SEQ ID NO: 39304
  CDS (1)..(1614): transl_table=11

SEQ ID NO: 56202 - protein, 537 aa, Colwellia psychrerythraea 34H; identical to SEQ ID NO: 39305

SEQ ID NO: 56203 - DNA, 1359 bp, Pseudomonas syringae pv. phaseolicola 1448A; identical to SEQ ID NO: 39306
  CDS (1)..(1359): transl_table=11

SEQ ID NO: 56204 - protein, 452 aa, Pseudomonas syringae pv. phaseolicola 1448A; identical to SEQ ID NO: 39307

SEQ ID NO: 56205 - DNA, 1332 bp, Candidatus Blochmannia pennsylvanicus str. BPEN; identical to SEQ ID NO: 39308
  CDS (1)..(1332): transl_table=11

SEQ ID NO: 56206 - protein, 443 aa, Candidatus Blochmannia pennsylvanicus str. BPEN; identical to SEQ ID NO: 39309

SEQ ID NO: 56207 - DNA, 1329 bp, Dechloromonas aromatica RCB; identical to SEQ ID NO: 39310
  CDS (1)..(1329): transl_table=11

SEQ ID NO: 56208 - protein, 442 aa, Dechloromonas aromatica RCB; identical to SEQ ID NO: 39311

SEQ ID NO: 56209 - DNA, 1899 bp, Dechloromonas aromatica RCB; identical to SEQ ID NO: 39312
  CDS (1)..(1899): transl_table=11

SEQ ID NO: 56210 - protein, 632 aa, Dechloromonas aromatica RCB; identical to SEQ ID NO: 39313

SEQ ID NO: 56211 - DNA, 1317 bp, Thermobifida fusca YX; identical to SEQ ID NO: 39314
  CDS (1)..(1317): transl_table=11

SEQ ID NO: 56212 - protein, 438 aa, Thermobifida fusca YX; identical to SEQ ID NO: 39315

SEQ ID NO: 56213 - DNA, 1566 bp, Ralstonia eutropha JMP134; identical to SEQ ID NO: 39316
  CDS (1)..(1566): transl_table=11

SEQ ID NO: 56214 - protein, 521 aa, Ralstonia eutropha JMP134; identical to SEQ ID NO: 39317

SEQ ID NO: 56215 - DNA, 1296 bp, Ralstonia eutropha JMP134; identical to SEQ ID NO: 39318
  CDS (1)..(1296): transl_table=11

SEQ ID NO: 56216 - protein, 431 aa, Ralstonia eutropha JMP134; identical to SEQ ID NO: 39319

SEQ ID NO: 56217 - DNA, 1245 bp, Ralstonia eutropha JMP134; identical to SEQ ID NO: 39320
  CDS (1)..(1245): transl_table=11

SEQ ID NO: 56218 - protein, 414 aa, Ralstonia eutropha JMP134; identical to SEQ ID NO: 39321

SEQ ID NO: 56219 - DNA, 1743 bp, Ralstonia eutropha JMP134; identical to SEQ ID NO: 39322
  CDS (1)..(1743): transl_table=11

SEQ ID NO: 56220 - protein, 580 aa, Ralstonia eutropha JMP134; identical to SEQ ID NO: 39323

SEQ ID NO: 56221 - DNA, 1284 bp, Ehrlichia canis str. Jake; identical to SEQ ID NO: 39324
  CDS (1)..(1284): transl_table=11

SEQ ID NO: 56222 - protein, 427 aa, Ehrlichia canis str. Jake; identical to SEQ ID NO: 39325

SEQ ID NO: 56223 - DNA, 1254 bp, Dehalococcoides sp. CBDB1; identical to SEQ ID NO: 39326
  CDS (1)..(1254): transl_table=11

SEQ ID NO: 56224 - protein, 417 aa, Dehalococcoides sp. CBDB1; identical to SEQ ID NO: 39327

SEQ ID NO: 56225 - DNA, 1872 bp, Dehalococcoides sp. CBDB1; identical to SEQ ID NO: 39328
  CDS (1)..(1872): transl_table=11

SEQ ID NO: 56226 - protein, 623 aa, Dehalococcoides sp. CBDB1; identical to SEQ ID NO: 39329

SEQ ID NO: 56227 - DNA, 1923 bp, Dehalococcoides sp. CBDB1; identical to SEQ ID NO: 39330
  CDS (1)..(1923): transl_table=11

SEQ ID NO: 56228 - protein, 640 aa, Dehalococcoides sp. CBDB1; identical to SEQ ID NO: 39331

SEQ ID NO: 56229 - DNA, 1281 bp, Thiobacillus denitrificans ATCC 25259; identical to SEQ ID NO: 39332
  CDS (1)..(1281): transl_table=11

SEQ ID NO: 56230 - protein, 426 aa, Thiobacillus denitrificans ATCC 25259; identical to SEQ ID NO: 39333

SEQ ID NO: 56231 - DNA, 1326 bp, Anaeromyxobacter dehalogenans 2CP-C; identical to SEQ ID NO: 39334
  CDS (1)..(1326): transl_table=11

SEQ ID NO: 56232 - protein, 441 aa, Anaeromyxobacter dehalogenans 2CP-C; identical to SEQ ID NO: 39335

SEQ ID NO: 56233 - DNA, 1719 bp, Syntrophobacter fumaroxidans MPOB; identical to SEQ ID NO: 39336
  CDS (1)..(1719): transl_table=11

SEQ ID NO: 56234 - protein, 572 aa, Syntrophobacter fumaroxidans MPOB; identical to SEQ ID NO: 39337

SEQ ID NO: 56235 - DNA, 1563 bp, Alcaligenes eutrophus; identical to SEQ ID NO: 39338
  CDS (1)..(1563): transl_table=11

SEQ ID NO: 56236 - protein, 520 aa, Alcaligenes eutrophus; identical to SEQ ID NO: 39339

SEQ ID NO: 56237 - DNA, 1815 bp, Rhodococcus opacus; identical to SEQ ID NO: 39340
  CDS (1)..(1815): transl_table=11

SEQ ID NO: 56238 - protein, 604 aa, Rhodococcus opacus; identical to SEQ ID NO: 39341

SEQ ID NO: 56239 - DNA, 1440 bp, Dictyostelium discoideum; identical to SEQ ID NO: 39342
  CDS (1)..(1440)

SEQ ID NO: 56240 - protein, 479 aa, Dictyostelium discoideum; identical to SEQ ID NO: 39343

SEQ ID NO: 56241 - DNA, 1464 bp, Solanum tuberosum; identical to SEQ ID NO: 39344
  CDS (1)..(1464)

SEQ ID NO: 56242 - protein, 487 aa, Solanum tuberosum; identical to SEQ ID NO: 39345

SEQ ID NO: 56243 - DNA, 1473 bp, Desulfovibrio fructosovorans; identical to SEQ ID NO: 39346
  CDS (1)..(1473): transl_table=11

SEQ ID NO: 56244 - protein, 490 aa, Desulfovibrio fructosovorans; identical to SEQ ID NO: 39347

SEQ ID NO: 56245 - DNA, 1332 bp, Rhodothermus marinus; identical to SEQ ID NO: 39348
  CDS (1)..(1332): transl_table=11

SEQ ID NO: 56246 - protein, 443 aa, Rhodothermus marinus; identical to SEQ ID NO: 39349

SEQ ID NO: 56247 - DNA, 1395 bp, Homo sapiens; identical to SEQ ID NO: 39350
  CDS (1)..(1395)

SEQ ID NO: 56248 - protein, 464 aa, Homo sapiens; identical to SEQ ID NO: 39351

SEQ ID NO: 56249 - DNA, 1425 bp, Nyctotherus ovalis; identical to SEQ ID NO: 39352
  CDS (1)..(1425): transl_table=10

SEQ ID NO: 56250 - protein, 474 aa, Nyctotherus ovalis; identical to SEQ ID NO: 39353

SEQ ID NO: 56251 - DNA, 1875 bp, Clostridium saccharoperbutylacetonicum; identical to SEQ ID NO: 39354
  CDS (1)..(1875): transl_table=11

SEQ ID NO: 56252 - protein, 624 aa, Clostridium saccharoperbutylacetonicum; identical to SEQ ID NO: 39355

SEQ ID NO: 56253 - DNA, 1290 bp, Trichomonas vaginalis; identical to SEQ ID NO: 39356
  CDS (1)..(1290)

SEQ ID NO: 56254 - protein, 429 aa, Trichomonas vaginalis; identical to SEQ ID NO: 39357

SEQ ID NO: 56255 - DNA, 2109 bp, Drosophila melanogaster; identical to SEQ ID NO: 39358
  CDS (1)..(2109)

SEQ ID NO: 56256 - protein, 702 aa, Drosophila melanogaster; identical to SEQ ID NO: 39359

SEQ ID NO: 56257 - DNA, 1389 bp, Nilaparvata lugens; identical to SEQ ID NO: 39360
  CDS (1)..(1389)

SEQ ID NO: 56258 - protein, 462 aa, Nilaparvata lugens; identical to SEQ ID NO: 39361

SEQ ID NO: 56259 - DNA, 1296 bp, uncultured bacterium 463; identical to SEQ ID NO: 39362
  CDS (1)..(1296)

SEQ ID NO: 56260 - protein, 431 aa, uncultured bacterium 463; identical to SEQ ID NO: 39363

SEQ ID NO: 56261 - DNA, 1455 bp, Chlamydomonas reinhardtii; identical to SEQ ID NO: 39364
  CDS (1)..(1455)

SEQ ID NO: 56262 - protein, 484 aa, Chlamydomonas reinhardtii; identical to SEQ ID NO: 39365

SEQ ID NO: 56263 - DNA, 1611 bp, Thiocapsa roseopersicina; identical to SEQ ID NO: 39366
  CDS (1)..(1611): transl_table=11

SEQ ID NO: 56264 - protein, 536 aa, Thiocapsa roseopersicina; identical to SEQ ID NO: 39367

SEQ ID NO: 56265 - DNA, 1854 bp, Leptospirillum ferrooxidans; identical to SEQ ID NO: 39368
  CDS (1)..(1854)

SEQ ID NO: 56266 - protein, 617 aa, Leptospirillum ferrooxidans; identical to SEQ ID NO: 39369

SEQ ID NO: 56267 - DNA, 1560 bp, Methylobacterium extorquens; identical to SEQ ID NO: 39370
  CDS (1)..(1560): transl_table=11

SEQ ID NO: 56268 - protein, 519 aa, Methylobacterium extorquens; identical to SEQ ID NO: 39371

SEQ ID NO: 56269 - DNA, 1416 bp, Xenopus laevis; identical to SEQ ID NO: 39372
  CDS (1)..(1416)

SEQ ID NO: 56270 - protein, 471 aa, Xenopus laevis; identical to SEQ ID NO: 39373

SEQ ID NO: 56271 - DNA, 1719 bp, Methylobacterium extorquens; identical to SEQ ID NO: 39374
  CDS (1)..(1719): transl_table=11

SEQ ID NO: 56272 - protein, 572 aa, Methylobacterium extorquens; identical to SEQ ID NO: 39375

SEQ ID NO: 56273 - DNA, 1605 bp, Synechococcus sp; identical to SEQ ID NO: 39376
  CDS (1)..(1605): transl_table=11

SEQ ID NO: 56274 - protein, 534 aa, Synechococcus sp; identical to SEQ ID NO: 39377

SEQ ID NO: 56275 - DNA, 1461 bp, Arabidopsis thaliana; identical to SEQ ID NO: 39378
  CDS (1)..(1461): n means a or g or c or t/u, s means g or c

SEQ ID NO: 56276 - protein, 486 aa, Arabidopsis thaliana; identical to SEQ ID NO: 39379
  Xaa in position 303 is unknown

SEQ ID NO: 56277 - DNA, 1389 bp, Drosophila melanogaster; identical to SEQ ID NO: 39380
  CDS (1)..(1389)

SEQ ID NO: 56278 - protein, 462 aa, Drosophila melanogaster; identical to SEQ ID NO: 39381

SEQ ID NO: 56279 - DNA, 1794 bp, Eubacterium acidaminophilum; identical to SEQ ID NO: 39382
  CDS (1)..(1794): transl_table=11

SEQ ID NO: 56280 - protein, 597 aa, Eubacterium acidaminophilum; identical to SEQ ID NO: 39383

SEQ ID NO: 56281 - DNA, 1068 bp, Homo sapiens; identical to SEQ ID NO: 39384
  CDS (1)..(1068)

SEQ ID NO: 56282 - protein, 355 aa, Homo sapiens; identical to SEQ ID NO: 39385

SEQ ID NO: 56283 - DNA, 1470 bp, Candida tropicalis; identical to SEQ ID NO: 39386
  CDS (1)..(1470): transl_table=12

SEQ ID NO: 56284 - protein, 489 aa, Candida tropicalis; identical to SEQ ID NO: 39387

SEQ ID NO: 56285 - DNA, 1626 bp, Anabaena variabilis; identical to SEQ ID NO: 39388
  CDS (1)..(1626): transl_table=11

SEQ ID NO: 56286 - protein, 541 aa, Anabaena variabilis; identical to SEQ ID NO: 39389

SEQ ID NO: 56287 - DNA, 1356 bp, Pseudomonas fluorescens; identical to SEQ ID NO: 39390
  CDS (1)..(1356): transl_table=11

SEQ ID NO: 56288 - protein, 451 aa, Pseudomonas fluorescens; identical to SEQ ID NO: 39391

SEQ ID NO: 56289 - DNA, 1143 bp, Yarrowia lipolytica; identical to SEQ ID NO: 39392
  CDS (1)..(1143)

SEQ ID NO: 56290 - protein, 380 aa, Yarrowia lipolytica; identical to SEQ ID NO: 39393

SEQ ID NO: 56291 - DNA, 1296 bp, Paracoccus denitrificans; identical to SEQ ID NO: 39394
  CDS (1)..(1296): transl_table=11

SEQ ID NO: 56292 - protein, 431 aa, Paracoccus denitrificans; identical to SEQ ID NO: 39395

SEQ ID NO: 56293 - DNA, 1317 bp, Thermus thermophilus; identical to SEQ ID NO: 39396
  CDS (1)..(1317): transl_table=11

SEQ ID NO: 56294 - protein, 438 aa, Thermus thermophilus; identical to SEQ ID NO: 39397

SEQ ID NO: 56295 - DNA, 1535 bp, Bos taurus; identical to SEQ ID NO: 39398
  CDS (79)..(1473)

SEQ ID NO: 56296 - protein, 464 aa, Bos taurus; identical to SEQ ID NO: 39399

SEQ ID NO: 56297 - DNA, 1395 bp, Homo sapiens; identical to SEQ ID NO: 39400
  CDS (1)..(1395)

SEQ ID NO: 56298 - protein, 464 aa, Homo sapiens; identical to SEQ ID NO: 39401

SEQ ID NO: 56299 - DNA, 1395 bp, Macaca fascicularis; identical to SEQ ID NO: 39402
  CDS (1)..(1395)

SEQ ID NO: 56300 - protein, 464 aa, Macaca fascicularis; identical to SEQ ID NO: 39403

SEQ ID NO: 56301 - DNA, 1395 bp, Mus musculus; identical to SEQ ID NO: 39404
  CDS (1)..(1395)

SEQ ID NO: 56302 - protein, 464 aa, Mus musculus; identical to SEQ ID NO: 39405

SEQ ID NO: 56303 - DNA, 1482 bp, Neurospora crassa; identical to SEQ ID NO: 39406
  CDS (1)..(1482)

SEQ ID NO: 56304 - protein, 493 aa, Neurospora crassa; identical to SEQ ID NO: 39407

SEQ ID NO: 56305 - DNA, 1305 bp, Rhizobium meliloti; identical to SEQ ID NO: 39408
  CDS (1)..(1305): transl_table=11

SEQ ID NO: 56306 - protein, 434 aa, Rhizobium meliloti; identical to SEQ ID NO: 39409

SEQ ID NO: 56307 - DNA, 1266 bp, Rhizobium meliloti; identical to SEQ ID NO: 39410
  CDS (1)..(1266): transl_table=11

SEQ ID NO: 56308 - protein, 421 aa, Rhizobium meliloti; identical to SEQ ID NO: 39411

SEQ ID NO: 56309 - DNA, 1281 bp, Aquifex aeolicus; identical to SEQ ID NO: 39412
  CDS (1)..(1281): transl_table=11

SEQ ID NO: 56310 - protein, 426 aa, Aquifex aeolicus; identical to SEQ ID NO: 39413

SEQ ID NO: 56311 - DNA, 1335 bp, Buchnera aphidicola subsp; identical to SEQ ID NO: 39414
  CDS (1)..(1335): transl_table=11

SEQ ID NO: 56312 - protein, 444 aa, Buchnera aphidicola subsp; identical to SEQ ID NO: 39415

SEQ ID NO: 56313 - DNA, 1344 bp, Buchnera aphidicola subsp; identical to SEQ ID NO: 39416
  CDS (1)..(1344): transl_table=11

SEQ ID NO: 56314 - protein, 447 aa, Buchnera aphidicola subsp; identical to SEQ ID NO: 39417

SEQ ID NO: 56315 - DNA, 1335 bp, Buchnera aphidicola subsp; identical to SEQ ID NO: 39418
  CDS (1)..(1335): transl_table=11

SEQ ID NO: 56316 - protein, 444 aa, Buchnera aphidicola subsp; identical to SEQ ID NO: 39419

SEQ ID NO: 56317 - DNA, 1338 bp, Mycobacterium bovis; identical to SEQ ID NO: 39420
  CDS (1)..(1338): transl_table=11

SEQ ID NO: 56318 - protein, 445 aa, Mycobacterium bovis; identical to SEQ ID NO: 39421

SEQ ID NO: 56319 - DNA, 1296 bp, Rhodobacter capsulatus; identical to SEQ ID NO: 39422
  CDS (1)..(1296): transl_table=11

SEQ ID NO: 56320 - protein, 431 aa, Rhodobacter capsulatus; identical to SEQ ID NO: 39423

SEQ ID NO: 56321 - DNA, 1266 bp, Rickettsia conorii; identical to SEQ ID NO: 39424
  CDS (1)..(1266): transl_table=11

SEQ ID NO: 56322 - protein, 421 aa, Rickettsia conorii; identical to SEQ ID NO: 39425

SEQ ID NO: 56323 - DNA, 1266 bp, Rickettsia prowazekii; identical to SEQ ID NO: 39426
  CDS (1)..(1266): transl_table=11

SEQ ID NO: 56324 - protein, 421 aa, Rickettsia prowazekii; identical to SEQ ID NO: 39427

SEQ ID NO: 56325 - DNA, 1350 bp, Streptomyces coelicolor; identical to SEQ ID NO: 39428
  CDS (1)..(1350): transl_table=11

SEQ ID NO: 56326 - protein, 449 aa, Streptomyces coelicolor; identical to SEQ ID NO: 39429

SEQ ID NO: 56327 - DNA, 25 bp, Artificial sequence
  (1)..(25): primer
atgaaaaacattatccgtactcccg

SEQ ID NO: 56328 - DNA, 21 bp, Artificial sequence
  (1)..(21): primer
ttaccagcgctctttcagcag

SEQ ID NO: 56329 - protein, 478 aa, Artificial sequence; identical to SEQ ID NO: 39432
  Variant (2)..(9): xaa in position 2 to 9 is any amino acid
  Variant (10)..(62): xaa in position 10 to 62 is any or no amino acid
  Variant (64)..(69): xaa in position 64 to 69 is any amino acid
  Variant (71)..(72): xaa in position 71 to 72 is any amino acid
  Variant (73)..(80): xaa in position 73 to 80 is any or no amino acid
  Variant (83)..(84): xaa in position 83 to 84 is any or no amino acid
  Variant (86)..(87): xaa in position 86 to 87 is any or no amino acid
  Variant (89)..(89): xaa in position 89 is any or no amino acid
  Variant (105)..(106): xaa in position 105 to 106 is any amino acid
  Variant (108)..(114): xaa in position 108 to 114 is any amino acid
  Variant (115)..(128): xaa in position 115 to 128 is any or no amino acid
  Variant (132)..(132): xaa in position 132 is any amino acid
  Variant (137)..(137): xaa in position 137 is any amino acid
  Variant (142)..(143): xaa in position 142 to 143 is any amino acid
  Variant (146)..(146): xaa in position 146 is any amino acid
  Variant (149)..(151): xaa in position 149 to 151 is any amino acid
  Variant (154)..(154): xaa in position 154 is any amino acid
  Variant (159)..(160): xaa in position 159 to 160 is any amino acid
  Variant (164)..(164): xaa in position 164 is any amino acid
  Variant (167)..(168): xaa in position 167 to 168 is any or no amino acid
  Variant (170)..(171): xaa in position 170 to 171 is any amino acid
  Variant (181)..(183): xaa in position 181 to 183 is any amino acid
  Variant (184)..(187): xaa in position 184 to 187 is any or no amino acid
  Variant (189)..(190): xaa in position 189 to 190 is any or no amino acid
  Variant (193)..(194): xaa in position 193 to 194 is any or no amino acid
  Variant (196)..(196): xaa in position 196 is any amino acid
  Variant (197)..(198): xaa in position 197 to 198 is any or no amino acid
  Variant (200)..(200): xaa in position 200 is any amino acid
  Variant (203)..(206): xaa in position 203 to 206 is any amino acid
  Variant (207)..(207): xaa in position 207 is any or no amino acid
  Variant (209)..(214): xaa in position 209 to 214 is any or no amino acid
  Variant (216)..(216): xaa in position 216 is any or no amino acid
  Variant (218)..(219): xaa in position 218 to 219 is any amino acid
  Variant (234)..(234): xaa in position 234 is any amino acid
  Variant (240)..(240): xaa in position 240 is any amino acid
  Variant (242)..(242): xaa in position 242 is any amino acid
  Variant (245)..(245): xaa in position 245 is any amino acid
  Variant (248)..(248): xaa in position 248 is any or no amino acid
  Variant (253)..(254): xaa in position 253 to 254 is any amino acid
  Variant (259)..(259): xaa in position 259 is any amino acid
  Variant (262)..(262): xaa in position 262 is any amino acid
  Variant (264)..(264): xaa in position 264 is any amino acid
  Variant (269)..(269): xaa in position 269 is any amino acid
  Variant (271)..(274): xaa in position 271 to 274 is any amino acid
  Variant (277)..(278): xaa in position 277 to 278 is any amino acid
  Variant (280)..(281): xaa in position 280 to 281 is any amino acid
  Variant (284)..(286): xaa in position 284 to 286 is any amino acid
  Variant (288)..(292): xaa in position 288 to 292 is any amino acid
  Variant (293)..(296): xaa in position 293 to 296 is any or no amino acid
  Variant (302)..(302): xaa in position 302 is any amino acid
  Variant (306)..(306): xaa in position 306 is any amino acid
  Variant (308)..(313): xaa in position 308 to 313 is any amino acid
  Variant (315)..(322): xaa in position 315 to 322 is any amino acid
  Variant (326)..(327): xaa in position 326 to 327 is any amino acid
  Variant (328)..(329): xaa in position 328 to 329 is any or no amino acid
  Variant (333)..(335): xaa in position 333 to 335 is any amino acid
  Variant (336)..(340): xaa in position 336 to 340 is any or no amino acid
  Variant (342)..(344): xaa in position 342 to 344 is any amino acid
  Variant (347)..(347): xaa in position 347 is any amino acid
  Variant (349)..(351): xaa in position 349 to 351 is any amino acid
  Variant (353)..(360): xaa in position 353 to 360 is any amino acid
  Variant (361)..(362): xaa in position 361 to 362 is any or no amino acid
  Variant (367)..(367): xaa in position 367 is any amino acid
  Variant (369)..(371): xaa in position 369 to 371 is any amino acid
  Variant (372)..(374): xaa in position 372 to 374 is any or no amino acid
  Variant (384)..(388): xaa in position 384 to 388 is any amino acid
  Variant (391)..(398): xaa in position 391 to 398 is any amino acid
  Variant (400)..(402): xaa in position 400 to 402 is any amino acid
  Variant (407)..(407): xaa in position 407 is any amino acid
  Variant (413)..(413): xaa in position 413 is any amino acid
  Variant (415)..(418): xaa in position 415 to 418 is any amino acid
  Variant (419)..(423): xaa in position 419 to 423 is any or no amino acid
  Variant (426)..(426): xaa in position 426 is any amino acid
  Variant (427)..(430): xaa in position 427 to 430 is any or no amino acid
  Variant (432)..(432): xaa in position 432 is any or no amino acid
  Variant (434)..(436): xaa in position 434 to 436 is any or no amino acid
  Variant (439)..(440): xaa in position 439 to 440 is any amino acid
  Variant (442)..(443): xaa in position 442 to 443 is any amino acid
  Variant (445)..(447): xaa in position 445 to 447 is any amino acid
  Variant (449)..(450): xaa in position 449 to 450 is any amino acid
  Variant (451)..(455): xaa in position 451 to 455 is any or no amino acid
  Variant (457)..(457): xaa in position 457 is any amino acid
  Variant (462)..(463): xaa in position 462 to 463 is any amino acid
  Variant (465)..(466): xaa in position 465 to 466 is any amino acid
  Variant (469)..(471): xaa in position 469 to 471 is any amino acid
  Variant (474)..(474): xaa in position 474 is any amino acid
  Variant (476)..(477): xaa in position 476 to 477 is any amino acid

SEQ ID NO: 56330 - protein, 12 aa, Artificial sequence
  Variant (4)..(5): xaa in position 4 to 5 is Ala or Gly
  Variant (7)..(7): xaa in position 7 is Pro or Ser
  Variant (8)..(8): xaa in position 8 is Ala, Ser or Thr
  Variant (10)..(10): xaa in position 10 is any amino acid
RGGXXFXXGXKW

SEQ ID NO: 56331 - protein, 50 aa, Artificial sequence; identical to SEQ ID NO: 39434
  Variant (2)..(4): xaa in position 2 to 4 is any amino acid
  Variant (6)..(6): xaa in position 6 is Ala, Cys, Gly, Ser or Thr
  Variant (9)..(9): xaa in position 9 is any amino acid
  Variant (10)..(10): xaa in position 10 is Asp or Glu
  Variant (11)..(11): xaa in position 11 is Pro or Ser
  Variant (12)..(12): xaa in position 12 is Ala, Gly or Asn
  Variant (13)..(13): xaa in position 13 is Ala, Ser or Thr
  Variant (14)..(15): xaa in position 14 to 15 is any amino acid
  Variant (18)..(19): xaa in position 18 to 19 is any amino acid
  Variant (20)..(20): xaa in position 20 is Ile, Leu or Met
  Variant (21)..(23): xaa in position 21 to 23 is any amino acid
  Variant (25)..(26): xaa in position 25 to 26 is any amino acid
  Variant (27)..(27): xaa in position 27 is Phe, Ile, Leu, Met or Val
  Variant (28)..(28): xaa in position 28 is Phe, Ile, Leu or Val
  Variant (29)..(29): xaa in position 29 is any amino acid
  Variant (30)..(30): xaa in position 30 is Ala or Gly
  Variant (31)..(32): xaa in position 31 to 32 is any amino acid
  Variant (33)..(33): xaa in position 33 is Ile, Leu, Met or Val
  Variant (34)..(34): xaa in position 34 is Ala, Cys, Gly, Ser, Thr or Val
  Variant (35)..(35): xaa in position 35 is Ala, Cys, Gly, Ser or Thr
  Variant (36)..(36): xaa in position 36 is any amino acid
  Variant (37)..(37): xaa in position 37 is Ala, Gly, Ser, Thr or Val
  Variant (38)..(49): xaa in position 38 to 49 is any amino acid
  Variant (50)..(50): xaa in position 50 is Ala, Glu or Gly

SEQ ID NO: 56332 - protein, 45 aa, Artificial sequence; identical to SEQ ID NO: 39435
  Variant (3)..(4): xaa in position 3 to 4 is any or no amino acid
  Variant (6)..(6): xaa in position 6 is Ile or Val
  Variant (7)..(7): xaa in position 7 is Ala or Cys
  Variant (11)..(11): xaa in position 11 is Ser or Thr
  Variant (12)..(12): xaa in position 12 is Ala or Ser
  Variant (13)..(13): xaa in position 13 is any amino acid
  Variant (14)..(14): xaa in position 14 is Phe, Ile, Leu or Met
  Variant (15)..(15): xaa in position 15 is Ala, Asp, Glu, Gly, Asn or Ser
  Variant (17)..(17): xaa in position 17 is Ile, Leu or Val
  Variant (20)..(21): xaa in position 20 to 21 is any amino acid
  Variant (22)..(22): xaa in position 22 is Ala or Gly
  Variant (23)..(23): xaa in position 23 is any amino acid
  Variant (24)..(24): xaa in position 24 is Pro or Val
  Variant (25)..(26): xaa in position 25 to 26 is any amino acid
  Variant (27)..(27): xaa in position 27 is Lys or Arg
  Variant (30)..(30): xaa in position 30 is any amino acid
  Variant (31)..(31): xaa in position 31 is Pro or Val
  Variant (32)..(34): xaa in position 32 to 34 is any amino acid
  Variant (36)..(39): xaa in position 36 to 39 is any amino acid
  Variant (41)..(41): xaa in position 41 is Ser or Thr
  Variant (42)..(44): xaa in position 42 to 44 is any amino acid

SEQ ID NO: 56333 - protein, 16 aa, Artificial sequence
  Variant (2)..(4): xaa in position 2 to 4 is any amino acid
  Variant (9)..(9): xaa in position 9 is any amino acid
  Variant (15)..(15): xaa in position 15 is any amino acid
FXXXESCGXCTPCRXG

SEQ ID NO: 56334 - DNA, 2374 bp, Escherichia coli K12; identical to SEQ ID NO: 1805
  CDS (86)..(2281)

SEQ ID NO: 56335 - protein, 731 aa, Escherichia coli K12; identical to SEQ ID NO: 1806

SEQ ID NO: 56336 - DNA, 2961 bp, Hafnia alvei; identical to SEQ ID NO: 1807
  CDS (185)..(2404)

SEQ ID NO: 56337 - protein, 739 aa, Hafnia alvei; identical to SEQ ID NO: 1808

SEQ ID NO: 56338 - DNA, 4341 bp, Escherichia coli; identical to SEQ ID NO: 1809
  CDS (660)..(2858)

SEQ ID NO: 56339 - protein, 732 aa, Escherichia coli; identical to SEQ ID NO: 1810

SEQ ID NO: 56340 - DNA, 1850 bp, Bacillus subtilis; identical to SEQ ID NO: 1811
  CDS (312)..(1784)

SEQ ID NO: 56341 - protein, 490 aa, Bacillus subtilis; identical to SEQ ID NO: 1812

SEQ ID NO: 56342 - DNA, 3091 bp, Lactobacillus sp; identical to SEQ ID NO: 1813
  CDS (572)..(2767)

SEQ ID NO: 56343 - protein, 731 aa, Lactobacillus sp; identical to SEQ ID NO: 1814

SEQ ID NO: 56344 - DNA, 1449 bp, Bacillus halodurans; identical to SEQ ID NO: 1815
  CDS (1)..(1449)

SEQ ID NO: 56345 - protein, 482 aa, Bacillus halodurans; identical to SEQ ID NO: 1816

SEQ ID NO: 56346 - DNA, 2196 bp, Sinorhizobium meliloti; identical to SEQ ID NO: 1817
  CDS (1)..(2196)

SEQ ID NO: 56347 - protein, 731 aa, Sinorhizobium meliloti; identical to SEQ ID NO: 1818

SEQ ID NO: 56348 - DNA, 1380 bp, Listeria innocua; identical to SEQ ID NO: 1819
  CDS (1)..(1380)

SEQ ID NO: 56349 - protein, 459 aa, Listeria innocua; identical to SEQ ID NO: 1820

SEQ ID NO: 56350 - DNA, 2307 bp, Yersinia pestis; identical to SEQ ID NO: 1821
  CDS (1)..(2307)

SEQ ID NO: 56351 - protein, 768 aa, Yersinia pestis; identical to SEQ ID NO: 1822

SEQ ID NO: 56352 - DNA, 2145 bp, Salmonella enterica subsp. enterica serovar Typhi; identical to SEQ ID NO: 1823
  CDS (1)..(2145)

SEQ ID NO: 56353 - protein, 714 aa, Salmonella enterica subsp. enterica serovar Typhi; identical to SEQ ID NO: 1824

SEQ ID NO: 56354 - DNA, 1467 bp, Nostoc sp. PCC 7120; identical to SEQ ID NO: 1825
  CDS (1)..(1467)

SEQ ID NO: 56355 - protein, 488 aa, Nostoc sp. PCC 7120; identical to SEQ ID NO: 1826

SEQ ID NO: 56356 - DNA, 2163 bp, Yersinia pestis; identical to SEQ ID NO: 1827
  CDS (1)..(2163)

SEQ ID NO: 56357 - protein, 720 aa, Yersinia pestis; identical to SEQ ID NO: 1828

SEQ ID NO: 56358 - DNA, 2271 bp, Salmonella enterica subsp. enterica serovar Typhi; identical to SEQ ID NO: 1829
  CDS (1)..(2271)

SEQ ID NO: 56359 - protein, 756 aa, Salmonella enterica subsp. enterica serovar Typhi; identical to SEQ ID NO: 1830

SEQ ID NO: 56360 - DNA, 2148 bp, Escherichia coli; identical to SEQ ID NO: 1831
  CDS (1)..(2148)

SEQ ID NO: 56361 - protein, 715 aa, Escherichia coli; identical to SEQ ID NO: 1832

SEQ ID NO: 56362 - DNA, 2835 bp, Escherichia coli; identical to SEQ ID NO: 1833
  CDS (571)..(2712)

SEQ ID NO: 56363 - protein, 713 aa, Escherichia coli; identical to SEQ ID NO: 1834

SEQ ID NO: 56364 - DNA, 1446 bp, Clostridium acetobutylicum; identical to SEQ ID NO: 1835
  CDS (1)..(1446)

SEQ ID NO: 56365 - protein, 481 aa, Clostridium acetobutylicum; identical to SEQ ID NO: 1836

SEQ ID NO: 56366 - DNA, 1464 bp, Clostridium acetobutylicum; identical to SEQ ID NO: 1837
  CDS (1)..(1464)

SEQ ID NO: 56367 - protein, 487 aa, Clostridium acetobutylicum; identical to SEQ ID NO: 1838

SEQ ID NO: 56368 - DNA, 2256 bp, Pseudomonas aeruginosa; identical to SEQ ID NO: 1839
  CDS (1)..(2256)

SEQ ID NO: 56369 - protein, 751 aa, Pseudomonas aeruginosa; identical to SEQ ID NO: 1840

SEQ ID NO: 56370 - DNA, 2853 bp, Mycobacterium leprae; identical to SEQ ID NO: 1841
  CDS (1)..(2853)

SEQ ID NO: 56371 - protein, 950 aa, Mycobacterium leprae; identical to SEQ ID NO: 1842

SEQ ID NO: 56372 - DNA, 2202 bp, Vibrio cholerae; identical to SEQ ID NO: 1843
  CDS (1)..(2202)

SEQ ID NO: 56373 - protein, 733 aa, Vibrio cholerae; identical to SEQ ID NO: 1844

SEQ ID NO: 56374 - DNA, 2163 bp, Vibrio cholerae; identical to SEQ ID NO: 1845
  CDS (1)..(2163)

SEQ ID NO: 56375 - protein, 720 aa, Vibrio cholerae; identical to SEQ ID NO: 1846

SEQ ID NO: 56376 - DNA, 2163 bp, Haemophilus influenzae; identical to SEQ ID NO: 1847
  CDS (1)..(2163)

SEQ ID NO: 56377 - protein, 720 aa, Haemophilus influenzae; identical to SEQ ID NO: 1848

SEQ ID NO: 56378 - DNA, 2844 bp, Mycobacterium tuberculosis; identical to SEQ ID NO: 1849
  CDS (1)..(2844)

SEQ ID NO: 56379 - protein, 947 aa, Mycobacterium tuberculosis; identical to SEQ ID NO: 1850

SEQ ID NO: 56380 - DNA, 1476 bp, Streptococcus pneumoniae; identical to SEQ ID NO: 1851
  CDS (1)..(1476)

SEQ ID NO: 56381 - protein, 491 aa, Streptococcus pneumoniae; identical to SEQ ID NO: 1852

SEQ ID NO: 56382 - DNA, 1476 bp, Bacillus halodurans; identical to SEQ ID NO: 1853
  CDS (1)..(1476)

SEQ ID NO: 56383 - protein, 491 aa, Bacillus halodurans; identical to SEQ ID NO: 1854

SEQ ID NO: 56384 - DNA, 2349 bp, Sinorhizobium meliloti; identical to SEQ ID NO: 1855
  CDS (1)..(2349)

SEQ ID NO: 56385 - protein, 782 aa, Sinorhizobium meliloti; identical to SEQ ID NO: 1856

SEQ ID NO: 56386 - DNA, 1476 bp, Streptococcus pneumoniae; identical to SEQ ID NO: 1857
  CDS (1)..(1476)

SEQ ID NO: 56387 - protein, 491 aa, Streptococcus pneumoniae; identical to SEQ ID NO: 1858

SEQ ID NO: 56388 - DNA, 2271 bp, Escherichia coli; identical to SEQ ID NO: 1859
  CDS (1)..(2271)

SEQ ID NO: 56389 - protein, 756 aa, Escherichia coli; identical to SEQ ID NO: 1860

SEQ ID NO: 56390 - DNA, 1443 bp, Bacillus subtilis; identical to SEQ ID NO: 1861
  CDS (1)..(1443)

SEQ ID NO: 56391 - protein, 480 aa, Bacillus subtilis; identical to SEQ ID NO: 1862

SEQ ID NO: 56392 - DNA, 1452 bp, Synechocystis sp; identical to SEQ ID NO: 1863
  CDS (1)..(1452)

SEQ ID NO: 56393 - protein, 483 aa, Synechocystis sp; identical to SEQ ID NO: 1864

SEQ ID NO: 56394 - DNA, 2307 bp, Yersinia pseudotuberculosis IP 32953; identical to SEQ ID NO: 1865
  CDS (1)..(2307)

SEQ ID NO: 56395 - protein, 768 aa, Yersinia pseudotuberculosis IP 32953; identical to SEQ ID NO: 1866

SEQ ID NO: 56396 - DNA, 1467 bp, Symbiobacterium thermophilum; identical to SEQ ID NO: 1867
  CDS (1)..(1467)

SEQ ID NO: 56397 - protein, 488 aa, Symbiobacterium thermophilum; identical to SEQ ID NO: 1868

SEQ ID NO: 56398 - DNA, 1410 bp, Symbiobacterium thermophilum; identical to SEQ ID NO: 1869
  CDS (1)..(1410)

SEQ ID NO: 56399 - protein, 469 aa, Symbiobacterium thermophilum; identical to SEQ ID NO: 1870

SEQ ID NO: 56400 - DNA, 2154 bp, Erwinia carotovora; identical to SEQ ID NO: 1871
  CDS (1)..(2154)

SEQ ID NO: 56401 - protein, 717 aa, Erwinia carotovora; identical to SEQ ID NO: 1872

SEQ ID NO: 56402 - DNA, 2790 bp, Acinetobacter sp; identical to SEQ ID NO: 1873
  CDS (1)..(2790)

SEQ ID NO: 56403 - protein, 929 aa, Acinetobacter sp; identical to SEQ ID NO: 1874

SEQ ID NO: 56404 - DNA, 1482 bp, Bacillus thuringiensis; identical to SEQ ID NO: 1875
  CDS (1)..(1482)

SEQ ID NO: 56405 - protein, 493 aa, Bacillus thuringiensis; identical to SEQ ID NO: 1876

SEQ ID NO: 56406 - DNA, 1422 bp, Bacillus thuringiensis; identical to SEQ ID NO: 1877
  CDS (1)..(1422)

SEQ ID NO: 56407 - protein, 473 aa, Bacillus thuringiensis; identical to SEQ ID NO: 1878

SEQ ID NO: 56408 - DNA, 2358 bp, Rhodopseudomonas palustris; identical to SEQ ID NO: 1879
  CDS (1)..(2358)

SEQ ID NO: 56409 - protein, 785 aa, Rhodopseudomonas palustris; identical to SEQ ID NO: 1880

SEQ ID NO: 56410 - DNA, 2837 bp, Shigella boydii; identical to SEQ ID NO: 1881
  CDS (165)..(2435)

SEQ ID NO: 56411 - protein, 756 aa, Shigella boydii; identical to SEQ ID NO: 1882

SEQ ID NO: 56412 - DNA, 1380 bp, Listeria monocytogenes; identical to SEQ ID NO: 1883
  CDS (1)..(1380)

SEQ ID NO: 56413 - protein, 459 aa, Listeria monocytogenes; identical to SEQ ID NO: 1884

SEQ ID NO: 56414 - DNA, 1482 bp, Bacillus cereus; identical to SEQ ID NO: 1885
  CDS (1)..(1482)

SEQ ID NO: 56415 - protein, 493 aa, Bacillus cereus; identical to SEQ ID NO: 1886

SEQ ID NO: 56416 - DNA, 1422 bp, Bacillus cereus; identical to SEQ ID NO: 1887
  CDS (1)..(1422)

SEQ ID NO: 56417 - protein, 473 aa, Bacillus cereus; identical to SEQ ID NO: 1888

SEQ ID NO: 56418 - DNA, 1458 bp, Mycobacterium paratuberculosis; identical to SEQ ID NO: 1889
  CDS (1)..(1458)

SEQ ID NO: 56419 - protein, 485 aa, Mycobacterium paratuberculosis; identical to SEQ ID NO: 1890

SEQ ID NO: 56420 - DNA, 2853 bp, Mycobacterium paratuberculosis; identical to SEQ ID NO: 1891
  CDS (1)..(2853)

SEQ ID NO: 56421 - protein, 950 aa, Mycobacterium paratuberculosis; identical to SEQ ID NO: 1892

SEQ ID NO: 56422 - DNA, 2100 bp, Lactobacillus johnsonii; identical to SEQ ID NO: 1893
  CDS (1)..(2100)

SEQ ID NO: 56423 - protein, 699 aa, Lactobacillus johnsonii; identical to SEQ ID NO: 1894

SEQ ID NO: 56424 - DNA, 3625 bp, Vibrio parahaemolyticus; identical to SEQ ID NO: 1895
  CDS (1451)..(3625)

SEQ ID NO: 56425 - protein, 724 aa, Vibrio parahaemolyticus; identical to SEQ ID NO: 1896

SEQ ID NO: 56426 - DNA, 2142 bp, Shigella flexneri; identical to SEQ ID NO: 1897
  CDS (1)..(2142)

SEQ ID NO: 56427 - protein, 713 aa, Shigella flexneri; identical to SEQ ID NO: 1898

SEQ ID NO: 56428 - DNA, 2181 bp, Vibrio vulnificus; identical to SEQ ID NO: 1899
  CDS (1)..(2181)

SEQ ID NO: 56429 - protein, 726 aa, Vibrio vulnificus; identical to SEQ ID NO: 1900

SEQ ID NO: 56430 - DNA, 2307 bp, Photorhabdus luminescens; identical to SEQ ID NO: 1901
  CDS (1)..(2307)

SEQ ID NO: 56431 - protein, 768 aa, Photorhabdus luminescens; identical to SEQ ID NO: 1902

SEQ ID NO: 56432 - DNA, 1404 bp, Gloeobacter violaceus; identical to SEQ ID NO: 1903
  CDS (1)..(1404)

SEQ ID NO: 56433 - protein, 467 aa, Gloeobacter violaceus; identical to SEQ ID NO: 1904

SEQ ID NO: 56434 - DNA, 2259 bp, Chromobacterium violaceum; identical to SEQ ID NO: 1905
  CDS (1)..(2259)

SEQ ID NO: 56435 - protein, 752 aa, Chromobacterium violaceum; identical to SEQ ID NO: 1906

SEQ ID NO: 56436 - DNA, 1251 bp, Chromobacterium violaceum; identical to SEQ ID NO: 1907
  CDS (1)..(1251)

SEQ ID NO: 56437 - protein, 416 aa, Chromobacterium violaceum; identical to SEQ ID NO: 1908

SEQ ID NO: 56438 - DNA, 2352 bp, Fusobacterium nucleatum subsp; identical to SEQ ID NO: 1909
  CDS (1)..(2352)

SEQ ID NO: 56439 - protein, 783 aa, Fusobacterium nucleatum subsp; identical to SEQ ID NO: 1910

SEQ ID NO: 56440 - DNA, 2196 bp, Shigella flexneri; identical to SEQ ID NO: 1911
  CDS (1)..(2196)

SEQ ID NO: 56441 - protein, 731 aa, Shigella flexneri; identical to SEQ ID NO: 1912

SEQ ID NO: 56442 - DNA, 2271 bp, Bordetella pertussis; identical to SEQ ID NO: 1913
  CDS (1)..(2271)

SEQ ID NO: 56443 - protein, 756 aa, Bordetella pertussis; identical to SEQ ID NO: 1914

SEQ ID NO: 56444 - DNA, 2271 bp, Bordetella parapertussis; identical to SEQ ID NO: 1915
  CDS (1)..(2271)

SEQ ID NO: 56445 - protein, 756 aa, Bordetella parapertussis; identical to SEQ ID NO: 1916

SEQ ID NO: 56446 - DNA, 1422 bp, Bacillus cereus; identical to SEQ ID NO: 1917
  CDS (1)..(1422)

SEQ ID NO: 56447 - protein, 473 aa, Bacillus cereus; identical to SEQ ID NO: 1918

SEQ ID NO: 56448 - DNA, 1422 bp, Bacillus anthracis; identical to SEQ ID NO: 1919
  CDS (1)..(1422)

SEQ ID NO: 56449 - protein, 473 aa, Bacillus anthracis; identical to SEQ ID NO: 1920

SEQ ID NO: 56450 - DNA, 2271 bp, Shigella flexneri; identical to SEQ ID NO: 1921
  CDS (1)..(2271)

SEQ ID NO: 56451 - protein, 756 aa, Shigella flexneri; identical to SEQ ID NO: 1922

SEQ ID NO: 56452 - DNA, 2136 bp, Shigella flexneri; identical to SEQ ID NO: 1923
  CDS (1)..(2136)

SEQ ID NO: 56453 - protein, 711 aa, Shigella flexneri; identical to SEQ ID NO: 1924

SEQ ID NO: 56454 - DNA, 2127 bp, Escherichia coli; identical to SEQ ID NO: 1925
  CDS (1)..(2127)

SEQ ID NO: 56455 - protein, 708 aa, Escherichia coli; identical to SEQ ID NO: 1926

SEQ ID NO: 56456 - DNA, 1563 bp, Oryza sativa; identical to SEQ ID NO: 1927
  CDS (1)..(1563)

SEQ ID NO: 56457 - protein, 520 aa, Oryza sativa; identical to SEQ ID NO: 1928

SEQ ID NO: 56458 - DNA, 2181 bp, Vibrio parahaemolyticus; identical to SEQ ID NO: 1929
  CDS (1)..(2181)

SEQ ID NO: 56459 - protein, 726 aa, Vibrio parahaemolyticus; identical to SEQ ID NO: 1930

SEQ ID NO: 56460 - DNA, 4026 bp, Vibrio parahaemolyticus; identical to SEQ ID NO: 1931
  CDS (1779)..(3914)

SEQ ID NO: 56461 - protein, 711 aa, Vibrio parahaemolyticus; identical to SEQ ID NO: 1932

SEQ ID NO: 56462 - DNA, 1461 bp, Clostridium tetani; identical to SEQ ID NO: 1933
  CDS (1)..(1461)

SEQ ID NO: 56463 - protein, 486 aa, Clostridium tetani; identical to SEQ ID NO: 1934

SEQ ID NO: 56464 - DNA, 1416 bp, Clostridium tetani; identical to SEQ ID NO: 1935
  CDS (1)..(1416)

SEQ ID NO: 56465 - protein, 471 aa, Clostridium tetani; identical to SEQ ID NO: 1936

SEQ ID NO: 56466 - DNA, 2766 bp, Bradyrhizobium japonicum; identical to SEQ ID NO: 1937
  CDS (1)..(2766)

SEQ ID NO: 56467 - protein, 921 aa, Bradyrhizobium japonicum; identical to SEQ ID NO: 1938

SEQ ID NO: 56468 - DNA, 2517 bp, Bradyrhizobium japonicum; identical to SEQ ID NO: 1939
  CDS (1)..(2517)

SEQ ID NO: 56469 - protein, 838 aa, Bradyrhizobium japonicum; identical to SEQ ID NO: 1940

SEQ ID NO: 56470 - DNA, 2181 bp, Vibrio vulnificus; identical to SEQ ID NO: 1941
  CDS (1)..(2181)

SEQ ID NO: 56471 - protein, 726 aa, Vibrio vulnificus; identical to SEQ ID NO: 1942

SEQ ID NO: 56472 - DNA, 2109 bp, Vibrio vulnificus; identical to SEQ ID NO: 1943
  CDS (1)..(2109)

SEQ ID NO: 56473 - protein, 702 aa, Vibrio vulnificus; identical to SEQ ID NO: 1944

SEQ ID NO: 56474 - DNA, 2163 bp, Shewanella oneidensis; identical to SEQ ID NO: 1945
  CDS (1)..(2163)

SEQ ID NO: 56475 - protein, 720 aa, Shewanella oneidensis; identical to SEQ ID NO: 1946

SEQ ID NO: 56476 - DNA, 1419 bp, Oceanobacillus iheyensis; identical to SEQ ID NO: 1947
  CDS (1)..(1419)

SEQ ID NO: 56477 - protein, 472 aa, Oceanobacillus iheyensis; identical to SEQ ID NO: 1948

SEQ ID NO: 56478 - DNA, 2154 bp, Escherichia coli O6; identical to SEQ ID NO: 1949
  CDS (1)..(2154)

SEQ ID NO: 56479 - protein, 717 aa, Escherichia coli O6; identical to SEQ ID NO: 1950

SEQ ID NO: 56480 - DNA, 2271 bp, Escherichia coli O6; identical to SEQ ID NO: 1951
  CDS (1)..(2271)

SEQ ID NO: 56481 - protein, 756 aa, Escherichia coli O6; identical to SEQ ID NO: 1952

SEQ ID NO: 56482 - DNA, 2370 bp, Escherichia coli O6; identical to SEQ ID NO: 1953
  CDS (1)..(2370)

SEQ ID NO: 56483 - protein, 789 aa, Escherichia coli O6; identical to SEQ ID NO: 1954

SEQ ID NO: 56484 - DNA, 2136 bp, Escherichia coli O6; identical to SEQ ID NO: 1955
  CDS (1)..(2136)

SEQ ID NO: 56485 - protein, 711 aa, Escherichia coli O6; identical to SEQ ID NO: 1956

SEQ ID NO: 56486 - DNA, 2208 bp, Escherichia coli O6; identical to SEQ ID NO: 1957
  CDS (1)..(2208)

SEQ ID NO: 56487 - protein, 735 aa, Escherichia coli O6; identical to SEQ ID NO: 1958

SEQ ID NO: 56488 - DNA, 2142 bp, Escherichia coli O6; identical to SEQ ID NO: 1959
  CDS (1)..(2142)

SEQ ID NO: 56489 - protein, 713 aa, Escherichia coli O6; identical to SEQ ID NO: 1960

SEQ ID NO: 56490 - DNA, 1488 bp, Thermoanaerobacter tengcongensis; identical to SEQ ID NO: 1961
  CDS (1)..(1488)

SEQ ID NO: 56491 - protein, 495 aa, Thermoanaerobacter tengcongensis; identical to SEQ ID NO: 1962

SEQ ID NO: 56492 - DNA, 1419 bp, Thermoanaerobacter tengcongensis; identical to SEQ ID NO: 1963
  CDS (1)..(1419)

SEQ ID NO: 56493 - protein, 472 aa, Thermoanaerobacter tengcongensis; identical to SEQ ID NO: 1964

SEQ ID NO: 56494 - DNA, 2352 bp, Fusobacterium nucleatum; identical to SEQ ID NO: 1965
  CDS (1)..(2352)

SEQ ID NO: 56495 - protein, 783 aa, Fusobacterium nucleatum; identical to SEQ ID NO: 1966

SEQ ID NO: 56496 - DNA, 1431 bp, Clostridium perfringens; identical to SEQ ID NO: 1967
  CDS (1)..(1431)

SEQ ID NO: 56497 - protein, 476 aa, Clostridium perfringens; identical to SEQ ID NO: 1968

SEQ ID NO: 56498 - DNA, 1455 bp, Clostridium perfringens; identical to SEQ ID NO: 1969
  CDS (1)..(1455)

SEQ ID NO: 56499 - protein, 484 aa, Clostridium perfringens; identical to SEQ ID NO: 1970

SEQ ID NO: 56500 - DNA, 2280 bp, Ralstonia solanacearum; identical to SEQ ID NO: 1971
  CDS (1)..(2280)

SEQ ID NO: 56501 - protein, 759 aa, Ralstonia solanacearum; identical to SEQ ID NO: 1972

SEQ ID NO: 56502 - DNA, 2271 bp, Salmonella typhimurium; identical to SEQ ID NO: 1973
  CDS (1)..(2271)

SEQ ID NO: 56503 - protein, 756 aa, Salmonella typhimurium; identical to SEQ ID NO: 1974

SEQ ID NO: 56504 - DNA, 2136 bp, Salmonella typhimurium; identical to SEQ ID NO: 1975
  CDS (1)..(2136)

SEQ ID NO: 56505 - protein, 711 aa, Salmonella typhimurium; identical to SEQ ID NO: 1976

SEQ ID NO: 56506 - DNA, 2199 bp, Salmonella typhimurium; identical to SEQ ID NO: 1977
  CDS (1)..(2199)

SEQ ID NO: 56507 - protein, 732 aa, Salmonella typhimurium; identical to SEQ ID NO: 1978

SEQ ID NO: 56508 - DNA, 2142 bp, Salmonella typhimurium; identical to SEQ ID NO: 1979
  CDS (1)..(2142)

SEQ ID NO: 56509 - protein, 713 aa, Salmonella typhimurium; identical to SEQ ID NO: 1980

SEQ ID NO: 56510 - DNA, 2136 bp, Vibrio vulnificus; identical to SEQ ID NO: 1981
  CDS (1)..(2136)

SEQ ID NO: 56511 - protein, 711 aa, Vibrio vulnificus; identical to SEQ ID NO: 1982

SEQ ID NO: 56512 - DNA, 2163 bp, Pasteurella multocida; identical to SEQ ID NO: 1983
  CDS (1)..(2163)

SEQ ID NO: 56513 - protein, 720 aa, Pasteurella multocida; identical to SEQ ID NO: 1984

SEQ ID NO: 56514 - DNA, 2139 bp, Moritella japonica; identical to SEQ ID NO: 1985
  CDS (1)..(2139)

SEQ ID NO: 56515 - protein, 712 aa, Moritella japonica; identical to SEQ ID NO: 1986

SEQ ID NO: 56516 - DNA, 1479 bp, Streptomyces coelicolor; identical to SEQ ID NO: 1987
  CDS (1)..(1479)

SEQ ID NO: 56517 - protein, 492 aa, Streptomyces coelicolor; identical to SEQ ID NO: 1988

SEQ ID NO: 56518 - DNA, 2130 bp, Eikenella corrodens; identical to SEQ ID NO: 1989
  CDS (1)..(2130)

SEQ ID NO: 56519 - protein, 709 aa, Eikenella corrodens; identical to SEQ ID NO: 1990

SEQ ID NO: 56520 - DNA, 2271 bp, Escherichia coli; identical to SEQ ID NO: 1859
  CDS (4)..(2271)

SEQ ID NO: 56521 - protein, 755 aa, Escherichia coli; identical to SEQ ID NO: 1992

SEQ ID NO: 56522 - DNA, 2196 bp, Lactobacillus sp; identical to SEQ ID NO: 1993
  CDS (1)..(2196)

SEQ ID NO: 56523 - protein, 731 aa, Lactobacillus sp; identical to SEQ ID NO: 1814

SEQ ID NO: 56524 - DNA, 1482 bp, Bacillus anthracis; identical to SEQ ID NO: 1995
  CDS (1)..(1482)

SEQ ID NO: 56525 - protein, 493 aa, Bacillus anthracis; identical to SEQ ID NO: 1996

SEQ ID NO: 56526 - DNA, 1383 bp, Bacillus cereus; identical to SEQ ID NO: 1997
  CDS (1)..(1383)

SEQ ID NO: 56527 - protein, 460 aa, Bacillus cereus; identical to SEQ ID NO: 1998

SEQ ID NO: 56528 - DNA, 20 bp, Artificial sequence
  (1)..(20): primer
atggggcagggttttccacc

SEQ ID NO: 56529 - DNA, 25 bp, Artificial sequence
  (1)..(25): primer
ttacttcaacacataaccgtacaac

SEQ ID NO: 56530 - protein, 642 aa, Artificial sequence; identical to SEQ ID NO: 2902
  Variant (2)..(5): xaa in position 2 to 5 is any amino acid
  Variant (7)..(58): xaa in position 7 to 58 is any amino acid
  Variant (60)..(61): xaa in position 60 to 61 is any amino acid
  Variant (63)..(66): xaa in position 63 to 66 is any amino acid
  Variant (68)..(71): xaa in position 68 to 71 is any amino acid
  Variant (73)..(76): xaa in position 73 to 76 is any amino acid
  Variant (78)..(90): xaa in position 78 to 90 is any amino acid
  Variant (92)..(92): xaa in position 92 is any amino acid
  Variant (94)..(113): xaa in position 94 to 113 is any amino acid
  Variant (116)..(116): xaa in position 116 is any amino acid
  Variant (120)..(131): xaa in position 120 to 131 is any amino acid
  Variant (133)..(188): xaa in position 133 to 188 is any amino acid
  Variant (191)..(191): xaa in position 191 is any amino acid
  Variant (193)..(215): xaa in position 193 to 215 is any amino acid
  Variant (217)..(217): xaa in position 217 is any amino acid
  Variant (219)..(224): xaa in position 219 to 224 is any amino acid
  Variant (226)..(290): xaa in position 226 to 290 is any amino acid
  Variant (292)..(292): xaa in position 292 is any amino acid
  Variant (295)..(300): xaa in position 295 to 300 is any amino acid
  Variant (302)..(302): xaa in position 302 is any amino acid
  Variant (304)..(305): xaa in position 304 to 305 is any amino acid
  Variant (307)..(333): xaa in position 307 to 333 is any amino acid
  Variant (337)..(337): xaa in position 337 is any amino acid
  Variant (339)..(341): xaa in position 339 to 341 is any amino acid
  Variant (343)..(355): xaa in position 343 to 355 is any amino acid
  Variant (357)..(370): xaa in position 357 to 370 is any amino acid
  Variant (372)..(457): xaa in position 372 to 457 is any amino acid
  Variant (460)..(460): xaa in position 460 is any amino acid
  Variant (462)..(494): xaa in position 462 to 494 is any amino acid
  Variant (496)..(497): xaa in position 496 to 497 is any amino acid
  Variant (499)..(505): xaa in position 499 to 505 is any amino acid
  Variant (507)..(520): xaa in position 507 to 520 is any amino acid
  Variant (522)..(524): xaa in position 522 to 524 is any amino acid
  Variant (526)..(620): xaa in position 526 to 620 is any amino acid
  Variant (622)..(624): xaa in position 622 to 624 is any amino acid
  Variant (626)..(630): xaa in position 626 to 630 is any amino acid
  Variant (635)..(640): xaa in position 635 to 640 is any amino acid

SEQ ID NO: 56531 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 56532 - protein, 76 aa, Artificial sequence; identical to SEQ ID NO: 2897
  Variant (1)..(1): xaa in position 1 is Leu, Met or Val
  Variant (2)..(2): xaa in position 2 is Gly or Asp
  Variant (3)..(3): xaa in position 3 is Asp, Ser, Asn, Gln or Gly
  Variant (4)..(4): xaa in position 4 is Leu or Arg
  Variant (5)..(6): xaa in position 5 to 6 is any amino acid
  Variant (7)..(7): xaa in position 7 is His or Pro
  Variant (8)..(8): xaa in position 8 is any amino acid
  Variant (9)..(9): xaa in position 9 is Gly, Ser, Glu or Asp
  Variant (10)..(13): xaa in position 10 to 13 is any amino acid
  Variant (14)..(14): xaa in position 14 is Ala or Ser
  Variant (15)..(15): xaa in position 15 is Gln, Glu or Met
  Variant (16)..(18): xaa in position 16 to 18 is any amino acid
  Variant (19)..(19): xaa in position 19 is Ala or Ser
  Variant (20)..(21): xaa in position 20 to 21 is any amino acid
  Variant (22)..(22): xaa in position 22 is Phe, Tyr, Trp or Val
  Variant (23)..(23): xaa in position 23 is any amino acid
  Variant (24)..(24): xaa in position 24 is Ala, Ser or Val
  Variant (25)..(27): xaa in position 25 to 27 is any amino acid
  Variant (28)..(28): xaa in position 28 is Tyr, Phe or Trp
  Variant (29)..(30): xaa in position 29 to 30 is any amino acid
  Variant (31)..(31): xaa in position 31 is Val, Thr, Leu or Ile
  Variant (32)..(32): xaa in position 32 is any amino acid
  Variant (34)..(34): xaa in position 34 is Thr or Ser
  Variant (35)..(35): xaa in position 35 is Ser or Thr
  Variant (36)..(36): xaa in position 36 is any amino acid
  Variant (37)..(37): xaa in position 37 is Ser, Ala or Gly
  Variant (38)..(38): xaa in position 38 is Asn, Ile, Val or Ser
  Variant (39)..(51): xaa in position 39 to 51 is any amino acid
  Variant (52)..(52): xaa in position 52 is Val, Ile, Leu or Ala
  Variant (53)..(53): xaa in position 53 is Leu, Ile, Val or Met
  Variant (54)..(55): xaa in position 54 to 55 is any amino acid
  Variant (57)..(57): xaa in position 57 is Asn or Asp
  Variant (58)..(58): xaa in position 58 is any amino acid
  Variant (60)..(60): xaa in position 60 is Lys, Gln or Arg
  Variant (61)..(61): xaa in position 61 is Ser or Ala
  Variant (62)..(65): xaa in position 62 to 65 is any amino acid
  Variant (66)..(66): xaa in position 66 is any or no amino acid
  Variant (67)..(67): xaa in position 67 is Leu, Ile, Met or Val
  Variant (68)..(73): xaa in position 68 to 73 is any amino acid
  Variant (74)..(74): xaa in position 74 is Pro or Ala
  Variant (75)..(75): xaa in position 75 is any amino acid
  Variant (76)..(76): xaa in position 76 is Tyr, Phe or Trp

SEQ ID NO: 56533 - protein, 39 aa, Artificial sequence; identical to SEQ ID NO: 2898
  Variant (1)..(1): xaa in position 1 is Val, Ile, Leu, Phe or Thr
  Variant (2)..(2): xaa in position 2 is Ile, Val, Leu, Phe or Ala
  Variant (3)..(5): xaa in position 3 to 5 is any amino acid
  Variant (6)..(6): xaa in position 6 is Thr, Asn or Ser
  Variant (7)..(7): xaa in position 7 is Tyr, Phe or Pro
  Variant (8)..(8): xaa in position 8 is Asp, Tyr, Phe or His
  Variant (10)..(12): xaa in position 10 to 12 is any amino acid
  Variant (13)..(13): xaa in position 13 is Asn, Asp or Ser
  Variant (14)..(25): xaa in position 14 to 25 is any amino acid
  Variant (26)..(29): xaa in position 26 to 29 is any or no amino acid
  Variant (30)..(30): xaa in position 30 is Ile, Val, Leu or Phe
  Variant (31)..(31): xaa in position 31 is any amino acid
  Variant (32)..(32): xaa in position 32 is Phe, Val, Trp or Ile
  Variant (34)..(34): xaa in position 34 is Glu, Ser or Cys
  Variant (36)..(36): xaa in position 36 is Trp or His
  Variant (37)..(37): xaa in position 37 is any amino acid
  Variant (38)..(38): xaa in position 38 is Ala, Gly, Pro or Val
  Variant (39)..(39): xaa in position 39 is Tyr, His or Phe

SEQ ID NO: 56534 - protein, 84 aa, Artificial sequence; identical to SEQ ID NO: 2899
  Variant (1)..(1): xaa in position 1 is Ser or Leu
  Variant (2)..(2): xaa in position 2 is any amino acid
  Variant (5)..(7): xaa in position 5 to 7 is any amino acid
  Variant (8)..(8): xaa in position 8 is Ala, Gly or Ser
  Variant (9)..(9): xaa in position 9 is Leu, Phe, Met or Ile
  Variant (10)..(10): xaa in position 10 is Ser, Thr, Arg or Glu
  Variant (11)..(11): xaa in position 11 is Gln or Met
  Variant (12)..(12): xaa in position 12 is any amino acid
  Variant (13)..(13): xaa in position 13 is Ser or Ala
  Variant (14)..(14): xaa in position 14 is any amino acid
  Variant (15)..(15): xaa in position 15 is Ile, Leu, Met, Val or Phe
  Variant (16)..(16): xaa in position 16 is His, Asn, Leu or Ile
  Variant (17)..(25): xaa in position 17 to 25 is any amino acid
  Variant (26)..(33): xaa in position 26 to 33 is any or no amino acid
  Variant (34)..(34): xaa in position 34 is Phe, Val, Leu, Met or Ile
  Variant (35)..(42): xaa in position 35 to 42 is any amino acid
  Variant (43)..(43): xaa in position 43 is Ser or Thr
  Variant (44)..(44): xaa in position 44 is Thr or Ser
  Variant (46)..(47): xaa in position 46 to 47 is any amino acid
  Variant (48)..(48): xaa in position 48 is Tyr, Gln or Val
  Variant (49)..(49): xaa in position 49 is any amino acid
  Variant (50)..(50): xaa in position 50 is Leu, Ile, Phe or Met
  Variant (51)..(51): xaa in position 51 is any amino acid
  Variant (52)..(52): xaa in position 52 is Ala or Ser
  Variant (53)..(53): xaa in position 53 is Ser, Ala or Thr
  Variant (54)..(54): xaa in position 54 is any amino acid
  Variant (55)..(55): xaa in position 55 is Asp or Glu
  Variant (56)..(63): xaa in position 56 to 63 is any amino acid
  Variant (64)..(65): xaa in position 64 to 65 is any or no amino acid
  Variant (66)..(66): xaa in position 66 is Gly, Ala, Lys or Asn
  Variant (67)..(73): xaa in position 67 to 73 is any amino acid
  Variant (74)..(74): xaa in position 74 is Ile, Val, Leu, Tyr or Phe
  Variant (75)..(80): xaa in position 75 to 80 is any amino acid
  Variant (81)..(81): xaa in position 81 is Arg or Lys
  Variant (82)..(83): xaa in position 82 to 83 is any amino acid
  Variant (84)..(84): xaa in position 84 is Ile, Leu, Val, Met, Phe, Ala or Thr

SEQ ID NO: 56535 - protein, 31 aa, Artificial sequence; identical to SEQ ID NO: 2900
  Variant (1)..(1): xaa in position 1 is Val, Ile, Leu, Cys or Arg
  Variant (2)..(5): xaa in position 2 to 5 is any amino acid
  Variant (6)..(9): xaa in position 6 to 9 is any or no amino acid
  Variant (10)..(10): xaa in position 10 is Gly, Thr, Asp or Asn
  Variant (11)..(11): xaa in position 11 is any amino acid
  Variant (12)..(12): xaa in position 12 is Ile, Val or Thr
  Variant (13)..(13): xaa in position 13 is any amino acid
  Variant (14)..(14): xaa in position 14 is Ala, Gly, Thr or Leu
  Variant (15)..(16): xaa in position 15 to 16 is any amino acid
  Variant (17)..(17): xaa in position 17 is Val, Ile, Ala, Leu or Phe
  Variant (18)..(19): xaa in position 18 to 19 is any amino acid
  Variant (24)..(24): xaa in position 24 is Ile, Val or Phe
  Variant (25)..(26): xaa in position 25 to 26 is any amino acid
  Variant (27)..(27): xaa in position 27 is Val, Leu, Ile, Phe or Met
  Variant (28)..(29): xaa in position 28 to 29 is any amino acid
  Variant (31)..(31): xaa in position 31 is Glu or Gln

SEQ ID NO: 56536 - DNA, 504 bp, Escherichia coli
  CDS (1)..(504)
atgctaattcgagtagaaattcccattgatgcgccgggtattgatgccctgctgcgtcgttcattcgaaagtgatgcggaagcgaagctggttcacgatctgcgtgaagatggctttctgacgctggggctggtggcracagatgacgaaggtcaggtcattggctatgtggcatttagtccggttgatgtgcagggcgaagacctgcaatgggtcggcatggcaccgctggcggtagatgaaaaataccgtggacaggggctggcacgccaactggtctatgaaggactcgattcgcttaatgagttcggctatgccgcagtggtgacgctgggcgatccggcgctatacagccgtttcggctttgaactggcggcgcatcacgatctgcgttgccgctggccgggcactgaaagcgccttccaggtacatcgtttagcggatgacgcgttgaatggcgtaactggtctggttgagtatcacgagcatttcaatcgcttttaa

SEQ ID NO: 56537 - protein, 167 aa, Escherichia coli
MLIRVEIPIDAPGIDALLRRSFESDAEAKLVHDLREDGFLTLGLVATDDEGQVIGYVAFSPVDVQGEDLQWVGMAPLAVDEKYRGQGLARQLVYEGLDSLNEFGYAAVVTLGDPALYSRFGFELAAHHDLRCRWPGTESAFQVHRLADDALNGVTGLVEYHEHFNRF

SEQ ID NO: 56538 - DNA, 516 bp, Francisella tularensis subsp. tularensis
  CDS (1)..(516)
atgcatgtaaaaatccgctatgaaaaattaaaagatcaagagttaatctataaattgatctctgaagcttttgatactagtaatgaagagaaactagttagacttttgcatactgatcatcaaagcttgatatcgctagttgccgaaactgatgatagcagcataataggtcaggcgattatctcaaaaatgactgctgagaaagatgaaacgctaaaaatatatgctcttgcaccaatgtctgtggcaccaaaatatcaacatcaaggaattggttctaagcttatagaagcaatcattaaggaagccaaaaaaaataatattgatgcaatatttgtcttaggtcatccaagttattatccaaaatttggtttcaaaccagccacagaatatcagataaaatgtgaatatgatgtcccagcggatgtttttatggtactagatttgtcagctaaactagctagtttaaaaggacaaactgtctactatgccgaagagtttggcaaaattttttag

SEQ ID NO: 56539 - protein, 171 aa, Francisella tularensis subsp. tularensis
MHVKIRYEKLKDQELIYKLISEAFDTSNEEKLVRLLHTDHQSLISLVAETDDSSIIGQAIISKMTAEKDETLKIYALAPMSVAPKYQHQGIGSKLIEAIIKEAKKNNIDAIFVLGHPSYYPKFGFKPATEYQIKCEYDVPADVFMVLDLSAKLASLKGQTVYYAEEFGKIF

SEQ ID NO: 56540 - DNA, 507 bp, Mesorhizobium loti MAFF303099
  CDS (1)..(507): transl_table=11
atgagcatgatgtcgatacgcgcggcgacgccgcgggatcgcgaggccattcgcctcgtcgaggaacacgccttcggccagcaggcggaggccgggctggtcgacgcgctggtcaccggcggcgacgccgtcgtcgaactggtggcggaagaagacggccaggcggtcggccacatcctgttttcccggctgttcgtccagactggcggcaggagcttcgcggcggtggcgctggcgccgctggcggtggaaccttcgttccatggcagcggcataggcggcgcgctgatccgcgaggcgcatatccggctgaaggatgccggcgagacgctggcggtggtgctgggcgacccggcctattatggccgtttcggctacagccatgcgcgggccgagaagttcgagagcgaataccagggcgaggcgctgcaggcgctggcctggggcgacgctccggaggccggcaggctggtctacgcttccgccttcaccgctctcgccgcgtag

SEQ ID NO: 56541 - protein, 168 aa, Mesorhizobium loti MAFF303099
MSMMSIRAATPRDREAIRLVEEHAFGQQAEAGLVDALVTGGDAVVELVAEEDGQAVGHILFSRLFVQTGGRSFAAVALAPLAVEPSFHGSGIGGALIREAHIRLKDAGETLAVVLGDPAYYGRFGYSHARAEKFESEYQGEALQALAWGDAPEAGRLVYASAFTALAA

SEQ ID NO: 56542 - DNA, 552 bp, Vibrio cholerae O1 biovar eltor str. N16961
  CDS (1)..(552): transl_table=11
ttgtgcataaagggatgcaaacgccgaattcatcccacgaggttattaatgcttattcgaactgaagcgcctgctgatattttggtggtcgatcaactgttgaaaaacgtctttgctactgaggcagaggcggatttagtgatggcgctgcgtgaaaatggccagcgcactttgtcactggtggcttgcgatgatgaaggtgagattgttgggcatgtgatgttcagtcctgtcacgttagaaggcgaggatctcaactggcaaggtcttgcacctctcgcggtaaaagaagaataccgtcgccaaggcattggtgccgagttagtcaaagaagggttaagctcgcttggggagcttggctatcctgcttgtgtggtgcttggcgatccggcctactactcacgttttggctttgaagatgccgcgcgttattcgctgcgttgtgcttgggatgtaccgcagggagcatttcaagtggtggcgctatgggagcgtgagttagatggtcgatgtggagtgattgaatacagccaagagtttgcggctttataa

SEQ ID NO: 56543 - protein, 183 aa, Vibrio cholerae O1 biovar eltor str. N16961
MCIKGCKRRIHPTRLLMLIRTEAPADILVVDQLLKNVFATEAEADLVMALRENGQRTLSLVACDDEGEIVGHVMFSPVTLEGEDLNWQGLAPLAVKEEYRRQGIGAELVKEGLSSLGELGYPACVVLGDPAYYSRFGFEDAARYSLRCAWDVPQGAFQVVALWERELDGRCGVIEYSQEFAAL

SEQ ID NO: 56544 - DNA, 507 bp, Pseudomonas aeruginosa PAO1
  CDS (1)..(507): transl_table=11
atgaatatttccatccgtgcggagacgcccggcgacatcgacgccatcgcccacctgaccgaagccgcgttccgcaacgaaacgcacagcagccataccgagcagtacatcgtcgatgccctgcgccgtgctggcgcgctgacgctttcgctggtggccgaagcgaatggccaggtgatcggccatatcgcagcctcgccagtgaccatcgatggcgaagcgggcgactggtacggcctcgcgccgctatcggtggcgcccgggcgacagcgccagggtctcggttcgcagttggtccggcgcctgctcaccgagctgcgactgctgcccgcgggtggctgcgtggtactgggcgaaccgacctactactcgcgcttcggctttcgggtggaaagcggcctggcgttgcccggcgttcccgccgaatacttccaggcacagtccttcagcgggcgcatggcgcaaggaatagtggccttccacgccgcattcgacgccagcggctga

SEQ ID NO: 56545 - protein, 168 aa, Pseudomonas aeruginosa PAO1
MNISIRAETPGDIDAIAHLTEAAFRNETHSSHTEQYIVDALRRAGALTLSLVAEANGQVIGHIAASPVTIDGEAGDWYGLAPLSVAPGRQRQGLGSQLVRRLLTELRLLPAGGCVVLGEPTYYSRFGFRVESGLALPGVPAEYFQAQSFSGRMAQGIVAFHAAFDASG

SEQ ID NO: 56546 - DNA, 522 bp, Lactococcus lactis subsp. lactis Il1403
  CDS (1)..(522): transl_table=11
atgataattaaaacaataaatttggaaaactataatgaagttactgaacttattcgtgaatcttttagtcagtcagaacatggttatggtaatgaggctgaacttgttgataaaattcgtaatgaagaaggttatatcaaagatttggaaattgttgcttttgaagatggtaaaatcgttggtcacggtcttttgagtgaggtagagatagtaagtgactcacaaaaattcaaaggtttggtcttagctcctcttgatgttttaactacttaccaaggtaaaggtattggggcagcagtattattggaacttgaaaaaagagcaaaaattttggattatccgtttattagtattttaggtcatgaaacttattatcctaagtttggttatgtaccagcaagtcaatatcaaatcaaagcaccttttgaagttcctgataagaactttatgattaaagaattaactgacggtggcttagaaggaaaatcaggagtaattcactactcagaagcctttaactaa

SEQ ID NO: 56547 - protein, 173 aa, Lactococcus lactis subsp. lactis Il1403
MIIKTINLENYNEVTELIRESFSQSEHGYGNEAELVDKIRNEEGYIKDLEIVAFEDGKIVGHGLLSEVEIVSDSQKFKGLVLAPLDVLTTYQGKGIGAAVLLELEKRAKILDYPFISILGHETYYPKFGYVPASQYQIKAPFEVPDKNFMIKELTDGGLEGKSGVIHYSEAFN

SEQ ID NO: 56548 - DNA, 504 bp, Agrobacterium tumefaciens str. C58
  CDS (1)..(504): transl_table=11
atgatcatccggccggagcggcagggtgatgaagaggcgatcgctcgcgttacggaagatgccttccgtaacgtcgaacaccgtagcgggacagaacaactgatcgtcgcgcggctgcgggacgccggcgctctgacggtttcactggttgcggaagacagcgaaggcatcatcggccatgtcggtttctcgccggtgacgctgtcgagtggcgagaccggctggttctgcctcgcgccgctctccgttacacctgaaaggcagggcgaaggtgtcggttcgaggctggcgcgtgacgggcttgccgtgctggagcggctgagcgctgccggctgcgttgttgtcggcgatcccgcctattacggccgcttcggttttcgccctgtcgcgggcctgagtgccgaggggattcctgacgaatatttcacagttcttcgcttgcatggcggaactccatccggcattgtcggttttcatccgggtttcgatggcgacaacgcttaa

SEQ ID NO: 56549 - protein, 167 aa, Agrobacterium tumefaciens str. C58
MIIRPERQGDEEAIARVTEDAFRNVEHRSGTEQLIVARLRDAGALTVSLVAEDSEGIIGHVGFSPVTLSSGETGWFCLAPLSVTPERQGEGVGSRLARDGLAVLERLSAAGCVVVGDPAYYGRFGFRPVAGLSAEGIPDEYFTVLRLHGGTPSGIVGFHPGFDGDNA

SEQ ID NO: 56550 - DNA, 498 bp, Sinorhizobium meliloti 1021
  CDS (1)..(498): transl_table=11
atgatcatccgaccggaaaccgcgggcgacgccgaggcgatccggcagattaccgaggcggctttcgccgggcagccctatagcgaccagacggaggcccggatcatcgaccggctgcgctccgaggacgcgatgacgctgtccctcgttgccgaggaagagggtgaggtgatcggccacatcgctttttcgcctgtcacgatcaccccgttcgcggtcggctggtacgggctcggtcccgtgtcggtgcggccggactggcaaggacgcggcacggggagcgcacttgtgcgccgcgggctcgacatgctgcgcaaggcgggggcttcaggctgcgtcctggcgggcaatccggccttctatgagagattcgggttccgcaacgagcctgctcttgtttttccgggttgtgcgccgcaatatttcatggctttacccttgtcgggagggctggtttccggcaccgtcacttatcatcccgccttcggagcggactga

SEQ ID NO: 56551 - protein, 165 aa, Sinorhizobium meliloti 1021
MIIRPETAGDAEAIRQITEAAFAGQPYSDQTEARIIDRLRSEDAMTLSLVAEEEGEVIGHIAFSPVTITPFAVGWYGLGPVSVRPDWQGRGTGSALVRRGLDMLRKAGASGCVLAGNPAFYERFGFRNEPALVFPGCAPQYFMALPLSGGLVSGTVTYHPAFGAD

SEQ ID NO: 56552 - DNA, 591 bp, Sinorhizobium meliloti 1021
  CDS (1)..(591): transl_table=11
atggccgctgttgttgattccttgcgcgcgttcttcgcgccaaccacctttgtgatcgactcggaaaacccgggcgatgtcgttgcgcgcgagaacctgctcgaccgcgccatgggcgcgggtcgccgcaggaaatcgtcggagaagctgcgtcgcggccgcgtgcctgccgagggccttgcccttgtcgcccgggatgccgacggtcacgtcatcggcaccgtgcgcctctggaacgtcgaggccggcgtcaaccgcgagggccagccggtgccggcgctgctgctcggcccgcttgcggtcgatccggcgcatgagggcaaaggtatcggcggcatgctgatgcgcgcggcggtccaggaagccaagaaccgcggccatggcgccgtcctgctcgtcggcgacgccgcctattacgaacgtttcggcttcttctcgcagcgcgcgcagcatctcgtcatgcccggtcctttcgagcgcaatcgcttcctggcgctcgagctcaaggaaggctggctcgacggtgctgccgggatgctggtcgccagcggccggaaactcgctttgccgccgcttcgccgcgccgcctga

SEQ ID NO: 56553 - protein, 196 aa, Sinorhizobium meliloti 1021
MAAVVDSLRAFFAPTTFVIDSENPGDVVARENLLDRAMGAGRRRKSSEKLRRGRVPAEGLALVARDADGHVIGTVRLWNVEAGVNREGQPVPALLLGPLAVDPAHEGKGIGGMLMRAAVQEAKNRGHGAVLLVGDAAYYERFGFFSQRAQHLVMPGPFERNRFLALELKEGWLDGAAGMLVASGRKLALPPLRRAA

SEQ ID NO: 56554 - DNA, 504 bp, Salmonella typhimurium LT2
  CDS (1)..(504): transl_table=11
atgctaattcgagtagaaattcctattgatgcgcctggtattgatgcgctgttacgccgttcattcgaaagcgatgcggaagcgaagctggttcacgatttgcgtgaagatggttttctgacgctcggactggtggccacggatgatgaaggtcaggtggtgggctatgtcgcctttagcccggttgatgtgcagggcgaagatttacagtgggtcggcatggcgccgctggcggtcgatgaaaagtatcgcgggcaagggctggcgcgccagttagtgtatgaagggctggattcgctcaacgagttcggctacgcggcggtcgtgacgctgggcgatccggcgttatatagccgcttcggttttgaactggccgcacattacgatcttcactgccgttggcccggtacggaaagcgctttccaggtacaccgtttggctgaggatgcgctggagggcgtgacggggctggtggagtatcacgaccacttcaatcgtttttaa

SEQ ID NO: 56555 - protein, 167 aa, Salmonella typhimurium LT2
MLIRVEIPIDAPGIDALLRRSFESDAEAKLVHDLREDGFLTLGLVATDDEGQVVGYVAFSPVDVQGEDLQWVGMAPLAVDEKYRGQGLARQLVYEGLDSLNEFGYAAVVTLGDPALYSRFGFELAAHYDLHCRWPGTESAFQVHRLAEDALEGVTGLVEYHDHFNRF

SEQ ID NO: 56556 - DNA, 519 bp, Listeria innocua Clip11262
  CDS (1)..(519): transl_table=11
atgattattcgaaaagaacaaccacaagattacgaggccattcgtcgtgtaaatgaggaagcttttaaaggtactgtggaagcagacttaattcaaaatatccggaaatccgattattatcagccaggtttgtcacttgtagcagaaacggaagatgggcttattgtaggctatattatgtttagtgaaatttcactggagacagctgggcgcagcagatttattttaggtcttgccccgcttgccgttttgccagaataccaggggaaacgggttggttcaagcttaatggaggaagggatccgcttatcacgcgaaaaagcatatcccgctattgctgtgttaggacatgctgattattatccgcgatttggatttattccttccaatcaatttgcgattccagcaccatttgatgtgccatctgaatactttatgctacttgaactgtatgatggaagtttagaaaatctagcagggacaattcattacccagctgcattttctgaagataattaa

SEQ ID NO: 56557 - protein, 172 aa, Listeria innocua Clip11262
MIIRKEQPQDYEAIRRVNEEAFKGTVEADLIQNIRKSDYYQPGLSLVAETEDGLIVGYIMFSEISLETAGRSRFILGLAPLAVLPEYQGKRVGSSLMEEGIRLSREKAYPAIAVLGHADYYPRFGFIPSNQFAIPAPFDVPSEYFMLLELYDGSLENLAGTIHYPAAFSEDN

SEQ ID NO: 56558 - DNA, 522 bp, Nostoc sp. PCC 7120
  CDS (1)..(522): transl_table=11
atggatgttaacatgatgaatatacgctgtgaaactgacgcagattatttagctatttccgaagtaaacaacttatcttttggtcaagagaatgaaacacaattaattgatgaaattcgtatttccgagttttatattccagaattatcattaatttacgaaattaatcatatcgtggtctggcatattctttttagctatattgagttagtaggagaagagaacctacaagtgctggggttagcacctatggctgttcatcctgaatttcaaagaaaaggaattggcagcgctctagtcaaaacaggtttagaaaaagcagatgcaagaggagaaagtttagttattgtattagggtatcctcagttttattctcgttttggttttatcccttctgttaactgtaaaattgagagtccttttccagtaccagacgatgtatttatggtcaaaacactacaaagttatcaagaaaaatatcaaggaaaagttatttatccgccggctttttccaaagtttaa

SEQ ID NO: 56559 - protein, 173 aa, Nostoc sp. PCC 7120
MDVNMMNIRCETDADYLAISEVNNLSFGQENETQLIDEIRISEFYIPELSLIYEINHIVVWHILFSYIELVGEENLQVLGLAPMAVHPEFQRKGIGSALVKTGLEKADARGESLVIVLGYPQFYSRFGFIPSVNCKIESPFPVPDDVFMVKTLQSYQEKYQGKVIYPPAFSKV

SEQ ID NO: 56560 - DNA, 591 bp, Agrobacterium tumefaciens str. C58
  CDS (1)..(591): transl_table=11
ttgtgtgacgggaggccaaggatggccgctcttttgaattcggtacgggcattttttacaccgcagacatttcatgtcgatcaggaaaatccgggcgatgtcgtcgcccgtgagaaccttctcgaccgcgccatgggcgctggccgccgccgcaagtcttctgaaaagctgcgcgccggccgcgttccggccgaaggcctggcgcttgttgctcgggatgaggatggccatgtcattgccacggtgcgcctttggaatgtcgaagccggtatttcacgcgaaggccgtcctgtcgaggcgttgttgcttggcccgttggccgtcgatgccgcccatgagggcaagggcatcggctccgcactgatgcgtgcggcaatcggtgaagccaccaagcgcggccatggcgccatcctcctggtcggcgacgcgccctattacgagcgcttcggctttttcgccgacaaggcccagcacctcatcatgcccggcccgttcgagcgcaaccgttttctggcgctggagctgaaagctggctggctcgaaggtgccgccggtcttctggtggcaaacggccgccggctctcggcctga

SEQ ID NO: 56561 - protein, 196 aa, Agrobacterium tumefaciens str. C58
MCDGRPRMAALLNSVRAFFTPQTFHVDQENPGDVVARENLLDRAMGAGRRRKSSEKLRAGRVPAEGLALVARDEDGHVIATVRLWNVEAGISREGRPVEALLLGPLAVDAAHEGKGIGSALMRAAIGEATKRGHGAILLVGDAPYYERFGFFADKAQHLIMPGPFERNRFLALELKAGWLEGAAGLLVANGRRLSA

SEQ ID NO: 56562 - DNA, 510 bp, Brucella melitensis 16M
  CDS (1)..(510): transl_table=11
gtgaagggaggcagaatgcatatccgcaaggaaaggccacaagacgccgccgaaatccgtcaggtgacagaggcggcttttcgccctgttgcttatagcaaccagaaggaaggggagattgtcgatgcgcttcgcgcggcaaaggcgcttaccctgtcgctggttgcggaggaagacgggcaggttctgggccatatcgccttttcgccggtcctgatcggcggtgcggaaaagggttggtacgggcttggtcccgtttcagtgctgcccgcccggcaaggtgaggggattggcggcaagctgatccgcgagggccttgcgcaattgcgcggtgccggggcaaggggctgtgttcttcttggcgacctcggctattacggacgctttggtttcaaggccgatgcgcggcagaaactgccgggggtgccgcccgaatatttccagtgtctggccttcggtccggatatgccgcaaggcgatgttgcctatcatgcggcattcgatgcatga

SEQ ID NO: 56563 - protein, 169 aa, Brucella melitensis 16M
MKGGRMHIRKERPQDAAEIRQVTEAAFRPVAYSNQKEGEIVDALRAAKALTLSLVAEEDGQVLGHIAFSPVLIGGAEKGWYGLGPVSVLPARQGEGIGGKLIREGLAQLRGAGARGCVLLGDLGYYGRFGFKADARQKLPGVPPEYFQCLAFGPDMPQGDVAYHAAFDA

SEQ ID NO: 56564 - DNA, 543 bp, Clostridium perfringens str. 13
  CDS (1)..(543): transl_table=11
atgaaagtaattgttagaaaagagttagaacaagatcataaaacagtagaacttttagtagaagaagcctttaaagatgctgagtacagtgatcatatggaacatgttttagttagtaaacttagaaagggagaaaactttattgatggcttatctttagttgctgaaagagaaggggaaatagtaggacacatattattaactaaagctaatatagaaaatgaaacagaaaaatatgaaactttagccttagcaccagtttcagtattacctaaatatcaaggtattggaattggaggagaacttataagagaaggaatgagaatggctaaggaacttggatatgattcaataatagttttaggacatgataaatactatcctaaatttggatttaaaaaagctggagattttggaataaaagctccttttgaagtgccagaagaaaactttatggcaatagaattaaatgaagaagctttaaaaaatataagtggtgttgtaagatatgctaatgaatttttagcagataataataagtaa

SEQ ID NO: 56565 - protein, 180 aa, Clostridium perfringens str. 13
MKVIVRKELEQDHKTVELLVEEAFKDAEYSDHMEHVLVSKLRKGENFIDGLSLVAEREGEIVGHILLTKANIENETEKYETLALAPVSVLPKYQGIGIGGELIREGMRMAKELGYDSIIVLGHDKYYPKFGFKKAGDFGIKAPFEVPEENFMAIELNEEALKNISGVVRYANEFLADNNK

SEQ ID NO: 56566 - DNA, 507 bp, Corynebacterium glutamicum ATCC 13032
  CDS (1)..(507): transl_table=11
atgagcgcattccacatccgagcggaacaatcgcgcgatatcagcgcgattcatgatgttactgaagcggcctttacaggaattgagcattcagatggaacagagcaagatctcgtcgataagcttcgtgctgcaaaggcgctgagcctttcgctcgtcgctgaggcggatggcgaggtcattgggcatatcgcagcctctgaggtactgatcggcggtggggtgcagggctggtttggcattgggcctgtcagtgttcggcccgataagcagcagcaaggcgtgggtattgcgctgatgggcagcgcgcttgatcagttgcgtgcggagggtgctggcggcatcgtgttgctgggggatccgggctattatcgacgcttcggttttgaggtcgtgcccgggctggtctatccggacgcgccagcggaattttttatggctgtgtgtttgaatgctccggcgtttccgcagggtgttgtggagtatcactcggcatttggagggtag

SEQ ID NO: 56567 - protein, 168 aa, Corynebacterium glutamicum ATCC 13032
MSAFHIRAEQSRDISAIHDVTEAAFTGIEHSDGTEQDLVDKLRAAKALSLSLVAEADGEVIGHIAASEVLIGGGVQGWFGIGPVSVRPDKQQQGVGIALMGSALDQLRAEGAGGIVLLGDPGYYRRFGFEVVPGLVYPDAPAEFFMAVCLNAPAFPQGVVEYHSAFGG

SEQ ID NO: 56568 - DNA, 654 bp, Methanosarcina acetivorans C2A
  CDS (1)..(654): transl_table=11
ttgcagaaacggatttctctgagaagggaggagaaaacgacaatgaacatttctatcagattggaagaagaaaaggacttcaaaaatgtagaatacatgacaagagaagcattctgggatttatacaaaccgggatgtgatgaacatcttgtattgcataaaataagaaaggtacctgcatttgtaaaagaattggattttgttgcatgtgatgaggatacaatcgtcggcaacattatctattcaagagctaaggtcatagattcggaaaataaggagttcgaagttttatgtatgggcccatttgcagtattgccatcatctcaaaagcaggggataggttctttattaatgaatcattctatcgaaaaggcaaggcagctgggatataagggtattattatttttggaaatcccgactactatcatcgttttggttttgtcagtgccaaagagtataatatttggacgtcctggggcgataattttgacgcatttatggcattggaactctacgacggtagcttgaagggtgtttcaggaaaattttatgaggacgaagtttttaagatagaaaatgaggagctggaggattttgaaaagcaatttccctacaaagaaaagcatattacggacactcaattaaaactataa

SEQ ID NO: 56569 - protein, 217 aa, Methanosarcina acetivorans C2A
MQKRISLRREEKTTMNISIRLEEEKDFKNVEYMTREAFWDLYKPGCDEHLVLHKIRKVPAFVKELDFVACDEDTIVGNIIYSRAKVIDSENKEFEVLCMGPFAVLPSSQKQGIGSLLMNHSIEKARQLGYKGIIIFGNPDYYHRFGFVSAKEYNIWTSWGDNFDAFMALELYDGSLKGVSGKFYEDEVFKIENEELEDFEKQFPYKEKHITDTQLKL

SEQ ID NO: 56570 - DNA, 522 bp, Streptomyces coelicolor A3(2)
  CDS (1)..(522)
atgtcctcttcccgttcttcctggaacacccgcgccgagaccggcgccgacgtccccgtcatccgtgacatcgtccgggccgccttccccacaccggaggaagccgccctcgtcgacgcgctgcgcgccgacgccggggcgtggatcgagggtctgtccctcgtcgcggtggacgactccgaccggcccgtggggcacgccctgctgacccgctgccacatcggggacagcccggcactgtgcctggcgcccgtcgcggtccggcccgagcaccagaacagcggcgccggcgcggccgcggtccgggccgcgctcgcggctgccgggcgcctcggcgagcaccacgtcgtcgtcctcggacacccggagtactacccccgcttcggcttcggcagggcctccgcccacggcatccggctgagcatcgacgtcccggacgaggccctgatggtcctcaccctggacgccgcccacccgctgcccgccgggaccgtccggtacgccgcgccgttcggtatctga

SEQ ID NO: 56571 - protein, 173 aa, Streptomyces coelicolor A3(2)
MSSSRSSWNTRAETGADVPVIRDIVRAAFPTPEEAALVDALRADAGAWIEGLSLVAVDDSDRPVGHALLTRCHIGDSPALCLAPVAVRPEHQNSGAGAAAVRAALAAAGRLGEHHVVVLGHPEYYPRFGFGRASAHGIRLSIDVPDEALMVLTLDAAHPLPAGTVRYAAPFGI

SEQ ID NO: 56572 - DNA, 654 bp, Methanosarcina mazei Go1
  CDS (1)..(654): transl_table=11
ttgaagaggcggctttattttagaagcgaggagaaaacgataatgaacatttctatcagagtagaagaagaaaaggacttcaaaattgtagaatacacgacaagagaagcattctgggatttatacaaaccaggatgtgatgaacatcttgtactgcataaaataagaaaagtacctgcatttgtaaaagaactggattttgttgcatgtgatgaggatacaatcgtcggcaatattatttattcaagagctaaggtcctgaatgaggaaaataaagaattcgaagttttatgtatgggcccattaacagtattgccatcatatcaaaagcaggggatcggttctttattaatgaattattctatcgaaaaagcaagacagctggcatataagggtgtaattatttttggaaatcctgattattatcatcgttttggttttgtcaatgctagagaatatgatatccggacatcctggggcgataattttgatgcatttatggcattggaactttacgatggtagcttgaggggcatttcaggaaaattttatgaggacgaggtttttaaaatagaaaatgaggagctggaggattttgaaaagcaatttccctacaaagagaagcatgttacggacactcaattaaaactatga

SEQ ID NO: 56573 - protein, 217 aa, Methanosarcina mazei Go1
MKRRLYFRSEEKTIMNISIRVEEEKDFKIVEYTTREAFWDLYKPGCDEHLVLHKIRKVPAFVKELDFVACDEDTIVGNIIYSRAKVLNEENKEFEVLCMGPLTVLPSYQKQGIGSLLMNYSIEKARQLAYKGVIIFGNPDYYHRFGFVNAREYDIRTSWGDNFDAFMALELYDGSLRGISGKFYEDEVFKIENEELEDFEKQFPYKEKHVTDTQLKL

SEQ ID NO: 56574 - DNA, 507 bp, Xanthomonas campestris pv. campestris str. ATCC 33913
  CDS (1)..(507): transl_table=11
atgagtgtgctgatccgcgaggcgagcgacggcgacgccgctgccatcgaggtgctgacgatggtggccttcatgcgcgccgagcatagccggcatgacgagcagcatgtgattgccgcgctgcgtaacgacgatgcgctggcgctgtcgttggtcgccgatcacgacggctatgtggtcggccatctggcggtgtcgccggtggctttgtccgacggttcttccggctggttcgcactcggaccgctggcagtgggcccaggccatcaacgtcaggggctcggcacgcgcttggtgcaggcggccctggccaccttgcgcgagcgcggtgcggccgggtgcgtggcccacggcgaacccggctttttccggcggttgggatttgcggtggagccggggttgagcgtgcccgacgtgcccgcatcggaattgcaggcgctggccttcggcgaccggctgctgccgctggccgatgtggcctatcacccggccttcggactgggctga

SEQ ID NO: 56575 - protein, 168 aa, Xanthomonas campestris pv. campestris str. ATCC 33913
MSVLIREASDGDAAAIEVLTMVAFMRAEHSRHDEQHVIAALRNDDALALSLVADHDGYVVGHLAVSPVALSDGSSGWFALGPLAVGPGHQRQGLGTRLVQAALATLRERGAAGCVAHGEPGFFRRLGFAVEPGLSVPDVPASELQALAFGDRLLPLADVAYHPAFGLG

SEQ ID NO: 56576 - DNA, 507 bp, Xanthomonas axonopodis pv. citri str. 306
  CDS (1)..(507): transl_table=11
atgaacgtgttgatccgcgaagccaccgaaggcgacgccgccgccatcgaactgctgaccatggtggccttcatgcgcgccgaacgcagccggcatgacgagcaccaggtgattgcaggattgcgtcaggacggcgcactggcgttgtcgttggtggccgaccacgacggctatgtggtcgggcatctggccgtctcgccggtggcgctgtccgacgattcgcccggctggttcgcgcttggcccgctggccgtggggcccggccaccaacggcaagggctgggcgcgcggttggtgcaggcagcgctcgccacgttgcgcgagcgcggcgccgcaggctgcctggcgctgggcgagccggcgtttttccggcgcctgggtttcgcggtcgaacctggcttggtgttgcccgaggtgcctgcatcggaactgcaagccctggcattcggcgaccggctgctgccgctggccgatgtgtcttaccacccggcgttcgggctgggttga

SEQ ID NO: 56577 - protein, 168 aa, Xanthomonas axonopodis pv. citri str. 306
MNVLIREATEGDAAAIELLTMVAFMRAERSRHDEHQVIAGLRQDGALALSLVADHDGYVVGHLAVSPVALSDDSPGWFALGPLAVGPGHQRQGLGARLVQAALATLRERGAAGCLALGEPAFFRRLGFAVEPGLVLPEVPASELQALAFGDRLLPLADVSYHPAFGLG

SEQ ID NO: 56578 - DNA, 531 bp, Staphylococcus aureus subsp. aureus MW2
  CDS (1)..(531): transl_table=11
atgcaaattagacaaatacatcaacatgactttgctcaagttgaccagttaattagaacggcatttgaaaatagtgaacatggttatggtaatgaatcagaactagtagaccaaattcgtctaagtgatacgtatgacaataacttagaattagtagctgttcttcaaaatgaagttgtagggcacggtttactaagtgaagtttatcttgataacgaggcacaacgggaaattggattagtgttagcacctgtatctgttgatattcatcatcaaaataaaggtattgggaagcgattgattcaagcattagaacgagaagcaatattaaaaggatataattttatcagtgtattaggatggccgacgtattatgccaatctaggatatcaacgcgcaagtatgtacgacatttatccaccatatgatggtataccagacgaagcgtttttaattaaagaattaaaagtgaacagtttagcgggaaaaacaggtaccataaattacacatctgcttttgaaaaaatatga

SEQ ID NO: 56579 - protein, 176 aa, Staphylococcus aureus subsp. aureus MW2
MQIRQIHQHDFAQVDQLIRTAFENSEHGYGNESELVDQIRLSDTYDNNLELVAVLQNEVVGHGLLSEVYLDNEAQREIGLVLAPVSVDIHHQNKGIGKRLIQALEREAILKGYNFISVLGWPTYYANLGYQRASMYDIYPPYDGIPDEAFLIKELKVNSLAGKTGTINYTSAFEKI

SEQ ID NO: 56580 - DNA, 525 bp, Bacillus anthracis str. A2012
  CDS (1)..(525): n means a or g or c or t/u, s means g or c
gtgataacgattagacaagaacaaaaaaatgattatagaaaaacagaagaagttgtaaaagaagcatttttgcatgaagagtttagtgataaaaaagaacatgaacttgtaaaacgtattagagaatgtgacgcgtttgttccggagttatcaattgttgcggtagatgaggcaatagtcggtcacattatgttatcgaaaattaagatagaacaggatggaacttctgaagaatcattagcacttgcaccagtttcagttgctaggggccatcagaagaaagggattggtggaaagcttattgtagctgctttagaaaaagcgaaagaacttggatacggatcagttgtagtattaggacatccagagtactatccgaaatttggttttaaaaaagcaattgagtggaatataaaagcaccatttgaagtgcctgaagaagtgtttatggtaatagaattaacagaaaatgmtcttgaaagtgtagaaggagttgtacaatattcgagtgcttttgctgagtag

SEQ ID NO: 56581 - protein, 174 aa, Bacillus anthracis str. A2012
  Xaa in position 158 is unknown
MITIRQEQKNDYRKTEEVVKEAFLHEEFSDKKEHELVKRIRECDAFVPELSIVAVDEAIVGHIMLSKIKIEQDGTSEESLALAPVSVARGHQKKGIGGKLIVAALEKAKELGYGSVVVLGHPEYYPKFGFKKAIEWNIKAPFEVPEEVFMVIELTENXLESVEGVVQYSSAFAE

SEQ ID NO: 56582 - DNA, 486 bp, Chlorobium tepidum TLS
  CDS (1)..(486): transl_table=11
ttggtaaactcccggccccggcctgcgggtcttgccggacaaacgggagatattggtatattaaaggacaaaccgttcatcatcgaggcgctgcgagccgccggagcgctgacgatctctctcgtggcggcgttgggcggacgggtggtcggtcatatcgccttctcgccggtgaccatgtctgacgggtcgtttggggggttcggactcgggttgctgtcggtgctgccggagtttcagcggcagggcatcggtggtgtactgatccgggacggcctcgcctggctaaaagcgctcggggcgatcggctgctgcctggttggccatccggagtactaccgccaattcggcttcgagaatccggatgggctggggcacgaaggcgtaccgctggagttttttttcgtgctctctttcggcggtcaggtcccacagggcagcgcaaggttccacgacgcattcatggccagcggccctgcgtcataa

SEQ ID NO: 56583 - protein, 161 aa, Chlorobium tepidum TLS
MVNSRPRPAGLAGQTGDIGILKDKPFIIEALRAAGALTISLVAALGGRVVGHIAFSPVTMSDGSFGGFGLGLLSVLPEFQRQGIGGVLIRDGLAWLKALGAIGCCLVGHPEYYRQFGFENPDGLGHEGVPLEFFFVLSFGGQVPQGSARFHDAFMASGPAS

SEQ ID NO: 56584 - DNA, 507 bp, Yersinia pestis KIM
  CDS (1)..(507): transl_table=11
gtgttgatccgggttgaaattccggttgatgcgccggggatcgatgctttactgcgtcgggcatttcagcagggtgatgaggcggagctggtacaacaactgcgcgaagatggcttgctgacgcttgggatcgtggcgacggacgatgaaggggtcgttatcggttatgcggcgttcagcccggttgaggttggcggtgaagatcgccaatgggtcgcattggcaccactggccgtggaagagggcttgcgtcggcagggcttgggtgaaaagttggtgtatgagggccttgatgccctgaatgagttcggttatgccgctgtggtagtgctaggtgcgccagcttattattactcacgttttggttttgtaccggcagcccgccatcaactaacctgccgttggcccggtagcgaagaggctttccaggtatatgcactggcagaagacacgctggttaataccaaaggcgaagtggtgttctctgccccattcaatcgcttttag

SEQ ID NO: 56585 - protein, 168 aa, Yersinia pestis KIM
MLIRVEIPVDAPGIDALLRRAFQQGDEAELVQQLREDGLLTLGIVATDDEGVVIGYAAFSPVEVGGEDRQWVALAPLAVEEGLRRQGLGEKLVYEGLDALNEFGYAAVVVLGAPAYYYSRFGFVPAARHQLTCRWPGSEEAFQVYALAEDTLVNTKGEVVFSAPFNRF

SEQ ID NO: 56586 - DNA, 534 bp, Oceanobacillus iheyensis HTE831
  CDS (1)..(534): transl_table=11
atggatatcttaattagagaagaacgaactgaagaatataacacaacggaaaaggttgttaaaagggtatttttaaaggaagaatttagcgataagaaagagcatttacttgttaatcggattagaaaatcggatgcgtttattcctgaactttcattgatcgcaatagatcaagccaatgaaattattggtcacattctattatcaaaaattacaatcgtaaatgatcataaaactgttgattctttagctcttgccccggtatctgttataccggagcatcagaaaaaaggaattggaagtcaattaattcatgctgcattaaaaaaagcaaaagaaattggttatcattcagttattgtattaggtcataaagactattatccaaagtttggttttaaacaggcacgcttctggaatatacaagctccatttgatgtacctgatgaagtatttatggccctagaattaacggaggatgctcttgaaaatgtggaaggtgtcgttcattactccaacgccttttcaggatga

SEQ ID NO: 56587 - protein, 177 aa, Oceanobacillus iheyensis HTE831
MDILIREERTEEYNTTEKVVKRVFLKEEFSDKKEHLLVNRIRKSDAFIPELSLIAIDQANEIIGHILLSKITIVNDHKTVDSLALAPVSVIPEHQKKGIGSQLIHAALKKAKEIGYHSVIVLGHKDYYPKFGFKQARFWNIQAPFDVPDEVFMALELTEDALENVEGVVHYSNAFSG

SEQ ID NO: 56588 - DNA, 588 bp, Bradyrhizobium japonicum USDA 110
  CDS (1)..(588)
atgactgcttttcggaagccacaagtcgccctcacttcgaaagccgctccgttcgcgatccgtgcggagcgtgctgccgacgtcgccgcccgtgaagcgctgctcgatgccagctttggcgagaaccgccatggccgcacctgccagcgcctgcgcgacggacgtgcacctgcctcaggccttgccctgtcggctgtgcgcgaggggacactcgtgggaaccgtgcggctgtggcacgtcagcgccggaggcaggcccgctctggtcctcggaccgctggcggtggaccctgcctgccgcgagctcgggatcggcgccgcgctgatgcaacaagcgctggccgccgcccgggcgcgcgggcatgccgccgtgatcctgcttggcgatgccccctactatgcgcgtttcggcttctcggccgagaggaccggcgcactgatgctgcccggcccgttcgagcgagaccgcctgctggcgatcgaattccaggccggtgcgctggatggcgccgaggggatgatcgtcccgaccggcgcggccctggccaaacggagggtggttcgccccctccaggcgcacgcggcctaa

SEQ ID NO: 56589 - protein, 195 aa, Bradyrhizobium japonicum USDA 110
MTAFRKPQVALTSKAAPFAIRAERAADVAAREALLDASFGENRHGRTCQRLRDGRAPASGLALSAVREGTLVGTVRLWHVSAGGRPALVLGPLAVDPACRELGIGAALMQQALAAARARGHAAVILLGDAPYYARFGFSAERTGALMLPGPFERDRLLAIEFQAGALDGAEGMIVPTGAALAKRRVVRPLQAHAA

SEQ ID NO: 56590 - DNA, 504 bp, Vibrio parahaemolyticus RIMD 2210633
  CDS (1)..(504): transl_table=11
atgcttattcgaactgaagcccctgcggacattctgaccattgaccgcctattgaaacatgcgtttccaaccgatgcagaagccaacttggtgatgcgtttacgtgaaaacggcaagctgaccttgtcgctggtggcgtgtacggatgaaggtgaggtaattggccatgctttatttagcccagttacattaaatggtgaagatttgtcgtggcaagggcttgcaccattggctgttcatgaggactatcgccgtcaaggcattggagctgaactcattaaagaaggtttcgaatctctgcgtgatttcggttatccagtctgtgtcgtgttgggtgaacctaactactatgcacgacaaggtttcaatgctggtgaagagatgggctttgaatgcgcttgggaagtgcctgaaggtgcgtttcgagtagctgaactcgtcgaaggccaatgtacaggacgttctggacgcattgattacgcgccagagttctcagagctttaa

SEQ ID NO: 56591 - protein, 167 aa, Vibrio parahaemolyticus RIMD 2210633
MLIRTEAPADILTIDRLLKHAFPTDAEANLVMRLRENGKLTLSLVACTDEGEVIGHALFSPVTLNGEDLSWQGLAPLAVHEDYRRQGIGAELIKEGFESLRDFGYPVCVVLGEPNYYARQGFNAGEEMGFECAWEVPEGAFRVAELVEGQCTGRSGRIDYAPEFSEL

SEQ ID NO: 56592 - DNA, 525 bp, Bacillus cereus ATCC 14579
  CDS (1)..(525): transl_table=11
atggtaacgattagacaagaacaaaaaaatgattatagaaaaacagaagaagtcataaaagaagcatttttaaaggaagaatttagtgataaaacagaacatgaacttgtaaaacgtattagagaatgtgacgcgtttgttccagagttatcaattgttgcggtagatgaagatatagttggtcacattatgttatcgaaaattacaatagaacaagatggaacttctgtagaatcgttagcacttgcaccagtttcagttgctaggggtcatcagaaaaaaggaattggtggaaaactgattgtagctgcattagaaaaagcgaaagaacttggatacggatcagttgtagtattgggacatccagagtactacccgaaatttggttttaagaaagcaagtgagtggaatataaaagcaccgtttgaagtgcctgaagaggtatttatgataatggaattaacagaaaatgctcttcgaggtgtaaaaggaattgtacaatattcgagtgcttttgctgagtag

SEQ ID NO: 56593 - protein, 174 aa, Bacillus cereus ATCC 14579
MVTIRQEQKNDYRKTEEVIKEAFLKEEFSDKTEHELVKRIRECDAFVPELSIVAVDEDIVGHIMLSKITIEQDGTSVESLALAPVSVARGHQKKGIGGKLIVAALEKAKELGYGSVVVLGHPEYYPKFGFKKASEWNIKAPFEVPEEVFMIMELTENALRGVKGIVQYSSAFAE

SEQ ID NO: 56594 - DNA, 591 bp, Rhodopirellula baltica SH 1
  CDS (1)..(591): transl_table=11
ttgcattctcgtgttgttggcacttcaatgaagatccaagcgacaggcaggattcgagtagccacggaacaggatcgcgatgcaattcctgcggtacacatgaacgcctttggcgaggacgaaggtccggtgatcgtcaagctggtcgatgagatgctcgatgacgcttccggcaaaccaatgctttcactcgtcgccgacacagatgacgggttgattggccaccttcttttcacgtctgtgagaatcgagccggacgatagcacggtcagtgcaaggattcttgcgccgctggccgttgttcagaatcgacaacgccagggaattggcggacgtttgattcaagcggggttaagtcagttggccgactctggtgtcgacctcgtctttgtcctcggctatcccgactactattttcgtttcgggttcaagcccgctggtattcaaggtcttcaagcaacctatccgatcccaccacaaaacgcagatgcttggatggtggcggaactgacgcccggaacgattgagaattgcgagggaactatccgttgctcgaaagctttggaccatccgaagtactggatcgagtga

SEQ ID NO: 56595 - protein, 196 aa, Rhodopirellula baltica SH 1
MHSRVVGTSMKIQATGRIRVATEQDRDAIPAVHMNAFGEDEGPVIVKLVDEMLDDASGKPMLSLVADTDDGLIGHLLFTSVRIEPDDSTVSARILAPLAVVQNRQRQGIGGRLIQAGLSQLADSGVDLVFVLGYPDYYFRFGFKPAGIQGLQATYPIPPQNADAWMVAELTPGTIENCEGTIRCSKALDHPKYWIE

SEQ ID NO: 56596 - DNA, 501 bp, Bordetella pertussis Tohama I
  CDS (1)..(501): transl_table=11
atgctgatccgttccgaaacccccgccgaccagcgcgccatcttcgacgtgacgcaggcggcgtttcgcggccatccgcacagcgagcagaccgaggcgtacatcgtccaggcgctgcgcgccgccggcgcgttgacgctgtcgctggtggccgagctcgacgcccgggtggtcggccatgccgcgttctcgccggtgcagatttccgacggcagcccgtcgtggttcggcctgggaccggtgtcggtcgatccggcccaccagggccgcggtatcggcaccgccctgatcgaacacggcctggcgcggctgcaggcgcgcggcgcggccggttgcgtcctggtgggcgagccggcttactatgggcgtttcggctttcggcccgaacccgggctggtgctgccggacatgccgccgacgcatttcctggcgctgaccttcggcgcgcccgcgcgcggcaccgtcacctaccatccgggattcgcggcgcgcgacgcataa

SEQ ID NO: 56597 - protein, 166 aa, Bordetella pertussis Tohama I
MLIRSETPADQRAIFDVTQAAFRGHPHSEQTEAYIVQALRAAGALTLSLVAELDARVVGHAAFSPVQISDGSPSWFGLGPVSVDPAHQGRGIGTALIEHGLARLQARGAAGCVLVGEPAYYGRFGFRPEPGLVLPDMPPTHFLALTFGAPARGTVTYHPGFAARDA

SEQ ID NO: 56598 - DNA, 510 bp, Gloeobacter violaceus PCC 7421
  CDS (1)..(510): transl_table=11
atggaagttcgagccgaaaagccagaagatgtagaagctgttcgcagactcaatgttgcggcatttgggcgagagagtgaggcaaacttagtcgatcagttgcgaggcgttgcgtctacattttccttcgttgctgttgaatccgagcaaattgttggacacattttctttagtccagttgcgatcgcaggagaatgtgctgctaatttacttgttcttggattggcgccagtggcagtgcttcctgactatcagcgaaaaggaatcgggtcattgctgattcagcatggtttagcagagtgcgctcggttcggtttcaaagctgttgttgtgctgggttctccagcatactatctgcgattcgagtttactccagctaaggagaagggattggggtgtgagtacgcagtgccggatgagacatttatggtgttggagttggaaagtggtgcattggagggctgtgttggaataataaagtatcattcagagtttaatgaacttgcgtag

SEQ ID NO: 56599 - protein, 169 aa, Gloeobacter violaceus PCC 7421
MEVRAEKPEDVEAVRRLNVAAFGRESEANLVDQLRGVASTFSFVAVESEQIVGHIFFSPVAIAGECAANLLVLGLAPVAVLPDYQRKGIGSLLIQHGLAECARFGFKAVVVLGSPAYYLRFEFTPAKEKGLGCEYAVPDETFMVLELESGALEGCVGIIKYHSEFNELA

SEQ ID NO: 56600 - DNA, 504 bp, Photorhabdus luminescens subsp. laumondii TTO1
  CDS (1)..(504): transl_table=11
atgttgatcagagtagaaattccagtagatgcagcgggaatagatcaattattacggaaatcttttgataccccggcagaagcggaattggtccaacaattgcgggaagatggattattgacgttaggtgtggttgctacagatgacgaaggccaggtaatcggttatgtggcttttagtccggtggatattaatggtgaagatcaccaatgggttggtttggcaccgttagcggttgctgaagaatatcgtcggcaggggattggtgaaaagctggtgtatgaaggtttggatagcctgaatgaatttggctatggcgtcgtcgttgttttgggtgatccacactactattgccggtttggttttacgcttgccagtgagcatcagttgcattgccagtggtcaacgtgtgaatcttattttcaggtatatgaattagctgatagttccttggctgaccataaggggttggttacttactcctcacactttgaccgtttctaa

SEQ ID NO: 56601 - protein, 167 aa, Photorhabdus luminescens subsp. laumondii TTO1
MLIRVEIPVDAAGIDQLLRKSFDTPAEAELVQQLREDGLLTLGVVATDDEGQVIGYVAFSPVDINGEDHQWVGLAPLAVAEEYRRQGIGEKLVYEGLDSLNEFGYGVVVVLGDPHYYCRFGFTLASEHQLHCQWSTCESYFQVYELADSSLADHKGLVTYSSHFDRF

SEQ ID NO: 56602 - DNA, 534 bp, Synechocystis sp. PCC 6803
  CDS (1)..(534): transl_table=11
atgacaggacaagaaattttgataagggatgagagaaaggacgatgccgttctcattactgaagtgactattgcggccttcgcgcccctagagattagtaaccacacagagcagttcatcatcgaagctcttcgttccgcaggtgctttaaccctgtcattggttgcagaagtgaatagtcgtgttgtgggacatattgcattttcccctgtggccatctcggacggcacaaaaaactggtatggactcggcccggtctccgtgttacccctataccagcgtagggggattggtaaagctcttattcaggaaggactgtcacagttgaagggcttaggagccaagggctgttgccttgtcggacacccagaatactacaaaaaatttggatttaagaatgtggcggggcttgctctcgaaggggttcccgatgaggtattttttgctctttcgtttgacagtcattatccccagggtgatgttaccttccatgaaggattcagagcaaatagctctagcaacgtgaaattatga

SEQ ID NO: 56603 - protein, 177 aa, Synechocystis sp. PCC 6803
MTGQEILIRDERKDDAVLITEVTIAAFAPLEISNHTEQFIIEALRSAGALTLSLVAEVNSRVVGHIAFSPVAISDGTKNWYGLGPVSVLPLYQRRGIGKALIQEGLSQLKGLGAKGCCLVGHPEYYKKFGFKNVAGLALEGVPDEVFFALSFDSHYPQGDVTFHEGFRANSSSNVKL

SEQ ID NO: 56604 - DNA, 522 bp, Geobacter sulfurreducens PCA
  CDS (1)..(522): transl_table=11
atgaagattcagaaaccggccatcgaggcccgtcccaagatctacgcgcttctgcgcagctcctttcccggcagcgagtatgaagccgcgctggtacagaaactccacgaaaacgacaggtccatccacgaatgggcctgcatcatcggcggcaaggtcatcgcctacatcgcctttaccaatgcctaccatggccgcgacgtctgcggcctgcacctggcccccatggccgtggccccggagttccaggggcgcggggtagggctggagctgctcaggttcgccctgcgccaggaggcaatcagcagccggaccctcttcgttctgggtgaacccgcctattacagccggttcggtttcgaaccgtgcagcacgcccatctgtccctttgacaagaacaacgagcattttctgggcatgcgcaacacggccaccgacagtttcgtggtgggctatgagcccgaatttaccaccgccgcgccgaccgccgcgaccaaggggagaaagcgcgggagacggtaa

SEQ ID NO: 56605 - protein, 173 aa, Geobacter sulfurreducens PCA
MKIQKPAIEARPKIYALLRSSFPGSEYEAALVQKLHENDRSIHEWACIIGGKVIAYIAFTNAYHGRDVCGLHLAPMAVAPEFQGRGVGLELLRFALRQEAISSRTLFVLGEPAYYSRFGFEPCSTPICPFDKNNEHFLGMRNTATDSFVVGYEPEFTTAAPTAATKGRKRGRR

SEQ ID NO: 56606 - DNA, 495 bp, Anopheles gambiae str. PEST
  CDS (1)..(495)
atgaacatcatcattcggcccgaaacgggcgccgatcacgatgccattgaggcactgaccatggccgcattcctcaatgcgccccataccgatcacaacgaacagcggatcgtgcgcgacctgcgccaggccggggcgctcagcctgtcgctggtagcggagctggaggggcgggtggtcggccacctctgcttctcgccggtgaccatcagcgatggcagcccgcactggtatggtcttggccctatttcggtctctcctgccctgcacggcaaggggctgggttctcggctgatggaggtgggtctggccgagctcaaggggatgggagcggccggctgcgtggtgctgggggagcccggcttctacggccgtttcggcttcgtgtccgagccggggttggcgctgcccggcgtgccggccgagtacttcatggctcgctcgttcggcgccgccatgccccgtggcgaagtgtgctaccacccggccttttag

SEQ ID NO: 56607 - protein, 164 aa, Anopheles gambiae str. PEST
MNIIIRPETGADHDAIEALTMAAFLNAPHTDHNEQRIVRDLRQAGALSLSLVAELEGRVVGHLCFSPVTISDGSPHWYGLGPISVSPALHGKGLGSRLMEVGLAELKGMGAAGCVVLGEPGFYGRFGFVSEPGLALPGVPAEYFMARSFGAAMPRGEVCYHPAF

SEQ ID NO: 56608 - DNA, 561 bp, Yarrowia lipolytica CLIB99
  CDS (1)..(561)
atgatcttctcttggagcactacaacaacgtcgacagtggacgtcaagatctcacctgagctgccatggcacaaggatgatatctccaacgtgatcaagtctgcgtttgcgaagctcgccatctccaaccaccaggagcaggagattgtgcacgacttgcgagccacgggcgcactcacagcgtcctgggtcgccatcgataacaatacacagcaggtggttggcacgattttcctgagtgaggtcaaggtggacggacaggttcagagccccaagtggtacggcattggacccattgctgtattgcccgacttccagggcaacgggatcggcgccaaactcatgcatacggccattgagcattgccagggccagctcgatgccggtggcgtcgtgttgctgggaaacccggagttctacaagcagtttgaattcgttccccgtcgagacctgtcgctgatgggcgttccctctcagtactttcaggttcgaaagttccgaggagagtggccctctggagaagtcacctatgacgacgccttcatgagacactcgtggtga

SEQ ID NO: 56609 - protein, 186 aa, Yarrowia lipolytica CLIB99
MIFSWSTTTTSTVDVKISPELPWHKDDISNVIKSAFAKLAISNHQEQEIVHDLRATGALTASWVAIDNNTQQVVGTIFLSEVKVDGQVQSPKWYGIGPIAVLPDFQGNGIGAKLMHTAIEHCQGQLDAGGVVLLGNPEFYKQFEFVPRRDLSLMGVPSQYFQVRKFRGEWPSGEVTYDDAFMRHSW

SEQ ID NO: 56610 - DNA, 507 bp, Desulfovibrio vulgaris subsp. vulgaris str. Hildenborough
  CDS (1)..(507): transl_table=11
atggtggcttccatgattgtacgggaggaagtgccggaggacatcggcagcatattcgaggtgaccgccaaggcgtttgcgacgctggacatcagtgacaagcgggaaccatatgtcatcgaagccttgcgtcacgccggggctctttcgttgtcgctggttgccgtgtttgatggccgcgtcatcggccatgtggccttttcgccagtggcggtgtctgacggtacggagggctggtttggccttggccccttgtcggtgcaccctgcgtatccgcgccgaggtgtggggacggcactggtgcgcgaagggcttgcccgcctgcagtcgcttggtgccgcaggatgttgcctcgtggggcaccccacctactacgtccgtttcgggttcatgaatgcgccggggttgaatgtcgaaggcgtcccgccggagtatctcttcgccatgccgttcaaaggtgaagtgcccaagggcgtcgtgacctttcacgaagcgtttgaggtgtag

SEQ ID NO: 56611 - protein, 168 aa, Desulfovibrio vulgaris subsp. vulgaris str. Hildenborough
MVASMIVREEVPEDIGSIFEVTAKAFATLDISDKREPYVIEALRHAGALSLSLVAVFDGRVIGHVAFSPVAVSDGTEGWFGLGPLSVHPAYPRRGVGTALVREGLARLQSLGAAGCCLVGHPTYYVRFGFMNAPGLNVEGVPPEYLFAMPFKGEVPKGVVTFHEAFEV

SEQ ID NO: 56612 - DNA, 543 bp, Erwinia carotovora subsp. atroseptica SCRI1043
  CDS (1)..(543)
atgctagttcgggtggaaattcccgttgatgccgcagggatcgacagcttattgcgtcgttcttttccaacgggtgcagaagccgatctggtgcatcaactgcgtgaagacggcttattgacgcttggcgtcgtggcaaccgacgatgaaggtggtgtggtggggtacgccgcattcagtccggtgttgatcgaaggtgaggatcggcagtgggtagcgcttgcgccgttggcggtagacgaaagtctgcgtcgacaaggcgtgggtgagaagctggtctacgaagggttggatgcgctgaatgaatttagctataccgccgtcgttgtgctgggtgagcctgcgtactattcccgctttggtttcgttccggctacagagcaccagttgcattgtcgctggccggacagcgaatcgacttttcaggtctacccactggcggacaatcaggttgctggtgaagagtcgtctgaaggtgaaagtggatttgaagatgccatcgggctggttgaatatgccgagccgtttaaccgctttctctag

SEQ ID NO: 56613 - protein, 180 aa, Erwinia carotovora subsp. atroseptica SCRI1043
MLVRVEIPVDAAGIDSLLRRSFPTGAEADLVHQLREDGLLTLGVVATDDEGGVVGYAAFSPVLIEGEDRQWVALAPLAVDESLRRQGVGEKLVYEGLDALNEFSYTAVVVLGEPAYYSRFGFVPATEHQLHCRWPDSESTFQVYPLADNQVAGEESSEGESGFEDAIGLVEYAEPFNRFL

SEQ ID NO: 56614 - DNA, 519 bp, Desulfotalea psychrophila LSv54
  CDS (1)..(519): transl_table=11
atgatcattagagaatcgaagagtcgtgaacttgaggcgatttatgcgcttcatatggcagcctttgatgccgatgagcgcgagcttgtggcgaaactggccatagacttgatcaaggcagctcaccccctactctcattggttgcggtgagcgatgatctcgtcattggtcatattctttttagtccagtcagtatttcaaataacgacaatctatcatgctttattctggcgcctctggctgtatcacctgcaaggcaaaggcagggggttggcagtcagttaattgagcatggtttacgaacacttaccgcccagggcgcggatgttgtgttcgtcttgggtgatccagattattatagccgcagtggttttcatccagttcatgatgtaagtccatcgtattcattgccatacccggaggcatggcaggcaaaagagttaagggtaggcgcattgcaaggggtttccgggacggttgaatgtgtttccgttttaatgtcgccggagctttggtag

SEQ ID NO: 56615 - protein, 172 aa, Desulfotalea psychrophila LSv54
MIIRESKSRELEAIYALHMAAFDADERELVAKLAIDLIKAAHPLLSLVAVSDDLVIGHILFSPVSISNNDNLSCFILAPLAVSPARQRQGVGSQLIEHGLRTLTAQGADVVFVLGDPDYYSRSGFHPVHDVSPSYSLPYPEAWQAKELRVGALQGVSGTVECVSVLMSPELW

SEQ ID NO: 56616 - DNA, 504 bp, Photobacterium profundum SS9
  CDS (1)..(504): transl_table=11
atgctcattagaactgaagcacctgcggatattctacccatagatcgattgctgaagacggtgtttgagaccgatgctgaagctgatttagtgatgagattacgtgagaatagtcaccgtacattatctcttgttgcgtgtagtgatgacggcgaggtgattggacatatcctctttagccctgttaccgttgatgatgtggatgataattggcaaggcttagcgccattatcggtaaaacctgaataccaacgacaaggtatcggaaaagcattaatggaagaagcaaaaataatgcttgctgattttggttaccctgttgtcgttgtgcttggtcacagtgaatattatccacaagtgggtttcgagaaagcttctgagcacggtcttggctgtatttgggaagtacctgatgaagcctttatggttttagaagtgatacctgagcatctagccggtaaatctggcgtcgttaaatacagtgaagaattttcagctctgtaa

SEQ ID NO: 56617 - protein, 167 aa, Photobacterium profundum SS9
MLIRTEAPADILPIDRLLKTVFETDAEADLVMRLRENSHRTLSLVACSDDGEVIGHILFSPVTVDDVDDNWQGLAPLSVKPEYQRQGIGKALMEEAKIMLADFGYPVVVVLGHSEYYPQVGFEKASEHGLGCIWEVPDEAFMVLEVIPEHLAGKSGVVKYSEEFSAL

SEQ ID NO: 56618 - DNA, 552 bp, Magnetospirillum magnetotacticum MS-1
  CDS (1)..(552)
atggttcagatccgcgatgagatcgcctcggatggcgcggcccgcgagcgcctgctcgacacgtgcttcggcccgggtcgcttcctgaagacctcgcagcgcctgcgcgagggtcgccttcccgccctcgccctgagcgcggagcaggacggcaccctcgtcggcaccgtgcgcctgtgggatgtggagacggcctgcggccggccggccctgctgctcggcccgctcgcggtcgatccggcgctccaggggcagggcctcggcgcggcgctgatgcgtgcggccatcgcccgtgcggcggagctcggtcacggcgcggtgctgctggtgggggatgcgccctattatgcccgcttcggcttcgcgccggagaaggccgccggcctctacatgcccggcccgttcgagcgggagcgcttcctcggcctggaactcaaggccgacgcgctggcgggcgccgaaggtgtcctgcacgcgaccggggcgttcgaagcggttccggagttcgcggccgaagccgctgcccaggccgcacgacgacaggccgcctga

SEQ ID NO: 56619 - protein, 183 aa, Magnetospirillum magnetotacticum MS-1
MVQIRDEIASDGAARERLLDTCFGPGRFLKTSQRLREGRLPALALSAEQDGTLVGTVRLWDVETACGRPALLLGPLAVDPALQGQGLGAALMRAAIARAAELGHGAVLLVGDAPYYARFGFAPEKAAGLYMPGPFERERFLGLELKADALAGAEGVLHATGAFEAVPEFAAEAAAQAARRQAA

SEQ ID NO: 56620 - DNA, 507 bp, Dechloromonas aromatica RCB
  CDS (1)..(507)
atgaccacaaccatccgccccgaaaaaccttcagacgaagccgccattgagcaagtcactcggcgcgcttttctctcccacccttacagccatcaaaccgagcagttcatcatccgtgcgctgcgtgcagacgatgcgctttctgtctctctcgtggccgaggaggccggccgcatcgtcgggcatattgcgctgtctcctgtcaccatcagcgacggtagtgccggctggtatgggctgggcccgatttcggtcgaaccggaactgcagcgccgtggtatcggccgggcacttatggagagaggaattgtcgaactgcgcaagatcggagctgcggggtgcgtgctcgttggcgacccggcgttctacgtccgtttcggatttgcgaacaatcctgcactcgtgcttgagggggttcctccagagtttttcctctgtctgctccttggcacggcttccgctcatggctccgttcaattccatcaggcgtttcaagccacggcttga

SEQ ID NO: 56621 - protein, 168 aa, Dechloromonas aromatica RCB
MTTTIRPEKPSDEAAIEQVTRRAFLSHPYSHQTEQFIIRALRADDALSVSLVAEEAGRIVGHIALSPVTISDGSAGWYGLGPISVEPELQRRGIGRALMERGIVELRKIGAAGCVLVGDPAFYVRFGFANNPALVLEGVPPEFFLCLLLGTASAHGSVQFHQAFQATA

SEQ ID NO: 56622 - DNA, 507 bp, Anabaena variabilis ATCC 29413
  CDS (1)..(507)
atgaatatacgctgtgaaactgctacagattatttagctatttccgaagttaataatttagcttttggtcaagaaaatgaatcgcagctaattgataaaattcggatttctgagttttatattccagagttatcattaattgccgaagttaaccatactgtagttggtcatattctttttagctatattgagttagcaggagaagaaaaaatacaagtgcttggattagcacctatggctgtgcatcctgaatttcaaagacaaggaattggcagcgccctagtcaaagcgggattagaaaaagcagatgcaagaggagaaagtttagttattgtattagggcatccacagttttattctcgttttggtttcgtgccgtcagttaattataaaattgctagtccttttccagtaccagacgatgtatttatggtcaaaacactacgaagttatcaagataaatatcaaggaaaggttatttatccacctgctttttcccatgtttaa

SEQ ID NO: 56623 - protein, 168 aa, Anabaena variabilis ATCC 29413
MNIRCETATDYLAISEVNNLAFGQENESQLIDKIRISEFYIPELSLIAEVNHTVVGHILFSYIELAGEEKIQVLGLAPMAVHPEFQRQGIGSALVKAGLEKADARGESLVIVLGHPQFYSRFGFVPSVNYKIASPFPVPDDVFMVKTLRSYQDKYQGKVIYPPAFSHV

SEQ ID NO: 56624 - DNA, 504 bp, Exiguobacterium sp. 255-15
  CDS (1)..(504)
atgcagattcgtacagaaatattcaaagacgcggccggaattcggctcgtccatcaagccgcgtttggacagcggacggaagccgatctggtcgaagcgttacgggaagatgaggcgtcgctcccgcattacagccgcgtcgctgtaacggacaagggcgagattgttgggcatgtcttactcagccggatttacatcgaagacattccgtcgctcgcactcgcgccggtcggtgtcaaaccacactggcaacgcaaaggcatcggctcggaactgatccgccaagtgattgaagatgcccgggaagccggcgagtcacatatcgtcgtccttgggcatgacagttattatccgcagttcggattcgagcgggctgtcgattatggcatcgaagcaccattcccggtcccgatggacgtctttctggtcatgccgctcgaacggcaggcgttaaaagggattgccggaacagtccggtactcgaaaccctttagtgcggtataa

SEQ ID NO: 56625 - protein, 167 aa, Exiguobacterium sp. 255-15
MQIRTEIFKDAAGIRLVHQAAFGQRTEADLVEALREDEASLPHYSRVAVTDKGEIVGHVLLSRIYIEDIPSLALAPVGVKPHWQRKGIGSELIRQVIEDAREAGESHIVVLGHDSYYPQFGFERAVDYGIEAPFPVPMDVFLVMPLERQALKGIAGTVRYSKPFSAV

SEQ ID NO: 56626 - DNA, 507 bp, Mesorhizobium sp. BNC1
  CDS (1)..(507)
atgagcgcagtgattatccgtccggaagaagtcggagacgagaccgcgatccgtctcctcctcgtcaacgcctttggcggcgaggctgaagcaaggcttgtggacgaattgcgctcgtcgggcgaggtcgtgctttcgctcgtggccgagcgcgacggggaaatccgcggccatatcctcttctcgcggctgtgggtgcataacgcgggcgagcgttttgcggctgtcgccttggcgcctttggcggtccatcccgggcaccagcacgaaggcatcggaagcggcctggtggaggatgcgcatgcccgtctggaggcgcaaggagagaaactttcgctcgttcacggggagcctgcctattacggccgcttcggctatagccgcgaacgcgcggccggatttgaaaccatctatcagggtgaatatctccaggcgcgtgcgtgggacgatgctgcccctgcagccggacggctcgattatcctcaagccttcgcggatatcggctga

SEQ ID NO: 56627 - protein, 168 aa, Mesorhizobium sp. BNC1
MSAVIIRPEEVGDETAIRLLLVNAFGGEAEARLVDELRSSGEVVLSLVAERDGEIRGHILFSRLWVHNAGERFAAVALAPLAVHPGHQHEGIGSGLVEDAHARLEAQGEKLSLVHGEPAYYGRFGYSRERAAGFETIYQGEYLQARAWDDAAPAAGRLDYPQAFADIG

SEQ ID NO: 56628 - DNA, 594 bp, Burkholderia cepacia R18194
  CDS (1)..(594)
atggatgcgcgtgttccgcaacgcgcgccgctggatcggctgatcgggatgatgttcgacccgaacgcaccggtcgaggtcgtcacgctgcgcgaccagcgcgcaagcgagggcgacgcgatcggtcgcgtgatcgtcgcggcgttcgcgggcgagccggaaggcgggcagttcgaacggcggatcgtcgatacgctgcgtgcggacggtgcgttgagcgtctcgctcgtcgcggagcgcgacggccgcctgatcgggcatgttgcgttctcgccggtgtcgatcggcggcgaactgtccggcagccagggctggtacgggctggccccgctcgcggtgctgcccgactgccagcggcagagcatcggtgcagggttggtgcgcacggggctcgacgcgttgcgccggattggcgcgcgcggctgcgtgctgctcggcgaacccgcgtattacacgcggttcggctttgcgccatccggtgacatcgtgttcccgggcgtgccgcccgagtatttcctcgcgctgtcgctcgacgattcggcgccgcggccgtcgggtgacgttcgctatcacgacgtgttctatcccgcgtag

SEQ ID NO: 56629 - protein, 197 aa, Burkholderia cepacia R18194
MDARVPQRAPLDRLIGMMFDPNAPVEVVTLRDQRASEGDAIGRVIVAAFAGEPEGGQFERRIVDTLRADGALSVSLVAERDGRLIGHVAFSPVSIGGELSGSQGWYGLAPLAVLPDCQRQSIGAGLVRTGLDALRRIGARGCVLLGEPAYYTRFGFAPSGDIVFPGVPPEYFLALSLDDSAPRPSGDVRYHDVFYPA

SEQ ID NO: 56630 - DNA, 540 bp, Burkholderia cepacia R1808
  CDS (1)..(540)
atgttcgatccgcacgcgccggtcgacatcgtcacgttgcgcgacgaacgcgcgcgcgacgtcgatgcgatcggtcgcgtgatcgcggccgcatttgccggcgagccgcagcaagggcagcgcgagcggcagatcgtcgacgcgctgcgcgcggccggcgcgctcggcgtgtcgctggtcgccgagcgtgacgaccgcgtgatcggccacatcgcgttttcgccggttgcgatcggcggcgcgtcgccggacagccgttggtatgcgctcgcgccgctcgcggtgcggcccgattgcaggcggcagagcgtcggcgcggggctcgtgcgcaccgggctcgatgcgctgcgccggctcggggcacatggttgcgtcgtgctcggcgatcccgcgtactacgcgcggttcggctttgcgccttgcagcgatctggcgttgcacggtgcgccggccgggcgtttgcttgcgctggcgctcgatgcacacgcgccgcggccgtcgggcgacgttcgctatcacgacgcgttcgacctcggctag

SEQ ID NO: 56631 - protein, 179 aa, Burkholderia cepacia R1808
MFDPHAPVDIVTLRDERARDVDAIGRVIAAAFAGEPQQGQRERQIVDALRAAGALGVSLVAERDDRVIGHIAFSPVAIGGASPDSRWYALAPLAVRPDCRRQSVGAGLVRTGLDALRRLGAHGCVVLGDPAYYARFGFAPCSDLALHGAPAGRLLALALDAHAPRPSGDVRYHDAFDLG

SEQ ID NO: 56632 - DNA, 519 bp, Ralstonia metallidurans CH34
  CDS (1)..(519)
atgaccctccagctccgacacgaaaccccggacgacattgccgccatcgaggccgtgaccatcgccgcgttcgctgatgcaccacacaccagccacaccgagcaattcatcgtgcgcgccttgcgtgccgccaacgaactgacgctttccatcgtggccgaagaacatgggcgcgtcgtcggtcacgtcgcgctgtcgccagtaacaatcacccatgagcacgggcgaaagaccgagggctggtataggttggggccgatctccgtcctgccgccaaggcaggggcaaggcatcggttcgcgcctgatggaacaggcgctgtctgaactgcgggctatgcaggccgcaggctgcgtgctgctgggcgatccaacgtactacacgcgctttggcttccaggcccatgcgggcttgcaactgccgggcgtgccgcccggctatttcatggcgctggccctgcatgggacagtgccggaaggcatcgcgcactacagcgatgccttcaacgccgccgcctga

SEQ ID NO: 56633 - protein, 172 aa, Ralstonia metallidurans CH34
MTLQLRHETPDDIAAIEAVTIAAFADAPHTSHTEQFIVRALRAANELTLSIVAEEHGRVVGHVALSPVTITHEHGRKTEGWYRLGPISVLPPRQGQGIGSRLMEQALSELRAMQAAGCVLLGDPTYYTRFGFQAHAGLQLPGVPPGYFMALALHGTVPEGIAHYSDAFNAAA

SEQ ID NO: 56634 - DNA, 549 bp, Ralstonia metallidurans CH34
  CDS (1)..(549)
atggttgatgtccaccgcgagagcatcaatgaggaaaactgcatgaccatctccgtccggaccgagcgtcccgaggatgttgaaaccatcgcccaactcacggaagcggcgttcaggggcgagacccactcgagccacaccgaagccttcatcatcaacggcttgcgtcgtgccggatgcctgacgctctcgctggtggcggaggatgaaagcgggatcgtcggccacgttgcagcctcgcccgtcaccatttcctccggcaattcgggctggtatggcattgggccagtctcggtattgccagatcggcagcgcaggggcattggctcggtgctgatgctggcggcgcttgatgagttgcgacgccttggcgcacgcggttgcgtcgtgctgggtgagcctgcctattacggcagattcggcttccaggccgattcccggctggtgttgcccggcgtaccgcaggagtatttccagacccttgccttcgggcccgacgtgccggtaggcaccgtgcgctatcacgatgcattcgacgccacggagtag

SEQ ID NO: 56635 - protein, 182 aa, Ralstonia metallidurans CH34
MVDVHRESINEENCMTISVRTERPEDVETIAQLTEAAFRGETHSSHTEAFIINGLRRAGCLTLSLVAEDESGIVGHVAASPVTISSGNSGWYGIGPVSVLPDRQRRGIGSVLMLAALDELRRLGARGCVVLGEPAYYGRFGFQADSRLVLPGVPQEYFQTLAFGPDVPVGTVRYHDAFDATE

SEQ ID NO: 56636 - DNA, 510 bp, Nostoc punctiforme PCC 73102
  CDS (1)..(510)
atgatcgatatccgttatgaaactctgtcagattacacagtaatagctgaggtgaatacattagcttttgggcaagaaaatgaggctaaacttgtagagaaaattcgccgttctgaccgctatattccagaactttctctggttgcagagattgaaaatgttgtagtcggtcatattttattcagctacattgatttagtgggtgaagaaacgctacaggtaatcggtttagcacctttagcagtttatccacagtttcaaagacagggtattggtagcgcactaataaaagcagggttagaaatagcagaggcaaagaaagaagctatagtgattgtccttggccatccccacttctatactcgctttggctttcagccttctgttgtttatgaaatcgagtctccttttccagtaccagaggatgtcttcatggttaaaccactgcaaagctatcaaaaaaggtataaaggaaaagttttttatccatctacttttgatggagtgtaa

SEQ ID NO: 56637 - protein, 169 aa, Nostoc punctiforme PCC 73102
MIDIRYETLSDYTVIAEVNTLAFGQENEAKLVEKIRRSDRYIPELSLVAEIENVVVGHILFSYIDLVGEETLQVIGLAPLAVYPQFQRQGIGSALIKAGLEIAEAKKEAIVIVLGHPHFYTRFGFQPSVVYEIESPFPVPEDVFMVKPLQSYQKRYKGKVFYPSTFDGV

SEQ ID NO: 56638 - DNA, 507 bp, Pseudomonas aeruginosa UCBPP-PA14
  CDS (1)..(507)
atgaatatttccatccgtgcggaaacgcccggcgacatcgacgccatcgctcgcctgaccgaagccgcgctccgcaacgaaacgcatagcagccataccgagcagtacatcgtcgatgccctccgccgtgctggcgcgctgacgctttcgctggtggccgaagcgaatggccaggtgatcggccatatcgcagcctcaccagtgaccatcgatggcgaagcgggcggctggtacggcctcgcgccgctatcggtggcgcccgggcgacagcgccagggtctcggttcgcagttggtccggcgcctgctcaccgagttgcgactgctgcccgcgggtggctgcgtggtactgggcgaaccgacctactactcgcgcttcggctttcgggtggaaagcggcctggcgttgcccggcgttcccgccgaatacttccaggcacagtccttcagcgggcgcatggcgcgaggaatagtggccttccacgccgcattcgacgccagcgactga

SEQ ID NO: 56639 - protein, 168 aa, Pseudomonas aeruginosa UCBPP-PA14
MNISIRAETPGDIDAIARLTEAALRNETHSSHTEQYIVDALRRAGALTLSLVAEANGQVIGHIAASPVTIDGEAGGWYGLAPLSVAPGRQRQGLGSQLVRRLLTELRLLPAGGCVVLGEPTYYSRFGFRVESGLALPGVPAEYFQAQSFSGRMARGIVAFHAAFDASD

SEQ ID NO: 56640 - DNA, 516 bp, Chloroflexus aurantiacus
  CDS (1)..(516)
atgaaaacgatgatccgccctgaaacagccgatgatttcaacgccatttacctgatcaaccaactggcattcaaccgcgaaaatgaagcgcacctggtggaggaactgcgctctgctggagcgatcatcttgtcgctggtggcacagatggaggatagaatcgtcggccatatcctgttttcaccggttgtaatcaccgatgccgacgcgcactggcaggctgtcggattgggaccgatggcagtcctgcctcagcttcaacatcggggaattggttcagccctcatccatgccgggctggctgaactcaacaagctcggtcacgatgtcgtcgttgtgctggggcatcccggcttctatccccgcttcgggtttaagccgtctaaaccatttggcattgcgtgggagattgatgtgcctgaagaagtgttcatggtgaaggaattgcgtagtggggcgctcaacggtagaaagggtgtcgtccgctatcaccctgcgttcaatggagttgaataa

SEQ ID NO: 56641 - protein, 171 aa, Chloroflexus aurantiacus
MKTMIRPETADDFNAIYLINQLAFNRENEAHLVEELRSAGAIILSLVAQMEDRIVGHILFSPVVITDADAHWQAVGLGPMAVLPQLQHRGIGSALIHAGLAELNKLGHDVVVVLGHPGFYPRFGFKPSKPFGIAWEIDVPEEVFMVKELRSGALNGRKGVVRYHPAFNGVE

SEQ ID NO: 56642 - DNA, 525 bp, uncultured archaeon GZfos18H11
  CDS (1)..(522)
atggtaataaacattagaaaagaaacagaaaaggattacgaagacattaaatcagtaaatgacaaagcatttggccaagaaaacgaaggtaaaatagttgaaaatctcagaaaaaatgaaaaatatatttctgatttatatttggtcgctgaaatagataataaaattgttggccacattttattctttccaattaaaataagatcacaggaaaatgaatacgaaaccctttcacttgctccaatgtcggtcttgccaaattatcaaaaaatgggtattggatcaaaactaattgaatatggaatcaaagctgctaaaaaagctggatatggttctattatcgtagtgggacaccctgactattatccaagatttggctttgcacctgcaagtacttttggaataaaactaccttttgaagttcctgataacgcttttatggctttagaacttttacccaatagcctaaagggaaaacaagggacagttaaatatccaaaagaatacaatgacgatgattgatag

SEQ ID NO: 56643 - protein, 173 aa, uncultured archaeon GZfos18H11
MVINIRKETEKDYEDIKSVNDKAFGQENEGKIVENLRKNEKYISDLYLVAEIDNKIVGHILFFPIKIRSQENEYETLSLAPMSVLPNYQKMGIGSKLIEYGIKAAKKAGYGSIIVVGHPDYYPRFGFAPASTFGIKLPFEVPDNAFMALELLPNSLKGKQGTVKYPKEYNDDD

SEQ ID NO: 56644 - DNA, 546 bp, Escherichia coli
  CDS (1)..(546)
atgacagtacaccacttcacttttcatatcacagataaaagtgatgccagtgatatccgggaagtcgaaacccgcgcatttggcttcagcaaagaagccgatttagtggcctctttacttgaggatgaaagcgcgcgccccgcgttatcgctgctagcccggtatgaaggcaaagccgtcgggcatattttatttacccgggcaaccttcaaaggagaaatggattcaccgttgatgcacatcctcgctcccctggcggtcataccggaataccaagggatgggcgtgggaggacggttgatacgcactggcatcgagcacctgaggttgatgggctgccagacggtttttgttctcggccacgccacctattacccccgacatgggttcgaaccctgtgccggagacaaaggctatccggcaccttatcccatcccggaggagcacaaagcctgctggatgatgcaatcactcaccgctcagcccatgaccctgaccggccacatccggtgcgcagaccctgatgaaaccggagcactgacgtga

SEQ ID NO: 56645 - protein, 181 aa, Escherichia coli
MTVHHFTFHITDKSDASDIREVETRAFGFSKEADLVASLLEDESARPALSLLARYEGKAVGHILFTRATFKGEMDSPLMHILAPLAVIPEYQGMGVGGRLIRTGIEHLRLMGCQTVFVLGHATYYPRHGFEPCAGDKGYPAPYPIPEEHKACWMMQSLTAQPMTLTGHIRCADPDETGALT

SEQ ID NO: 56646 - DNA, 23 bp, Artificial sequence
  (1)..(23): primer
atgctaattcgagtagaaattcc

SEQ ID NO: 56647 - DNA, 25 bp, Artificial sequence
  (1)..(25): primer
ttaaaagcgattgaaatgctcgtga

SEQ ID NO: 56648 - protein, 195 aa, Artificial sequence
  Variant (2)..(2): xaa in position 2 is any amino acid
  Variant (5)..(5): xaa in position 5 is any amino acid
  Variant (7)..(9): xaa in position 7 to 9 is any amino acid
  Variant (11)..(13): xaa in position 11 to 13 is any amino acid
  Variant (15)..(16): xaa in position 15 to 16 is any amino acid
  Variant (18)..(20): xaa in position 18 to 20 is any amino acid
  Variant (23)..(25): xaa in position 23 to 25 is any amino acid
  Variant (26)..(31): xaa in position 26 to 31 is any or no amino acid
  Variant (33)..(34): xaa in position 33 to 34 is any amino acid
  Variant (37)..(38): xaa in position 37 to 38 is any amino acid
  Variant (41)..(47): xaa in position 41 to 47 is any amino acid
  Variant (48)..(51): xaa in position 48 to 51 is any or no amino acid
  Variant (53)..(58): xaa in position 53 to 58 is any amino acid
  Variant (59)..(60): xaa in position 59 to 60 is any or no amino acid
  Variant (66)..(67): xaa in position 66 to 67 is any amino acid
  Variant (69)..(69): xaa in position 69 is any amino acid
  Variant (71)..(71): xaa in position 71 is any amino acid
  Variant (73)..(79): xaa in position 73 to 79 is any amino acid
  Variant (80)..(85): xaa in position 80 to 85 is any or no amino acid
  Variant (92)..(98): xaa in position 92 to 98 is any amino acid
  Variant (102)..(103): xaa in position 102 to 103 is any amino acid
  Variant (106)..(107): xaa in position 106 to 107 is any amino acid
  Variant (110)..(114): xaa in position 110 to 114 is any amino acid
  Variant (115)..(116): xaa in position 115 to 116 is any or no amino acid
  Variant (118)..(121): xaa in position 118 to 121 is any amino acid
  Variant (126)..(128): xaa in position 126 to 128 is any amino acid
  Variant (131)..(131): xaa in position 131 is any amino acid
  Variant (132)..(132): xaa in position 132 is any or no amino acid
  Variant (137)..(143): xaa in position 137 to 143 is any amino acid
  Variant (145)..(151): xaa in position 145 to 151 is any amino acid
  Variant (152)..(157): xaa in position 152 to 157 is any or no amino acid
  Variant (159)..(172): xaa in position 159 to 172 is any amino acid
  Variant (173)..(190): xaa in position 173 to 190 is any or no amino acid
  Variant (192)..(194): xaa in position 192 to 194 is any amino acid
MXIRXEXXXDXXXIXXLXXXAFXXXXXXXXXEXXLVXXLRXXXXXXXXXXXLXXXXXXXXVVGHIXXSXVXIXXXXXXXXXXXXXLAPLAVXXXXXXXGIGXXLIXXGLXXXXXXXGXXXXVVLGXXXYYXXRFGFXXXXXXXLXXXXXXXXXXXXXFXXXXXXXXXXXXXXXXXXXXXXXXXXXXXXXXYXXXF

SEQ ID NO: 56649 - protein, 16 aa, Artificial sequence
  Variant (2)..(3): xaa in position 2 to 3 is any or no amino acid
  Variant (6)..(11): xaa in position 6 to 11 is any amino acid
  Variant (12)..(13): xaa in position 12 to 13 is any or no amino acid
  Variant (15)..(15): xaa in position 15 is any amino acid
  Variant (16)..(16): xaa in position 16 is Ala, Gly, Ile, Leu or Val
LXXVAXXXXXXXXGXX

SEQ ID NO: 56650 - protein, 45 aa, Artificial sequence
  Variant (2)..(2): xaa in position 2 is Ala or Gly
  Variant (3)..(3): xaa in position 3 is Leu or Pro
  Variant (4)..(4): xaa in position 4 is Ile, Leu, Met or Val
  Variant (5)..(5): xaa in position 5 is Ala, Asp, Gly or Ser
  Variant (7)..(13): xaa in position 7 to 13 is any amino acid
  Variant (15)..(15): xaa in position 15 is any amino acid
  Variant (17)..(18): xaa in position 17 to 18 is any amino acid
  Variant (19)..(19): xaa in position 19 is any or no amino acid
  Variant (21)..(38): xaa in position 21 to 38 is any amino acid
  Variant (39)..(39): xaa in position 39 is any or no amino acid
  Variant (41)..(43): xaa in position 41 to 43 is any amino acid
  Variant (44)..(45): xaa in position 44 to 45 is Phe or Tyr
LXXXXVXXXXXXXGXGXXXLXXXXXXXXXXXXXXXXXXXGXXXXX

SEQ ID NO: 56651 - DNA, 1431 bp, Escherichia coli; identical to SEQ ID NO: 14875
  CDS (1)..(1431)

SEQ ID NO: 56652 - protein, 476 aa, Escherichia coli; identical to SEQ ID NO: 14876

SEQ ID NO: 56653 - DNA, 1638 bp, Fusobacterium nucleatum subsp. nucleatum ATCC 25586; identical to SEQ ID NO: 14877
  CDS (1)..(1638): transl_table=11

SEQ ID NO: 56654 - protein, 545 aa, Fusobacterium nucleatum subsp. nucleatum ATCC 25586; identical to SEQ ID NO: 14878

SEQ ID NO: 56655 - DNA, 1392 bp, Clostridium tetani E88; identical to SEQ ID NO: 14879
  CDS (1)..(1392): transl_table=11

SEQ ID NO: 56656 - protein, 463 aa, Clostridium tetani E88; identical to SEQ ID NO: 14880

SEQ ID NO: 56657 - DNA, 1380 bp, Bacteroides thetaiotaomicron VPI-5482; identical to SEQ ID NO: 14881
  CDS (1)..(1380): transl_table=11

SEQ ID NO: 56658 - protein, 459 aa, Bacteroides thetaiotaomicron VPI-5482; identical to SEQ ID NO: 14882

SEQ ID NO: 56659 - DNA, 1380 bp, Porphyromonas gingivalis W83; identical to SEQ ID NO: 14883
  CDS (1)..(1380): transl_table=11

SEQ ID NO: 56660 - protein, 459 aa, Porphyromonas gingivalis W83; identical to SEQ ID NO: 14884

SEQ ID NO: 56661 - DNA, 1449 bp, Rhodopseudomonas palustris CGA009; identical to SEQ ID NO: 14885
  CDS (1)..(1449): transl_table=11

SEQ ID NO: 56662 - protein, 482 aa, Rhodopseudomonas palustris CGA009; identical to SEQ ID NO: 14886

SEQ ID NO: 56663 - DNA, 1380 bp, Treponema denticola ATCC 35405; identical to SEQ ID NO: 14887
  CDS (1)..(1380): transl_table=11

SEQ ID NO: 56664 - protein, 459 aa, Treponema denticola ATCC 35405; identical to SEQ ID NO: 14888

SEQ ID NO: 56665 - DNA, 1380 bp, Treponema denticola ATCC 35405; identical to SEQ ID NO: 14889
  CDS (1)..(1380): transl_table=11

SEQ ID NO: 56666 - protein, 459 aa, Treponema denticola ATCC 35405; identical to SEQ ID NO: 14890

SEQ ID NO: 56667 - DNA, 1617 bp, Entamoeba histolytica HM-1:IMSS; identical to SEQ ID NO: 14891
  CDS (1)..(1617)

SEQ ID NO: 56668 - protein, 538 aa, Entamoeba histolytica HM-1:IMSS; identical to SEQ ID NO: 14892

SEQ ID NO: 56669 - DNA, 1389 bp, Desulfovibrio vulgaris subsp. vulgaris str. Hildenborough; identical to SEQ ID NO: 14893
  CDS (1)..(1389): transl_table=11

SEQ ID NO: 56670 - protein, 462 aa, Desulfovibrio vulgaris subsp. vulgaris str. Hildenborough; identical to SEQ ID NO: 14894

SEQ ID NO: 56671 - DNA, 1377 bp, Propionibacterium acnes KPA171202; identical to SEQ ID NO: 14895
  CDS (1)..(1377): transl_table=11

SEQ ID NO: 56672 - protein, 458 aa, Propionibacterium acnes KPA171202; identical to SEQ ID NO: 14896

SEQ ID NO: 56673 - DNA, 1365 bp, Symbiobacterium thermophilum IAM 14863; identical to SEQ ID NO: 14897
  CDS (1)..(1365): transl_table=11

SEQ ID NO: 56674 - protein, 454 aa, Symbiobacterium thermophilum IAM 14863; identical to SEQ ID NO: 14898

SEQ ID NO: 56675 - DNA, 1416 bp, Symbiobacterium thermophilum IAM 14863; identical to SEQ ID NO: 14899
  CDS (1)..(1416): transl_table=11

SEQ ID NO: 56676 - protein, 471 aa, Symbiobacterium thermophilum IAM 14863; identical to SEQ ID NO: 14900

SEQ ID NO: 56677 - DNA, 1443 bp, Photobacterium profundum SS9; identical to SEQ ID NO: 14901
  CDS (1)..(1443): transl_table=11

SEQ ID NO: 56678 - protein, 480 aa, Photobacterium profundum SS9; identical to SEQ ID NO: 14902

SEQ ID NO: 56679 - DNA, 1467 bp, Photobacterium profundum SS9; identical to SEQ ID NO: 14903
  CDS (1)..(1467): transl_table=11

SEQ ID NO: 56680 - protein, 488 aa, Photobacterium profundum SS9; identical to SEQ ID NO: 14904

SEQ ID NO: 56681 - DNA, 1401 bp, Photobacterium profundum SS9; identical to SEQ ID NO: 14905
  CDS (1)..(1401): transl_table=11

SEQ ID NO: 56682 - protein, 466 aa, Photobacterium profundum SS9; identical to SEQ ID NO: 14906

SEQ ID NO: 56683 - DNA, 1344 bp, Haloarcula marismortui ATCC 43049; identical to SEQ ID NO: 14907
  CDS (1)..(1344): transl_table=11

SEQ ID NO: 56684 - protein, 447 aa, Haloarcula marismortui ATCC 43049; identical to SEQ ID NO: 14908

SEQ ID NO: 56685 - DNA, 1449 bp, Azoarcus sp. EbN1; identical to SEQ ID NO: 14909
  CDS (1)..(1449): transl_table=11

SEQ ID NO: 56686 - protein, 482 aa, Azoarcus sp. EbN1; identical to SEQ ID NO: 14910

SEQ ID NO: 56687 - DNA, 1404 bp, Nostoc punctiforme PCC 73102; identical to SEQ ID NO: 14911
  CDS (1)..(1404)

SEQ ID NO: 56688 - protein, 467 aa, Nostoc punctiforme PCC 73102; identical to SEQ ID NO: 14912

SEQ ID NO: 56689 - DNA, 1416 bp, Haemophilus somnus 129PT; identical to SEQ ID NO: 14913
  CDS (1)..(1416)

SEQ ID NO: 56690 - protein, 471 aa, Haemophilus somnus 129PT; identical to SEQ ID NO: 14914

SEQ ID NO: 56691 - DNA, 1569 bp, Fusobacterium nucleatum subsp. vincentii ATCC 49256; identical to SEQ ID NO: 14915
  CDS (1)..(1569): transl_table=11

SEQ ID NO: 56692 - protein, 522 aa, Fusobacterium nucleatum subsp. vincentii ATCC 49256; identical to SEQ ID NO: 14916

SEQ ID NO: 56693 - DNA, 1383 bp, Fusobacterium nucleatum subsp. vincentii ATCC 49256; identical to SEQ ID NO: 14917
  CDS (1)..(1383): transl_table=11

SEQ ID NO: 56694 - protein, 460 aa, Fusobacterium nucleatum subsp. vincentii ATCC 49256; identical to SEQ ID NO: 14918

SEQ ID NO: 56695 - DNA, 1182 bp, Haemophilus influenzae 86-028NP; identical to SEQ ID NO: 14919
  CDS (1)..(1182)

SEQ ID NO: 56696 - protein, 393 aa, Haemophilus influenzae 86-028NP; identical to SEQ ID NO: 14920

SEQ ID NO: 56697 - DNA, 1347 bp, Solibacter usitatus Ellin6076; identical to SEQ ID NO: 14921
  CDS (1)..(1347): transl_table=11

SEQ ID NO: 56698 - protein, 448 aa, Solibacter usitatus Ellin6076; identical to SEQ ID NO: 14922

SEQ ID NO: 56699 - DNA, 1374 bp, Desulfitobacterium hafniense DCB-2; identical to SEQ ID NO: 14923
  CDS (1)..(1374): transl_table=11

SEQ ID NO: 56700 - protein, 457 aa, Desulfitobacterium hafniense DCB-2; identical to SEQ ID NO: 14924

SEQ ID NO: 56701 - DNA, 1389 bp, Desulfitobacterium hafniense DCB-2; identical to SEQ ID NO: 14925
  CDS (1)..(1389): transl_table=11

SEQ ID NO: 56702 - protein, 462 aa, Desulfitobacterium hafniense DCB-2; identical to SEQ ID NO: 14926

SEQ ID NO: 56703 - DNA, 1443 bp, uncultured bacterium; identical to SEQ ID NO: 14927
  CDS (1)..(1443)

SEQ ID NO: 56704 - protein, 480 aa, uncultured bacterium; identical to SEQ ID NO: 14928

SEQ ID NO: 56705 - DNA, 1365 bp, Symbiobacterium thermophilum; identical to SEQ ID NO: 14929
  CDS (1)..(1365)

SEQ ID NO: 56706 - protein, 454 aa, Symbiobacterium thermophilum; identical to SEQ ID NO: 14930

SEQ ID NO: 56707 - DNA, 1365 bp, Symbiobacterium thermophilum; identical to SEQ ID NO: 14897
  CDS (1)..(1365)

SEQ ID NO: 56708 - protein, 454 aa, Symbiobacterium thermophilum; identical to SEQ ID NO: 14898

SEQ ID NO: 56709 - DNA, 1386 bp, Chromobacterium violaceum; identical to SEQ ID NO: 14933
  CDS (1)..(1386): transl_table=11

SEQ ID NO: 56710 - protein, 461 aa, Chromobacterium violaceum; identical to SEQ ID NO: 14934

SEQ ID NO: 56711 - DNA, 1419 bp, Clostridium tetani; identical to SEQ ID NO: 14935
  CDS (1)..(1419): transl_table=11

SEQ ID NO: 56712 - protein, 472 aa, Clostridium tetani; identical to SEQ ID NO: 14936

SEQ ID NO: 56713 - DNA, 1389 bp, Enterobacter aerogenes; identical to SEQ ID NO: 14937
  CDS (1)..(1389): transl_table=11

SEQ ID NO: 56714 - protein, 462 aa, Enterobacter aerogenes; identical to SEQ ID NO: 14938

SEQ ID NO: 56715 - DNA, 1419 bp, Haemophilus influenzae; identical to SEQ ID NO: 14939
  CDS (1)..(1419): transl_table=11

SEQ ID NO: 56716 - protein, 472 aa, Haemophilus influenzae; identical to SEQ ID NO: 14940

SEQ ID NO: 56717 - DNA, 1347 bp, Halobacterium salinarium; identical to SEQ ID NO: 14941
  CDS (1)..(1347)

SEQ ID NO: 56718 - protein, 448 aa, Halobacterium salinarium; identical to SEQ ID NO: 14942

SEQ ID NO: 56719 - DNA, 1416 bp, Pasteurella multocida; identical to SEQ ID NO: 14943
  CDS (1)..(1416): transl_table=11

SEQ ID NO: 56720 - protein, 471 aa, Pasteurella multocida; identical to SEQ ID NO: 14944

SEQ ID NO: 56721 - DNA, 1401 bp, Photorhabdus luminescens; identical to SEQ ID NO: 14945
  CDS (1)..(1401): transl_table=11

SEQ ID NO: 56722 - protein, 466 aa, Photorhabdus luminescens; identical to SEQ ID NO: 14946

SEQ ID NO: 56723 - DNA, 1398 bp, Proteus inconstans; identical to SEQ ID NO: 14947
  CDS (1)..(1398): transl_table=11

SEQ ID NO: 56724 - protein, 465 aa, Proteus inconstans; identical to SEQ ID NO: 14948

SEQ ID NO: 56725 - DNA, 1404 bp, Proteus vulgaris; identical to SEQ ID NO: 14949
  CDS (1)..(1404): transl_table=11

SEQ ID NO: 56726 - protein, 467 aa, Proteus vulgaris; identical to SEQ ID NO: 14950

SEQ ID NO: 56727 - DNA, 1365 bp, Rhodobacter capsulatus; identical to SEQ ID NO: 14951
  CDS (1)..(1365): transl_table=11

SEQ ID NO: 56728 - protein, 454 aa, Rhodobacter capsulatus; identical to SEQ ID NO: 14952

SEQ ID NO: 56729 - DNA, 1389 bp, Thermoanaerobacter tengcongensis; identical to SEQ ID NO: 14953
  CDS (1)..(1389): transl_table=11

SEQ ID NO: 56730 - protein, 462 aa, Thermoanaerobacter tengcongensis; identical to SEQ ID NO: 14954

SEQ ID NO: 56731 - DNA, 1419 bp, Vibrio cholerae; identical to SEQ ID NO: 14955
  CDS (1)..(1419): transl_table=11

SEQ ID NO: 56732 - protein, 472 aa, Vibrio cholerae; identical to SEQ ID NO: 14956

SEQ ID NO: 56733 - DNA, 1401 bp, Vibrio parahaemolyticus; identical to SEQ ID NO: 14957
  CDS (1)..(1401): transl_table=11

SEQ ID NO: 56734 - protein, 466 aa, Vibrio parahaemolyticus; identical to SEQ ID NO: 14958

SEQ ID NO: 56735 - DNA, 1422 bp, Vibrio vulnificus; identical to SEQ ID NO: 14959
  CDS (1)..(1422): transl_table=11

SEQ ID NO: 56736 - protein, 473 aa, Vibrio vulnificus; identical to SEQ ID NO: 14960

SEQ ID NO: 56737 - DNA, 1371 bp, Citrobacter freundii; identical to SEQ ID NO: 14961
  CDS (1)..(1371): transl_table=11

SEQ ID NO: 56738 - protein, 456 aa, Citrobacter freundii; identical to SEQ ID NO: 14962

SEQ ID NO: 56739 - DNA, 1383 bp, Clostridium tetani; identical to SEQ ID NO: 14963
  CDS (1)..(1383)

SEQ ID NO: 56740 - protein, 460 aa, Clostridium tetani; identical to SEQ ID NO: 14964

SEQ ID NO: 56741 - DNA, 1371 bp, Enterobacter agglomerans; identical to SEQ ID NO: 14965
  CDS (1)..(1371): transl_table=11

SEQ ID NO: 56742 - protein, 456 aa, Enterobacter agglomerans; identical to SEQ ID NO: 14966

SEQ ID NO: 56743 - DNA, 1383 bp, Fusobacterium nucleatum; identical to SEQ ID NO: 14967
  CDS (1)..(1383): transl_table=11

SEQ ID NO: 56744 - protein, 460 aa, Fusobacterium nucleatum; identical to SEQ ID NO: 14968

SEQ ID NO: 56745 - DNA, 1377 bp, Pasteurella multocida; identical to SEQ ID NO: 14969
  CDS (1)..(1377): transl_table=11

SEQ ID NO: 56746 - protein, 458 aa, Pasteurella multocida; identical to SEQ ID NO: 14970

SEQ ID NO: 56747 - DNA, 1377 bp, Symbiobacterium sp; identical to SEQ ID NO: 14971
  CDS (1)..(1377): transl_table=11

SEQ ID NO: 56748 - protein, 458 aa, Symbiobacterium sp; identical to SEQ ID NO: 14972

SEQ ID NO: 56749 - DNA, 27 bp, Artificial sequence
  (1)..(27): primer
atgaaggattatgtaatggaaaacttt

SEQ ID NO: 56750 - DNA, 26 bp, Artificial sequence
  (1)..(26): primer
ttaaacttctttaagttttgcggtga

SEQ ID NO: 56751 - protein, 533 aa, Artificial sequence; identical to SEQ ID NO: 14975
  Variant (2)..(2): xaa in position 2 is any amino acid
  Variant (7)..(7): xaa in position 7 is any amino acid
  Variant (10)..(10): xaa in position 10 is any amino acid
  Variant (12)..(18): xaa in position 12 to 18 is any amino acid
  Variant (20)..(22): xaa in position 20 to 22 is any amino acid
  Variant (24)..(25): xaa in position 24 to 25 is any amino acid
  Variant (27)..(28): xaa in position 27 to 28 is any amino acid
  Variant (30)..(30): xaa in position 30 is any amino acid
  Variant (32)..(32): xaa in position 32 is any amino acid
  Variant (34)..(34): xaa in position 34 is any amino acid
  Variant (36)..(37): xaa in position 36 to 37 is any amino acid
  Variant (49)..(49): xaa in position 49 is any amino acid
  Variant (53)..(54): xaa in position 53 to 54 is any amino acid
  Variant (56)..(56): xaa in position 56 is any or no amino acid
  Variant (61)..(61): xaa in position 61 is any amino acid
  Variant (70)..(71): xaa in position 70 to 71 is any amino acid
  Variant (73)..(74): xaa in position 73 to 74 is any amino acid
  Variant (76)..(78): xaa in position 76 to 78 is any amino acid
  Variant (80)..(80): xaa in position 80 is any amino acid
  Variant (83)..(83): xaa in position 83 is any amino acid
  Variant (86)..(88): xaa in position 86 to 88 is any amino acid
  Variant (89)..(134): xaa in position 89 to 134 is any or no amino acid
  Variant (137)..(137): xaa in position 137 is any amino acid
  Variant (145)..(145): xaa in position 145 is any amino acid
  Variant (147)..(150): xaa in position 147 to 150 is any amino acid
  Variant (153)..(160): xaa in position 153 to 160 is any amino acid
  Variant (161)..(170): xaa in position 161 to 170 is any or no amino acid
  Variant (172)..(173): xaa in position 172 to 173 is any amino acid
  Variant (175)..(175): xaa in position 175 is any amino acid
  Variant (178)..(179): xaa in position 178 to 179 is any amino acid
  Variant (181)..(184): xaa in position 181 to 184 is any amino acid
  Variant (187)..(190): xaa in position 187 to 190 is any amino acid
  Variant (192)..(195): xaa in position 192 to 195 is any amino acid
  Variant (197)..(202): xaa in position 197 to 202 is any amino acid
  Variant (203)..(210): xaa in position 203 to 210 is any or no amino acid
  Variant (214)..(215): xaa in position 214 to 215 is any amino acid
  Variant (218)..(218): xaa in position 218 is any amino acid
  Variant (221)..(223): xaa in position 221 to 223 is any amino acid
  Variant (225)..(227): xaa in position 225 to 227 is any amino acid
  Variant (229)..(230): xaa in position 229 to 230 is any amino acid
  Variant (231)..(231): xaa in position 231 is any or no amino acid
  Variant (233)..(234): xaa in position 233 to 234 is any amino acid
  Variant (236)..(238): xaa in position 236 to 238 is any amino acid
  Variant (241)..(241): xaa in position 241 is any amino acid
  Variant (243)..(244): xaa in position 243 to 244 is any amino acid
  Variant (252)..(252): xaa in position 252 is any amino acid
  Variant (256)..(259): xaa in position 256 to 259 is any amino acid
  Variant (261)..(263): xaa in position 261 to 263 is any amino acid
  Variant (265)..(265): xaa in position 265 is any amino acid
  Variant (267)..(267): xaa in position 267 is any amino acid
  Variant (269)..(270): xaa in position 269 to 270 is any amino acid
  Variant (273)..(273): xaa in position 273 is any amino acid
  Variant (275)..(276): xaa in position 275 to 276 is any amino acid
  Variant (283)..(285): xaa in position 283 to 285 is any amino acid
  Variant (287)..(288): xaa in position 287 to 288 is any amino acid
  Variant (290)..(292): xaa in position 290 to 292 is any amino acid
  Variant (295)..(296): xaa in position 295 to 296 is any amino acid
  Variant (298)..(299): xaa in position 298 to 299 is any amino acid
  Variant (301)..(301): xaa in position 301 is any amino acid
  Variant (303)..(303): xaa in position 303 is any amino acid
  Variant (307)..(309): xaa in position 307 to 309 is any amino acid
  Variant (316)..(316): xaa in position 316 is any amino acid
  Variant (323)..(323): xaa in position 323 is any amino acid
  Variant (325)..(327): xaa in position 325 to 327 is any amino acid
  Variant (329)..(330): xaa in position 329 to 330 is any amino acid
  Variant (331)..(348): xaa in position 331 to 348 is any or no amino acid
  Variant (351)..(357): xaa in position 351 to 357 is any amino acid
  Variant (359)..(360): xaa in position 359 to 360 is any amino acid
  Variant (363)..(364): xaa in position 363 to 364 is any amino acid
  Variant (370)..(370): xaa in position 370 is any amino acid
  Variant (375)..(375): xaa in position 375 is any amino acid
  Variant (379)..(379): xaa in position 379 is any amino acid
  Variant (382)..(382): xaa in position 382 is any amino acid
  Variant (384)..(388): xaa in position 384 to 388 is any amino acid
  Variant (391)..(392): xaa in position 391 to 392 is any amino acid
  Variant (395)..(395): xaa in position 395 is any amino acid
  Variant (398)..(398): xaa in position 398 is any amino acid
  Variant (401)..(403): xaa in position 401 to 403 is any amino acid
  Variant (405)..(407): xaa in position 405 to 407 is any amino acid
  Variant (410)..(413): xaa in position 410 to 413 is any amino acid
  Variant (414)..(414): xaa in position 414 is any or no amino acid
  Variant (416)..(416): xaa in position 416 is any or no amino acid
  Variant (421)..(421): xaa in position 421 is any amino acid
  Variant (426)..(429): xaa in position 426 to 429 is any amino acid
  Variant (431)..(433): xaa in position 431 to 433 is any or no amino acid
  Variant (436)..(439): xaa in position 436 to 439 is any amino acid
  Variant (443)..(444): xaa in position 443 to 444 is any amino acid
  Variant (446)..(448): xaa in position 446 to 448 is any amino acid
  Variant (451)..(453): xaa in position 451 to 453 is any amino acid
  Variant (457)..(458): xaa in position 457 to 458 is any amino acid
  Variant (460)..(460): xaa in position 460 is any amino acid
  Variant (462)..(467): xaa in position 462 to 467 is any amino acid
  Variant (468)..(470): xaa in position 468 to 470 is any or no amino acid
  Variant (472)..(479): xaa in position 472 to 479 is any or no amino acid
  Variant (481)..(482): xaa in position 481 to 482 is any amino acid
  Variant (485)..(485): xaa in position 485 is any amino acid
  Variant (489)..(490): xaa in position 489 to 490 is any amino acid
  Variant (493)..(494): xaa in position 493 to 494 is any amino acid
  Variant (498)..(498): xaa in position 498 is any amino acid
  Variant (500)..(505): xaa in position 500 to 505 is any amino acid
  Variant (507)..(512): xaa in position 507 to 512 is any amino acid
  Variant (514)..(514): xaa in position 514 is any amino acid
  Variant (515)..(515): xaa in position 515 is any or no amino acid
  Variant (518)..(521): xaa in position 518 to 521 is any amino acid
  Variant (524)..(525): xaa in position 524 to 525 is any amino acid
  Variant (526)..(527): xaa in position 526 to 527 is any or no amino acid
  Variant (530)..(530): xaa in position 530 is any amino acid
  Variant (532)..(532): xaa in position 532 is any amino acid

SEQ ID NO: 56752 - protein, 85 aa, Artificial sequence; identical to SEQ ID NO: 14976
  Variant (2)..(2): xaa in position 2 is Pro or Ser
  Variant (3)..(4): xaa in position 3 to 4 is any amino acid
  Variant (5)..(5): xaa in position 5 is Ile, Leu or Met
  Variant (6)..(8): xaa in position 6 to 8 is any amino acid
  Variant (10)..(10): xaa in position 10 is any amino acid
  Variant (11)..(18): xaa in position 11 to 18 is any or no amino acid
  Variant (20)..(25): xaa in position 20 to 25 is any amino acid
  Variant (26)..(26): xaa in position 26 is Ala, Ser or Val
  Variant (27)..(28): xaa in position 27 to 28 is any amino acid
  Variant (30)..(30): xaa in position 30 is any amino acid
  Variant (32)..(32): xaa in position 32 is any amino acid
  Variant (33)..(33): xaa in position 33 is Ile or Leu
  Variant (34)..(34): xaa in position 34 is any amino acid
  Variant (35)..(35): xaa in position 35 is Ala, Gly or Ser
  Variant (36)..(39): xaa in position 36 to 39 is any amino acid
  Variant (49)..(49): xaa in position 49 is Ala, Gly, Asn, Ser or Thr
  Variant (51)..(51): xaa in position 51 is Ile, Met or Val
  Variant (52)..(52): xaa in position 52 is Ser or Thr
  Variant (53)..(53): xaa in position 53 is Asp, Asn, Gln or Ser
  Variant (54)..(56): xaa in position 54 to 56 is any amino acid
  Variant (57)..(57): xaa in position 57 is Ala, Gly or Ser
  Variant (58)..(58): xaa in position 58 is Ala or Gly
  Variant (59)..(59): xaa in position 59 is Ile, Leu, Met or Val
  Variant (60)..(60): xaa in position 60 is Phe, Ile, Leu or Met
  Variant (61)..(61): xaa in position 61 is any amino acid
  Variant (65)..(65): xaa in position 65 is Ala or Ser
  Variant (67)..(67): xaa in position 67 is Ala or Ser
  Variant (69)..(69): xaa in position 69 is Ala, Gly or Ser
  Variant (70)..(70): xaa in position 70 is any amino acid
  Variant (71)..(71): xaa in position 71 is Asn or Ser
  Variant (72)..(72): xaa in position 72 is Phe, Trp or Tyr
  Variant (73)..(74): xaa in position 73 to 74 is any amino acid
  Variant (75)..(75): xaa in position 75 is Phe, Leu or Met
  Variant (76)..(78): xaa in position 76 to 78 is any amino acid
  Variant (79)..(79): xaa in position 79 is Ala, Gly, Ile or Val
  Variant (80)..(83): xaa in position 80 to 83 is any amino acid
  Variant (84)..(84): xaa in position 84 is Asp, Gly, Asn or Pro
  Variant (85)..(85): xaa in position 85 is Phe or Tyr

SEQ ID NO: 56753 - protein, 41 aa, Artificial sequence; identical to SEQ ID NO: 14977
  Variant (2)..(2): xaa in position 2 is Ala or Thr
  Variant (7)..(7): xaa in position 7 is Ala or Gly
  Variant (10)..(10): xaa in position 10 is any amino acid
  Variant (11)..(15): xaa in position 11 to 15 is any or no amino acid
  Variant (17)..(40): xaa in position 17 to 40 is any amino acid
  Variant (41)..(41): xaa in position 41 is Ala, Glu, Gly, Gln or Thr

SEQ ID NO: 56754 - protein, 100 aa, Artificial sequence; identical to SEQ ID NO: 14978
  Variant (2)..(13): xaa in position 2 to 13 is any amino acid
  Variant (14)..(17): xaa in position 14 to 17 is any or no amino acid
  Variant (19)..(19): xaa in position 19 is Cys, Asn, Ser or Val
  Variant (21)..(22): xaa in position 21 to 22 is any amino acid
  Variant (27)..(27): xaa in position 27 is Ile or Val
  Variant (29)..(29): xaa in position 29 is Ile, Leu or Met
  Variant (30)..(30): xaa in position 30 is any amino acid
  Variant (32)..(32): xaa in position 32 is Ile, Leu or Met
  Variant (33)..(33): xaa in position 33 is any amino acid
  Variant (34)..(34): xaa in position 34 is Ala, Asp, Glu, Gly or Ser
  Variant (35)..(37): xaa in position 35 to 37 is any amino acid
  Variant (38)..(38): xaa in position 38 is Ile, Leu, Met or Val
  Variant (39)..(39): xaa in position 39 is Ala, Cys or Thr
  Variant (40)..(43): xaa in position 40 to 43 is any amino acid
  Variant (44)..(44): xaa in position 44 is Ile or Val
  Variant (45)..(45): xaa in position 45 is any amino acid
  Variant (46)..(46): xaa in position 46 is Phe, Ile, Leu, Met or Val
  Variant (47)..(48): xaa in position 47 to 48 is any amino acid
  Variant (50)..(50): xaa in position 50 is Ala, Ser or Val
  Variant (51)..(51): xaa in position 51 is Ala, Cys or Thr
  Variant (53)..(53): xaa in position 53 is any amino acid
  Variant (54)..(54): xaa in position 54 is Ala, Cys, Ser or Val
  Variant (57)..(57): xaa in position 57 is Ala or Cys
  Variant (58)..(58): xaa in position 58 is His, Trp or Tyr
  Variant (60)..(60): xaa in position 60 is Ile or Val
  Variant (61)..(62): xaa in position 61 to 62 is any amino acid
  Variant (63)..(63): xaa in position 63 is Asp, Gln or Arg
  Variant (64)..(64): xaa in position 64 is Asp or Glu
  Variant (65)..(68): xaa in position 65 to 68 is any amino acid
  Variant (69)..(69): xaa in position 69 is Asp, Glu, Gly, Asn or Ser
  Variant (70)..(71): xaa in position 70 to 71 is any amino acid
  Variant (72)..(72): xaa in position 72 is Ile, Leu, Pro or Val
  Variant (73)..(73): xaa in position 73 is any amino acid
  Variant (74)..(74): xaa in position 74 is Asp, Glu, Gln, Ser or Thr
  Variant (75)..(75): xaa in position 75 is Ile or Val
  Variant (76)..(77): xaa in position 76 to 77 is any amino acid
  Variant (78)..(78): xaa in position 78 is Asp, Glu or Lys
  Variant (79)..(83): xaa in position 79 to 83 is any amino acid
  Variant (84)..(84): xaa in position 84 is Asp or Glu
  Variant (85)..(88): xaa in position 85 to 88 is any amino acid
  Variant (90)..(90): xaa in position 90 is Ala, Gly or Ser
  Variant (94)..(94): xaa in position 94 is Ala, Cys, Gly, Pro or Thr
  Variant (95)..(95): xaa in position 95 is Phe, Ile, Leu or Met
  Variant (96)..(96): xaa in position 96 is Ala, Leu or Val
  Variant (97)..(97): xaa in position 97 is Asn, Pro or Gln
  Variant (98)..(98): xaa in position 98 is Ile or Met

SEQ ID NO: 56755 - protein, 84 aa, Artificial sequence; identical to SEQ ID NO: 14979
  Variant (2)..(4): xaa in position 2 to 4 is any amino acid
  Variant (8)..(8): xaa in position 8 is Leu or Met
  Variant (9)..(9): xaa in position 9 is Ala, Glu, Asn, Ser or Thr
  Variant (11)..(11): xaa in position 11 is any amino acid
  Variant (12)..(12): xaa in position 12 is Ala or Asp
  Variant (13)..(13): xaa in position 13 is Ile, Leu or Met
  Variant (14)..(16): xaa in position 14 to 16 is any amino acid
  Variant (18)..(18): xaa in position 18 is any amino acid
  Variant (20)..(20): xaa in position 20 is Phe, Ile or Leu
  Variant (21)..(31): xaa in position 21 to 31 is any amino acid
  Variant (33)..(33): xaa in position 33 is Ile or Val
  Variant (34)..(34): xaa in position 34 is any amino acid
  Variant (36)..(39): xaa in position 36 to 39 is any amino acid
  Variant (40)..(40): xaa in position 40 is Ala, Gly, Asn or Val
  Variant (41)..(42): xaa in position 41 to 42 is any amino acid
  Variant (44)..(46): xaa in position 44 to 46 is any amino acid
  Variant (47)..(47): xaa in position 47 is Asp, Glu, Gly or Asn
  Variant (48)..(48): xaa in position 48 is Ile or Val
  Variant (49)..(49): xaa in position 49 is Ala, Ile, Leu, Pro or Val
  Variant (50)..(52): xaa in position 50 to 52 is any amino acid
  Variant (53)..(53): xaa in position 53 is Ala or Pro
  Variant (54)..(54): xaa in position 54 is any amino acid
  Variant (56)..(56): xaa in position 56 is any or no amino acid
  Variant (58)..(58): xaa in position 58 is Ala, Gly or Thr
  Variant (59)..(60): xaa in position 59 to 60 is any amino acid
  Variant (61)..(61): xaa in position 61 is Ile, Leu or Val
  Variant (62)..(62): xaa in position 62 is Asp or Glu
  Variant (63)..(63): xaa in position 63 is Ala, Gly or Thr
  Variant (64)..(67): xaa in position 64 to 67 is any amino acid
  Variant (68)..(68): xaa in position 68 is Glu, Asn, Pro or Thr
  Variant (69)..(75): xaa in position 69 to 75 is any amino acid
  Variant (76)..(76): xaa in position 76 is Gly, Ile or Pro
  Variant (77)..(77): xaa in position 77 is Ala, Asp, Gly or Ser
  Variant (78)..(80): xaa in position 78 to 80 is any amino acid
  Variant (81)..(81): xaa in position 81 is Ala, Cys, Gly, Asn, Ser, Thr or Val
  Variant (82)..(83): xaa in position 82 to 83 is any amino acid
  Variant (84)..(84): xaa in position 84 is Ile, Leu or Val

SEQ ID NO: 56756 - DNA, 1251 bp, Saccharomyces cerevisiae
  CDS (1)..(1251)
atgtctttatcttcaaagttgtctgtccaagatttggacttgaaggacaagcgtgtcttcatcagagttgacttcaacgtcccattggacggtaagaagatcacttctaaccaaagaattgttgctgctttgccaaccatcaagtacgttttggaacaccacccaagatacgttgtcttggcttctcacttgggtagaccaaacggtgaaagaaacgaaaaatactctttggctccagttgctaaggaattgcaatcattgttgggtaaggatgtcaccttcttgaacgactgtgtgcgtccagaagttgaagccgctgtcaaggcttctgccccaggttccgttattttgttggaaaacttgcgttaccacatcgaagaagaaggttccagaaaggtcgatggtcaaaaggtcaaggcttccaaggaagatgttcaaaagttcagacacgaattgagctctttggctgatgtttacatcaacgatgccttcggtaccgctcacagagctcactcttctatggtcggtttcgacttgccacaacgtgctgccggtttcttgttggaaaaggaattgaagtacttcggtaaggctttggagaacccaaccagaccattcttggccatcttaggtggtgccaaggttgctgacaagattcaattgattgacaacttgttggacaaggtcgactctatcatcattggtggtggtatggctttcaccttcaagaaggttttggaaaacactgaaatcggtgactccatcttcgacaaggctggtgctgaaatcgttccaaagttgatggaaaaggccaaggccaagggtgtcgaagtcgtcttgccagtcgacttcatcattgctgatgctttctctgctgatgccaacaccaagactgtcactgacaaggaaggtattccagctggctggcaagggttggacaatggtccagaatctagaaagttgtttgctgctactgttgcaaaggctaagaccattgtctggaacggtccaccaggtgttttcgaattcgaaaagttcgctgctggtactaaggctttgttagacgaagttgtcaagagctctgctgctggtaacaccgtcatcattggtggtggtgacactgccactgtcgctaagaagtacggtgtcactgacaagatctcccatgtctctactggtggtggtgcttctttggaattattggaaggtaaggaattgccaggtgttgctttcttatccgaaaagaaataa

SEQ ID NO: 56757 - protein, 416 aa, Saccharomyces cerevisiae
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVRPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 56758 - DNA, 1179 bp, Francisella tularensis subsp. tularensis
  CDS (1)..(1179)
atgagttttctaacattgaaagatgttgatttaaaagataaaaaagtcttggttcgtgttgacttcaacgtacctgttaaagatggtaaggtaacaagtaaagttagaattgaagcggctattccgactattcaatatattctagatcaaggtggagctgtgattctgatgtcacaccttggtcgtcctacagagggtgagtatgattctcagttctctctagagcctgttgctaaagctttatctgaaattatcaataagccggttaagtttgctaaagactggttagatggtgttgatgttaaagctggtgaaattgtcatgtgtgaaaatgtccgctttaatagtggtgagaaaaaatcaacagatgatttatctaaaaagattgcaagcttaggtgatgtgtttgttatggacgcttttgctacagcgcatagagctcaagcttcgacctacggtgtggctaaatatattcctgtagcatgtgcagggatattgttaactaatgaaattcaagcattagaaaaagctttaaaatcgccaaaaaaaccaatggcagcaatagttggagggtctaaggtctctactaaactatcggtgctaaataaccttcttgataaggttgaaattcttattgttggtggtggtattgctaatactttcataaaagcagaaggttttgatgttggtaattcattgtatgaacaagatcttgtcgctgaagcaacagagattttagctaaagctaaggctttaggggttaatattcctgtgccagttgatgtaagagttgctaaagagtttagcgaaaatgcccaagcaatcattaaaaaggtttccgatgttgttgcggatgagatgattctagatataggtccagaatctcaaaagataattgctgagctgttaaaatcagcaaatactatcttatggaatggacctgttggagtatttgagtttgataactttgcagagggtacaaaagctttatctttagctatagcacaatcgcacgctttttcagtagctggtggtggtgatactattgctgcgatagaaaaatttggcattaaagaccaagtttcttatatatcaacagctggtggagcattcttagagtttcttgaaggcaagaaattaccagctatagagatacttaaagaaaaagcaatcaggtag

SEQ ID NO: 56759 - protein, 392 aa, Francisella tularensis subsp. tularensis
MSFLTLKDVDLKDKKVLVRVDFNVPVKDGKVTSKVRIEAAIPTIQYILDQGGAVILMSHLGRPTEGEYDSQFSLEPVAKALSEIINKPVKFAKDWLDGVDVKAGEIVMCENVRFNSGEKKSTDDLSKKIASLGDVFVMDAFATAHRAQASTYGVAKYIPVACAGILLTNEIQALEKALKSPKKPMAAIVGGSKVSTKLSVLNNLLDKVEILIVGGGIANTFIKAEGFDVGNSLYEQDLVAEATEILAKAKALGVNIPVPVDVRVAKEFSENAQAIIKKVSDVVADEMILDIGPESQKIIAELLKSANTILWNGPVGVFEFDNFAEGTKALSLAIAQSHAFSVAGGGDTIAAIEKFGIKDQVSYISTAGGAFLEFLEGKKLPAIEILKEKAIR

SEQ ID NO: 56760 - DNA, 1254 bp, Homo sapiens
  CDS (1)..(1254)
atgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttag

SEQ ID NO: 56761 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 56762 - DNA, 1254 bp, Mus musculus
  CDS (1)..(1254)
atgtcgctttccaacaagctgactttggacaagctggacgtgaaggggaagcgggtcgtgatgagggtggacttcaacgttcctatgaagaacaaccagataacaaacaaccaaaggatcaaggctgctgttccaagcatcaaattctgcttggacaatggagccaactccgttgtccttatgagccacctgggccggcctgatggtgttcccatgcctgacaagtactccttagagccagttgctgctgaactcaaatctctgctgggcaaggatgttctgttcttgaaggattgtgtgggcccagaagtcgagaatgcctgtgccaacccagcggctgggactgtcatcctgctggaaaacctccgctttcatgtagaggaagaagggaagggaaaagatgcttctgggaacaaggttaaagctgagccggccaaaattgatgctttccgagcctcactgtccaaactaggagatgtctatgtcaatgatgcttttgggactgcacaccgagcccatagctccatggtgggtgtgaatctgccacagaaggctggtggatttttgatgaagaaggagctgaactactttgccaaggctttggagagtcctgagcgacccttcctggctatcttgggaggcgctaaagttgcagacaagatccagctgatcaataatatgctagacaaagtcaatgagatgatcattggtggtggaatggcctttaccttccttaaggtcctcaacaacatggagattggcacatctctgtatgatgaagaaggagccaagattgtcaaagatctcatgtccaaagctgagaaaaatggtgtgaagattaccttgcctgttgactttgtcactgctgacaaatttgatgagaatgccaagactggccaagctactgtggcctctggtatacctgctggctggatgggcttggactgtggtactgagagcagcaagaaatatgccgaggctgtgggtcgagctaagcagattgtttggaatggtcctgttggggtatttgaatgggaagcctttgccaggggaaccaagtcactcatggatgaggtggtgaaagccacttctaggggttgcatcactatcataggtggtggagacactgccacttgctgtgccaaatggaacacagaggataaagtcagccatgtgagcactgggggcggtgccagtctagagctcctggaaggtaaagtccttcctggggtggatgctctcagcaatgtttag

SEQ ID NO: 56763 - protein, 417 aa, Mus musculus
MSLSNKLTLDKLDVKGKRVVMRVDFNVPMKNNQITNNQRIKAAVPSIKFCLDNGANSVVLMSHLGRPDGVPMPDKYSLEPVAAELKSLLGKDVLFLKDCVGPEVENACANPAAGTVILLENLRFHVEEEGKGKDASGNKVKAEPAKIDAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLYDEEGAKIVKDLMSKAEKNGVKITLPVDFVTADKFDENAKTGQATVASGIPAGWMGLDCGTESSKKYAEAVGRAKQIVWNGPVGVFEWEAFARGTKSLMDEVVKATSRGCITIIGGGDTATCCAKWNTEDKVSHVSTGGGASLELLEGKVLPGVDALSNV

SEQ ID NO: 56764 - DNA, 1212 bp, Neisseria meningitidis MC58
  CDS (1)..(1212): transl_table=11
atggcatttttaaaactgaccgaacaaaacgtgcagggcaaaaccgtcctcatccgcgccgatatgaacgtaccgttcaaagacggcaaaatcagcgacgacacccgtatccgcgcctcgctcgcgtccattaaatactgcgtggacaacggtgcgtccgttatcgtgatgacccatctcggccgcccgaccgaaggcgagttccaccccgaagacgatgtcgcccccgttgccgcgcacttgggcagcctgttgggcaaagacgtgaaagtattgaacgactggcgtgaaaacaaacccgccctgaacgcgggcgatgtcgtcatgctgcaaaacgtgcgcatcaacaaaggcgagaagaaaaacgatttggaactgggtaaagcctacgcttctttgtgcgacgtgttcgtcaatgacgcgttcggaaccgcccaccgcgcccaagcctcgaccgaagccgtcgcccaagccgcgcccgttgcctgcgccggcgtattgatggcgggcgaactcgacgctttgggcaaagccttgaaacagcccgcgcgcccgatggttgccatcgttgccggcagcaaagtgtccaccaagctgaccatcctcgaatcgctggcggacaaagtcgaccaactcatcgtcggcggcggtatcgcaaacaccttcctgttggcggaaggcaaagccatcggcaaatctttggcggaacacgatttggtggaagaatccaaaaaaattatggcgaaaatggcggcaaaaggcggttctgtgccgctgccgaccgatgtcgtcgttgccaaagcctttgccgccgatgcggaagctgtggtgaaagacattgccgccgatgcggaagctgtggtgaaagacattgccgacgttgccgaagacgagatgattttggacatcggtccgaaatccgctgccgcgcttgccgatttgcttaaagccgccggtacggtcgtttggaacgggccggtcggcgtgttcgagtttgaccaattcgcaggcggtacgaaagcccttgccgaagccattgcccaaagcaaagcgttctcgattgcgggcggcggcgacacgctggcggcgattgccaaattcggcgttaccgaacaaatcggctacatctccaccggcggcggcgcgttccttgagttcttggaaggcaaagagctgcctgccgtagccgctttggaaaaacgcggcgcgtaa

SEQ ID NO: 56765 - protein, 403 aa, Neisseria meningitidis MC58
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 56766 - DNA, 1248 bp, Sulfolobus solfataricus P2
  CDS (1)..(1248): transl_table=11
gtggggatctttctgattaaagtgggagacttaactatacccacaatggatgatatagatatccaatcaaaaaaagttctgttacgaatagacataaattcccccgtagatgagaacggcaaaataattgatgattctagaataaaggcacatattggaacaattaaggaattgattaataagggcaattctgttgtgttaatttcacatcaaggtaggcctggagacaaggatttcacaagtttagaggaacatgctaaattaatttcaaagtatttagatcgagaagtaattttcgtagatgatgtaataggcccatatgcaagggaaatgattaaaaaattagaaaataatgggattttactcttagataatataagattaatttcagaggagttaatagaggctccaccacaacaacacgtaaaaagctttttagtaaagaaattagctccgcttttcgacatttatatcaatgatgcgttcgctactgcacacagaagtcagcctagtatcgtaggctttcctttagctttaccatcagcagctggaagagtaatggaaagggaagtttcagcgttagccaagatttttaatgccgaagacacaccaaagatatttacgttaggtggtggtaaggttcacgatactattaggataattgaaaatctagtgagaaaaaggatagctgacagaatacttactgggggtttagttgcagaattattttctgtcgctaaaggaatgaatttaaatccaaagaatatggaaattctggaaaaattaggtatactgagtctaattcctagagctagaaaactacttctaagtggagctcctatcgaaataccagttgactataaggtagaaataaacggaaacgtaatcgaggaaccagctagtaaggtcactggcattataaaggatatcggatccactactgcagaaatatactcatcatttataaaagatgctaaagtagtagttttaaggggaccaatgggagtaatcgaagatgaaagatttaagagtggaagtaaaagcgtcttaaaagcatcattagagggacaaggttacgttataataggaggtggacacatgataagtgctttagatgaggatatgaagatagatagtagtaaagttcatatctctactggtggaggagctctcctcttattcttatctggagaacgattaccagcattagaggcattatcaatgtcggtggtgaatagcggtgattaa

SEQ ID NO: 56767 - protein, 415 aa, Sulfolobus solfataricus P2
MGIFLIKVGDLTIPTMDDIDIQSKKVLLRIDINSPVDENGKIIDDSRIKAHIGTIKELINKGNSVVLISHQGRPGDKDFTSLEEHAKLISKYLDREVIFVDDVIGPYAREMIKKLENNGILLLDNIRLISEELIEAPPQQHVKSFLVKKLAPLFDIYINDAFATAHRSQPSIVGFPLALPSAAGRVMEREVSALAKIFNAEDTPKIFTLGGGKVHDTIRIIENLVRKRIADRILTGGLVAELFSVAKGMNLNPKNMEILEKLGILSLIPRARKLLLSGAPIEIPVDYKVEINGNVIEEPASKVTGIIKDIGSTTAEIYSSFIKDAKVVVLRGPMGVIEDERFKSGSKSVLKASLEGQGYVIIGGGHMISALDEDMKIDSSKVHISTGGGALLLFLSGERLPALEALSMSVVNSGD

SEQ ID NO: 56768 - DNA, 1281 bp, Agrobacterium tumefaciens str. C58
  CDS (1)..(1281): transl_table=11
atgaggcctgaccggcttgcgtcggcaatcaggcatagtatggtccgtcccgaactcgcaacaaatcaggatcgacccatgcccgctttcaagaccatcgacgaccttaacgacattgccggaaagcgcgttctcgtccgcgttgatctcaacgtgccggtcgcggatggcaaggtgacggacgcaacccgtatcgaacgcgttgcgccgaccattctggaactctcttcaaagggcgcaaaagtcattctgctcgcccatttcggccgcccaaagggtgaacccgtcgctgagatgtcgctttcccagattgtccccacggtcgaggacgtgctggatcacgccatttccttcgcaacggactgcatcggtgcccctgcagcggatgcggtcgcaaaaatgaatgatggcgatattctgctgctggaaaacacccgcttccacaagggcgaggaaaagaacgatcccgccttcgtcgaagaactggccgcgaatggcgatatctatgtgaacgacgccttctccgccgctcaccgtgcccacgcctccaccgagggcctggcgcggcatctgcccgcttatgccggccgcaccatgcaggccgagcttgaggcgctggaaaaaggcctcggccagcccgttcgcccggtcgtcgccatcgtcggcggtgccaaggtttcgagcaagatcgatctcttgatgaacctcgtcaagaaggtcgatgccctcgtcattggcggcggcatggccaacaccttcctcgccgcccgcggcaccaatgtcggcaagtcgctctgcgagcacgatctggcagagaccgcaaagcagatcatgatcgaggcagcgacatccggttgcgctatcgtcctgccggaagacggcgtcgtcgcccgcgaattcacggccggcgcggccaatgaaattgtcgatatcaacgccattcccgccgacgccatggttctcgatgtcggtccgaaatcggttgaaagcatcaaggcctggatttcgcgggcggaaacgctggtctggaacggcccgctcggcgccttcgaaatcgaacccttcgatgcggcaaccgtggcggcggcaaaacacgctgcggaatgcaccaaggccggcaagctcgtttccgttgccggtggcggcgacaccgtcgctgcactcaaccatgccggtgtttcggacgatttcacctatatttcgacggcgggcggcgccttccttgaatggatggaaggcaaggaattgccaggcgttgccatcctgaccactgccaagtaa

SEQ ID NO: 56769 - protein, 426 aa, Agrobacterium tumefaciens str. C58
MRPDRLASAIRHSMVRPELATNQDRPMPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 56770 - DNA, 1164 bp, Escherichia coli K12; identical to SEQ ID NO: 10380
  CDS (1)..(1164): transl_table=11

SEQ ID NO: 56771 - protein, 387 aa, Escherichia coli K12; identical to SEQ ID NO: 10381

SEQ ID NO: 56772 - DNA, 1161 bp, Haemophilus influenzae Rd KW20; identical to SEQ ID NO: 10418
  CDS (1)..(1161): transl_table=11

SEQ ID NO: 56773 - protein, 386 aa, Haemophilus influenzae Rd KW20; identical to SEQ ID NO: 10419

SEQ ID NO: 56774 - DNA, 1164 bp, Salmonella typhimurium LT2
  CDS (1)..(1164): transl_table=11
atgtctgtaattaagatgaccgatctggatctggccgggaaacgcgtttttatccgtgcggatctgaacgtacctgttaaagaagggaaagtgaccagcgacgcgcgtatccgcgcttctctgccgaccatcgaactggctctgaaacagggcgcgaaagtgatggtaacttcccacctgggtcgtcctaccgaaggcgagtacaacgaagaattctctctgctgccggttgttaactacctgaaagacaaactgtctaacccggttcgcctggtcaaagattacctggacggcgttgacgtggccgaaggtgagctggtggttctggaaaacgttcgctttaacaaaggcgaaaagaaagacgacgaagcgctgtctaaaaaatacgccgccctgtgtgacgtattcgtgatggacgcctttggtactgcgcaccgcgcgcaggcttctacccacggtatcggcaaatttgctgatgttgcgtgcgcaggcccgctgctggccgctgaactggatgcgctgggtaaagcgctgaaagaaccggctcgtccgatggtggctatcgttggtggttctaaagtatctaccaaactgaccgttctggattccctgtctaaaatcgctgaccagctgattgtcggcggcggtatcgccaacaccttcgttgccgctcagggccacagcgtcggtaaatccctgtacgaagctgacctggttgacgaagcaaaacgtctgctgaccacttgcgatatcccggttccgaccgatgttcgcgttgccaccgagttctccgaaaccgcaccggcgactctgaaatccgttaacgacgtgaaagaagacgagcagatcctggatatcggcgatgcttccgctcagcagctggctgaaatcctcaagaatgccaaaaccattctgtggaacggcccggttggcgtgtttgagttcccgaacttccgtaaagggactgaaatcgtggcgaatgccatcgctgatagcgaagcgttttccatcgctggcggcggcgacaccctggcggcaatcgacctgttcggcattgctgacaaaatttcctacatttctactggcggcggcgcattcctcgaattcgtggaaggtaaagttctgccagccgtagcgatgctcgaagagcgcgctaagaagtaa

SEQ ID NO: 56775 - protein, 387 aa, Salmonella typhimurium LT2; identical to SEQ ID NO: 10401

SEQ ID NO: 56776 - DNA, 1215 bp, Brucella melitensis 16M
  CDS (1)..(1215): transl_table=11
ttgataaggaccgagagaagaaacatgatgttccgcacccttgacgatgccaatgtccaatccaagcgcgtgctggtccgtgttgacctcaacgtgccgatggcaaacggcgaagtcaccgaccttacccgcatcgaacgcatcgttccgaccatcgcggaactgtcaaggaagggcgcgaaggtcatcctgctcgcccatttcggtcgcccgaagggggttgcctcggatgaaaattcgctgaagcatgtcgtgaagccgctctccaaggttctggatcacagtgttcattttgccgaagactgcatcggcgacaaggcgaaagcggccgtcgatgcgctgaaggacggcgacgtcctgcttctggaaaatacccgtttccacaagggcgaggaaaagaacgatcctgaattcgtgcaggcgctggccgccaatggcgatctctatgtgaacgatgccttttccgccgctcaccgcgcccatgcctcgactgaaggtctggcccatgtcctgcctgccttcgcgggccgcgccatgcaggctgagcttgaagcacttgaaaagggcctcggcaatccggcccgcccggtggtcgccatcgtcggcggtgcaaaggtttcgaccaagctcgacctcctgtccaacctgatcgaaaaggtcgatgcgcttgtcatcggcggcggcatggccaacacgttccttgcagccaagggtcttgatgtcggcaaatcgctctgcgagcatgagctggcctcgaccgcacgcgaaatcatggccaaggccgaaaccaccaaatgcgccatcatcctgccggtggacgcgatcgtgggctggcacttcgccgccgatacgccacaccagacctatggcgtggattcggttccgggcgacgccatgatccttgacgcaggcgagctttcgaccgacctcattgcttcggccatcgatgatgccgcaacattggtctggaacggcccgcttggggctttcgagttgcgcccctttgacacagcaacggtgaaggtcgcaaggcatgtcgcaaagcgcacaaaggaaggcaagcttgtttcggtcggcggcggcggcgatacggtggcagccctcaaccatgcgggcgtggccgacgacttcacctatatctcaaccgctggcggcgctttcctcgaatggatggaaggcaaaccgcttccgggcgtcgatgtattgaagaagtga

SEQ ID NO: 56777 - protein, 404 aa, Brucella melitensis 16M
MIRTERRNMMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 56778 - DNA, 1167 bp, Encephalitozoon cuniculi; identical to SEQ ID NO: 10592
  CDS (1)..(1167)

SEQ ID NO: 56779 - protein, 388 aa, Encephalitozoon cuniculi; identical to SEQ ID NO: 10593

SEQ ID NO: 56780 - DNA, 1347 bp, Drosophila melanogaster
  CDS (1)..(1347)
atgcttccaattcggcagagtttataccaaagagctcaaactcgatttacaaaattaagatttccaagattttttagcaaagacgattgcaatggaaagcaagtaaagaagttgagcttaaaaaatgtagatgtggctgggaaaagggtttttatgagagtggactttaatgtacccatgaaagatggcaaaataaccaacaaccaacgaattgtttccgcacttcccagtattaaatatgccttggacaagaaatgtaagtccttggttttggcatcccacttggggcgtccggatggcaaaaagaacaaaaagtttagcctggaacccgtggccaaggagctggagagtgtgctgggccagccggttcaattcctggacgactgcgtgggtgatagcaccctgagagctttgaaggatccctccgacggcactgtgttcctgttggagaatcttcgtttctatgccgaggagacgggcagcagcaaggacgataacaagaagaaggtcaaagcagatcccgcgaaggtgaaggaattccgagccaagttggcgcagctgggcgagatctatgtgaacgatgcctttggaacagcacatcgtccgcatagttccatgatgggcgatggctacaaggtgcgagcggctggtttcctgctggacaaggaactggagtactttgccaaggttctccacgatccggccaagccctttttggccattctgggtggcgccaagatagccgataaaattccactgataacgaacctcctgaacaatgtaacggccatgatcatatccggtggcatggccttcacctttctcaaagtgctcaatggcatggagattggaaagtccctcttcgacgagaagggatccgagttggtcaacgacatagtctgcaaggcgaaggagaaggacgtgaatatactatttccgattgactttgtcatagccaataagatcgacaaggagccggataaagtggaacatgtggatgccacacagggcataccggaggacatgatgggtctggaccacggccaggcatccagtcagatgtttgctggcgctatttgtgcatccaaaaccatcgtctggaacggaccgccaggcttgttcgaaaacgagctattctccaaaggcaccgagtccatgctggaggcagtaatcggggccactaaccgaggagccaccacaatcgttggtggtggggatacggccaccgcttgcttgaagttcggaggcgccgacaaggtctcgcatgtgtccaccggtggaggagcttccctggagttgctggagggtaaggttctgcctggagtggctgctctttcggatgcctaa

SEQ ID NO: 56781 - protein, 448 aa, Drosophila melanogaster; identical to SEQ ID NO: 10625

SEQ ID NO: 56782 - DNA, 1326 bp, Bifidobacterium longum NCC2705
  CDS (1)..(1326): transl_table=11
gtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgctcggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagtcggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaa

SEQ ID NO: 56783 - protein, 441 aa, Bifidobacterium longum NCC2705
MTKHRIQSVDECGVLFRNACNMQSGKIGHFDVRFVKERIFMKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 56784 - DNA, 1197 bp, Streptococcus pyogenes SSI-1
  CDS (1)..(1197): transl_table=11
atggctaaattgactgttaaagacgttgatttgaaaggtaaaaaagtcctcgttcgtgttgactttaatgtgcctttgaaagacggcgttatcactaacgacaaccgtatcactgcggctcttccaacaatcaagtatatcatcgaacaaggtggtcgtgctatcctcttctctcaccttggacgtgttaaagaagaagctgacaaagaaggaaaatcacttgcaccggtagctgctgatttagctgctaaacttggtcaagatgttgtattcccaggtgttactcgtggttcaaaattagaagaagcaatcaatgctttggaagatggacaagttcttttggttgaaaacactcgttttgaagatgttgacggtaagaaagaatctaagaatgacgaagaacttggtaaatactgggcttcacttggagatggaatcttcgttaacgatgcatttggtacagcacaccgtgctcacgcatcaaacgtaggtatttcagcaaacgttgaaaaagctgtagctggtttccttcttgaaaacgaaattgcttacatccaagaagcagttgaaactccagaacgtccattcgtagctattcttggtggctcaaaagtttctgataagattggtgttatcgaaaatcttcttgaaaaagctgataaagttcttatcggtggtggtatgacttacacattctacaaagctcaaggtatcgaaatcggtaactcacttgtagaagaagacaaattggatgttgctaaagacctccttgaaaaatcaaatggtaaattgatcttgccagttgactcgaaagaagcaaacgcatttgctggttacactgaagttcgcgacactgaaggtgaagcagtttcagaaggcttccttggtcttgacatcggtcctaaatcaatcgctaaatttgatgaagcacttactggtgctaaaacagttgtttggaacggacctatgggtgtctttgaaaaccctgacttccaagctggtacaatcggtgtcatggacgctatcgttaaacaaccaggcgttaaatcaatcatcggtggtggtgattcagcagcagctgctatcaaccttggccgtgctgacaaattctcatggatcagtaccggcggaggcgctagcatggaacttctcgagggtaaagtattaccaggtttggcagcattgactgaaaaataa

SEQ ID NO: 56785 - protein, 398 aa, Streptococcus pyogenes SSI-1
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 56786 - DNA, 1278 bp, Bordetella parapertussis 12822
  CDS (1)..(1278): transl_table=11
ttggttttcccgtcacggggaaacggatctggcccttttcgcaggcaggccccggacgccatccacacaggaaccgaatacagtatgtccaacgtcaatacgctttccgcgctggccaagagcggcgctctgtccggcaagcgcgttttcatccgcgccgacctcaacgtgccgttcgacgacgccggccgcatcagcgaagacacccgcatccgcgcctcggtgcccggcatccgcctggcgctggacgccggcgaggcggtcatggtcacctcgcacctgggccgccccaaggagggcgcgctgaccgaggcggactcgctggccccggtcgcgcagcgcctgtccgaactgctgggcatgcaggtgcgcctggtgcccgactgggtcgacggcgtttccgtcgagccgggcgaagtcgtgctgctggagaactgccgcggcaacgtgggcgagaaaaaggacgacgaaggcttgtcgcgcaagatggcggcgctgtgcgatgtgtacgtcaacgacgccttcggcaccgcgcaccgcgccgaggccaccacgcacggcatcgcgcgcttcgcgccggtggcctgcgccggcccgctgctggaggccgagctcgaggcgctggggcgcgcgctgcatgatcccaaacggccgctggtggcgatcgtgggcggctccaaggtgtcgaccaagctgtccatcctgcaatcgctggccgacaaggtcgaccagctggtggtcggcggcggcatcgccaacaccttcatgctggccgccggcctgcccatcggcaagtcgctggccgagcccgagcaggtcgagcaggcgcgcgccgtgatcgaaatcatgaagcgccgcggcgccgaggtgccgattcccaccgacgtggtttgcgccaagtcgttcggcgcggacgccgcggccaccgtcaaggcggccgccgacgtggccgaggacgacatgatcctcgacatcggaccgcagaccgcgcagcgcctggccgacatcctcaaggcggccggcaccatcgtctggaacggtccggtcggcgtgttcgagttcgaccagttcgcccacggcaccgaggtggtggcgcgcgccatcgccgactcggcgggcttttcgattgccggcggcggcgatacgctggctgccatcgccaagtacggcatcgccgaccagaccggctatatctcgaccggcggcggcgctttcctggagttcctggaaggcaaggcgctgccggccgtggccgtgctgcaggcgcgcgccgcgtaa

SEQ ID NO: 56787 - protein, 425 aa, Bordetella parapertussis 12822
MVFPSRGNGSGPFRRQAPDAIHTGTEYSMSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 56788 - DNA, 1176 bp, Vibrio vulnificus YJ016
  CDS (1)..(1176): transl_table=11
ttgagaggacacatcatgtctgtaatcaagatgactgacctggatctagcaggtaaacgtgtattcatccgtgctgacctaaacgtgccagtaaaagacggtaaagtaacttctgatgcacgtatcatcgcatctcttcctactatcaagctatgtctagaagctggcgcgaaagtaatggtcacttctcacctaggtcgtcctactgaaggtgaatacgcagaagagttctctctacaaccagttgttaactacctaaacgacgcgctagattgcgaagtgaaactggctaaagattacctagatggtcttgagctaaacgctggtgaacttgttgttcttgaaaacgttcgctttaacaaaggcgagaagaaaaacgacgaagaactttctaagaaatacgcggcactatgtgacgtattcgtaatggatgcattcggtacagctcaccgtgcacaagcgtcaactcacggtgtgggtatgtttgctgaagtagcgtgtgcgggccctctacttgctgctgaactagaagcactaggcaaagcaatgagcaacccagagcgtcctctagttgctatcgttggtggttcaaaagtgtctactaaactaacggttcttgagtcactatctaaaatcgctgaccaacttgttgttggtggtggtatcgcgaacacattcatcgcagctgaaggtcacaatgtaggtaagtctctatacgaagcggatcttgttgaaactgcacaaaaactgatgaaagagtgtgcaattcctgtcgcgactgacgtagcgtgtgcgaaagcattcgacgagaacgcagaagcggaaatcaaacatgtttctgaagtacaagacgacgacatgatcttcgaccttggtccagactcaacagctgcactagctgaaatcatcgcaaacgcgaaaactattctgtggaatggccctgttggtgtattcgagttcaaaaacttcgaagcgggtactaaaggtatttctgaagcgatcgctcagtctccagcattctctgtagcaggcggtggcgatacgctagcggctatcgacaagttcggtatcaaagcggacgtatcttacatctctactggcggcggtgcgttccttgagtttgtagaaggtaaagtacttccagcagttgaaatgctagaagcacgcgctaagtaa

SEQ ID NO: 56789 - protein, 391 aa, Vibrio vulnificus YJ016
MRGHIMSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 56790 - DNA, 1344 bp, Eremothecium gossypii; identical to SEQ ID NO: 10564
  CDS (1)..(1344)

SEQ ID NO: 56791 - protein, 447 aa, Eremothecium gossypii; identical to SEQ ID NO: 10565

SEQ ID NO: 56792 - DNA, 1296 bp, Methanococcus maripaludis S2; identical to SEQ ID NO: 10818
  CDS (1)..(1296): transl_table=11

SEQ ID NO: 56793 - protein, 431 aa, Methanococcus maripaludis S2; identical to SEQ ID NO: 10819

SEQ ID NO: 56794 - DNA, 1254 bp, Gallus gallus
  CDS (1)..(1254)
atgtctctctccaacaagctcaccctggataaggtggatgtgaagggcaagcgggtcgtcatgagggttgacttcaatgttccaatgaaggatcacaaaataaccaacaaccaaagaatcaaggcagctgtccctaccatcaagcactgcttggaccatggagccaagtcagtggttttgatgagtcacctgggccgcccggatggagttcccatgcctgacaagttctccttttctccagtagctgtggagcttaaagctctcctgggcagggaggtctcattcctgaaggattgtgttggtcctgaggtggagaaggcctgtgctaatcctgcaaacggctccgtcatcctgctagagaacctccgattccatgtagaagaagaagggaaagggaaggatgcttcagggaacaagatcaaagctgatgctgcaaaagtggaggctttcagagcctctctttctaaattgggagatgtttatgtcaatgatgcttttggaactgcccatcgtgctcacagctccatggtaggtgttcatcttcctcagaaggctgctggcttcctgatgaagaaagaactggattattttgcaaaggcccttgagagtccagagagacccttcttagcaattcttggaggagctaaagttcaggataagatccagctgatcagtaacatgttagataaggtcaacgagatgatcattggtggtggaatggcattcacctttctcaaagtgttaaacaacatgcagattggcaactcgctgtttgatgaagagggatcaaaaattgtcaaggacctgatggccaaggcagagaagaacggtgtgaagattaccttgccagttgacttcatcactgcagacaaatttgatgagcatgcacagactggggaagccacagtggcttcaggcattcctgctggctggatgggcttggactgcggccctgaaagtgttaagaagtttgttgaagttgtgggaagggccaaacaaatagtgtggaacggtccagttggagtctttgaatgggacaagttctccaaaggaaccaaagccctgatggacaaagtggtggaagtaactggaaagggctgcatcaccattattggtggtggagatactgctacatgctgtgcgaagtggaatactgaagataaagttagccacgttagcactggaggtggtgccagcctggaactgctagagggtaaggttcttcctggcgtggatgccttgagcagtgtgtag

SEQ ID NO: 56795 - protein, 417 aa, Gallus gallus; identical to SEQ ID NO: 10457

SEQ ID NO: 56796 - DNA, 1254 bp, Danio rerio
  CDS (1)..(1254)
atgtctctttcgaacaaacttcatttggacaaggtggacgtgaaaggaaagcgggtgatcatgagggtggacttcaatgtccctatgaagaacaatgtgatcacaaataaccagagaatcaaggctgcagtcccatctatccagcactgtttagataattgtgccaaagctgtggccctgatgagccacttgggccggcctgatggagtccctatgccagacaaatactctctggagcctgtggctgcagaactcaagaacctgctgggaaaagacgttcagttcctgaaagactgtgtgggtccagatgtggagaaagcctgtgcagaccctcctgcaggatctgtcattctgctggagaatctgcgctttcatgtggctgaggagggcaagggcaaagatgcatcgggtaacaagaccaaagcaagtcaggcagagatcgatgctttccgagcctccctgtccaaattgggtgacgtatacgtcaacgatgctttcggaactgcacatagagctcacagctctatggttggagtgaatctccctcagaaggctgctggttttctgatgaagaaagagctagactactttgccatggcccttgagaaaccacagaggcctttcttggccatcctcggaggggccaaggtcaaagataagattcagctgatcaacaacatgttggacaaggtgaatgagatgatcattggtggaggaatggcctttaccttcctcaaggttctcaagaacatggagatcggcacttccctgtttgatgaagagggttccacaattgtgaaagacctcatggccaaagcagaaaagaacggtgtaaagatcacacttccagtcgactttatcactgcagacaaatttgatgagaaggcaacaacagggaccgcaacggtagcagaaggtattcctgctggctggatgggtctagactgtggtcctgagagctcaaagctctatgcagaggctgtggccagagccaagcagattgtgtggaacggacccgttggcgtgttcgagtgggacaactttgctcatggaaccaagaacatgatggacaaagttgtagaagcgaccaaaaatggctgcatcaccattatcggtgggggagacacagctacctgctgtgccaagtgggacactgaggacaaggtcagccatgtgagcacagggggcggagccagtctggagctgctggagggtaaagtgctgcccggtgtcgatgccctcagtaacgtataa

SEQ ID NO: 56797 - protein, 417 aa, Danio rerio
MSLSNKLHLDKVDVKGKRVIMRVDFNVPMKNNVITNNQRIKAAVPSIQHCLDNCAKAVALMSHLGRPDGVPMPDKYSLEPVAAELKNLLGKDVQFLKDCVGPDVEKACADPPAGSVILLENLRFHVAEEGKGKDASGNKTKASQAEIDAFRASLSKLGDVYVNDAFGTAHRAHSSMVGVNLPQKAAGFLMKKELDYFAMALEKPQRPFLAILGGAKVKDKIQLINNMLDKVNEMIIGGGMAFTFLKVLKNMEIGTSLFDEEGSTIVKDLMAKAEKNGVKITLPVDFITADKFDEKATTGTATVAEGIPAGWMGLDCGPESSKLYAEAVARAKQIVWNGPVGVFEWDNFAHGTKNMMDKVVEATKNGCITIIGGGDTATCCAKWDTEDKVSHVSTGGGASLELLEGKVLPGVDALSNV

SEQ ID NO: 56798 - DNA, 1257 bp, Magnaporthe grisea 70-15
  CDS (1)..(1257)
atgtctctctctaacaagctctccatcacggacgttgatgtcaaggggaagcgggtgctcatccgtgtcgacttcaacgttcctcttgacgataacaagaacatcaccaacaaccagcgtattgccggcgctgtgccaacaatcaagcatgccctcgacaatggcgccaagacagttatcctgatgtcgcacctcggtcggccaaatggatcgcccaaccccaagtactcgctcaagcctgtcgtgtccgagcttgagaagcttttgggcggcaaaaaggtcaccttcgctcctgactgtgtcggccctgaggtcgaggaaatcgtcaacaaggccggcgagggcgacgtcgtactattggagaacctgcgcttccacatcgaggaggagggcagcgccaaggacaaggagggcaacaagaccaaggctgacaaggccaaggtcgaggagttccgcaagggcctcaccaagttgggagacatttacatcaacgatgctttcggcactgctcaccgtgctcactcttccatggttggcgtcgacctaccccagaaggccgctggtttcctgatgaagaaggagcttgactacttcgcacaggccctcgagtcgcccaagcgccccttcttggccattcttggtggtgccaaggtttcggacaaaatccagctgatcgacaacctgcttgacaaggtcaacacgctcatcgtttgcggtggcatggcctttaccttcaagaaggttctcgacaacatggccattggaaactcgctctttgacgaggcaggatccaagaccgtccctgagctcatgaagaaggcgcaggagaagggcgtcaaggtcgtcctgccggtcgacttcatcactgctgacaagttcgccgcggacgccaagactgggtctgccacggacaaggagggcatccctgagggctggatgggcttggactgcggcgagaagagtgtcgagctgttccagagcgccatcgacgagtcgcagaccgtcctgtggaacggccccgccggtgtctttgagtttgacgctttcgccaagggcaccaaggccactcttgacgctgccgtcagcggctgcggcaagggcaagattgttatcatcggaggtggtgacacagctaccgttgcggccaagtacggagttgaggacaagctgagccacgtctcgaccggcggtggtgccagcttggagctcctcgagggcaaggaactgcctggtgtcaccgcgctcagcagcaagtaa

SEQ ID NO: 56799 - protein, 418 aa, Magnaporthe grisea 70-15
MSLSNKLSITDVDVKGKRVLIRVDFNVPLDDNKNITNNQRIAGAVPTIKHALDNGAKTVILMSHLGRPNGSPNPKYSLKPVVSELEKLLGGKKVTFAPDCVGPEVEEIVNKAGEGDVVLLENLRFHIEEEGSAKDKEGNKTKADKAKVEEFRKGLTKLGDIYINDAFGTAHRAHSSMVGVDLPQKAAGFLMKKELDYFAQALESPKRPFLAILGGAKVSDKIQLIDNLLDKVNTLIVCGGMAFTFKKVLDNMAIGNSLFDEAGSKTVPELMKKAQEKGVKVVLPVDFITADKFAADAKTGSATDKEGIPEGWMGLDCGEKSVELFQSAIDESQTVLWNGPAGVFEFDAFAKGTKATLDAAVSGCGKGKIVIIGGGDTATVAAKYGVEDKLSHVSTGGGASLELLEGKELPGVTALSSK

SEQ ID NO: 56800 - DNA, 1257 bp, Gibberella zeae PH-1
  CDS (1)..(1257)
atgtcgctgtccaacaagctttccatcgccgacgttgacgtcaagggcaagaaggtcctcatccgagtcgacttcaacgtccctctcgacgccgacaagaacatcaccaacaaccagcgaattgtcggtgctctccccaccatcaaatacgccctcgagaatggcgccaagtctgtcatcctcatgtcccacctcggacgccccaacggctcccccaacgagaagtactccctcaagcccgtcgtcgccgagctcgagaagcttctcagcaagaaggtcacctttgcccccgactgtgtcggccccgaggtcgaggagatcgtcaacaaggctgaggatggctctgtcattctcctcgagaacctccgattccacattgaggaggagggctcctccaaagacaaggagggcaacaagaccaaggccgacaaggctcaggttgaggctttccgcaagggtctgaccgctcttggtgacgtctacatcaacgacgctttcggcactgctcaccgtgctcactcttccatggtcggtgtcgatctcccccaaaaggcctccggtttcctcgtcaagaaggagctcgagtacttcgccaaggccctcgagaacccccagcgccccttccttgctattctcggtggtgccaaggtctccgacaagatccagctcatcgacaacctccttgacaaggtcaacaccctcatcatctgcggtggcatggccttcaccttcaagaagacccttgagaacgtctccatcggaaactccctcttcgacgaggccggctccaagaccgtcggtaacctcgttgagaaggccaagcagaagggcgtcaagctcgtcctccccgtcgactacatcaccgccgacaagttcgacaaggatgccaacactggctacgccactgacaaggacggtatccccgacggctggcagggacttgactgcggtgaggagtccgtcaagctctacaaggaggccattgccgatgccaagaccatcctctggaacggtcccgccggtgtctttgagttcgagaagttcgccagcggcaccaaggccactctcgacgccgtcgttgacgctgtccagaaggacggcaagatcgtcatcatcggtggtggtgacactgccaccgttgccaagaagtacggtgttgaggacaagattagccacgtctctaccggcggtggtgccagcttggagctcctcgagggcaaggagcttcccggtgttactgctctgtccagtaagtaa

SEQ ID NO: 56801 - protein, 418 aa, Gibberella zeae PH-1
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGNSLFDEAGSKTVGNLVEKAKQKGVKLVLPVDYITADKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSK

SEQ ID NO: 56802 - DNA, 1251 bp, Ustilago maydis 521
  CDS (1)..(1251)
atgtctctttccagcaagcttggtatcaccgatgtcgacctcaaggacaagaaggtcctgatccgtgtcgacttcaacgtccccatggacggcgacaagatcaccaacaaccagcgtattgtcgctgcccttcccactgtcaagtacgccatcgagcagaatgccaaggctgtcgtgctcatgtcgcacatgggtcgtcccgatggaaagcctgtccccaagtactcgctcaagcccgtcgctgccgaggtatccaagctgctcaacaaggatgtcgaattccttgctgactgcgtcggtgctgagacagagaaggctgtcgagtcggctaccggcggcaagatcttcttgctcgagaacctccgctaccacgttgaggaagagggcaagggcaccaatgaagccggagagaaggtcaaggctgaccccaagaaggtcgaggagttccgtgccagtctcaccaagctcggtgacgtctacatcaacgatgcctttggcacagctcaccgcgcccactcatcgatggttggtgtgcagctgccccaacgtgctgccggtttccttatgaagaaggagctcgagttctttgccaaggcgctcgagagccctgagcgccccttccttgctatcctcggtggtgccaaggtgtcggacaagatccagctcatcgacaacatgctggacaaggtcaactcgctcatcatctgcggtggtatggctttcaccttcaaaaagacgctcgacaatgtcaagattggcacctcgctctttgacgaggccggctcgcacaaagtcgctgagctcgttgagaaggccaagaagaacaacgtcgagctcgtcttccccgtcgactacatcaccgccgacaagtttgacaagaacgccaagaccggttcggccaccgatgccgacggtatccccgatgagtggatgggtctcgatgccggtgaggagtcgcgcaagaagttccgcgagaccattcttaaggccaagaccatcctgtggaacggccccgccggagtctttgagtttgacaactttgccggtggttccaaggccatgcttgacgcctgtctcgaggctgagaagaacggctctactgtcatcgttggaggtggtgacactgccacggtggttgccaagtacggcgctgaggacggcatctcgcactgctcgactggtggtggcgcttcgctggagctgctcgagggcaagaccttgcctggtgtcaaggagctttcggagaagtga

SEQ ID NO: 56803 - protein, 416 aa, Ustilago maydis 521
MSLSSKLGITDVDLKDKKVLIRVDFNVPMDGDKITNNQRIVAALPTVKYAIEQNAKAVVLMSHMGRPDGKPVPKYSLKPVAAEVSKLLNKDVEFLADCVGAETEKAVESATGGKIFLLENLRYHVEEEGKGTNEAGEKVKADPKKVEEFRASLTKLGDVYINDAFGTAHRAHSSMVGVQLPQRAAGFLMKKELEFFAKALESPERPFLAILGGAKVSDKIQLIDNMLDKVNSLIICGGMAFTFKKTLDNVKIGTSLFDEAGSHKVAELVEKAKKNNVELVFPVDYITADKFDKNAKTGSATDADGIPDEWMGLDAGEESRKKFRETILKAKTILWNGPAGVFEFDNFAGGSKAMLDACLEAEKNGSTVIVGGGDTATVVAKYGAEDGISHCSTGGGASLELLEGKTLPGVKELSEK

SEQ ID NO: 56804 - DNA, 1209 bp, Parachlamydia sp. UWE25
  CDS (1)..(1209): transl_table=11
gtgagggtgaaggataaattatcgattcgcgatttaaatttgaaagacaagaaagccttaattcgtgtcgattttaacgtccctttagaaaaaggtttgattacagatgatagtcgtattcaagcctctcttcccacaattcaatatgttttagatcaagaaggagccgttattttgatgagccatctcggtcgtcctaaaggtttgtttgattctaaattttcgttggctccttgtgctaaacgtttatcagaattattaaataagcctgtaaaaatggctgcagattgttgtggattagacgttgaacagatggttcgtcagctaaaatcaggagaagttttattgcttgaaaatttacgttttcacaaaggcgaagaaaggcctgatgatgaacctaattttacaagtgctttgtcagagttgggagatgtttatatcaatgatgcttttggaactgctcatcgtgctcatgcttcgacaacaaaaattgcaaaattttttcccaatcgtgcagcagcgggtttgttacttgaaaaggaaatttcttatctaggttgtgctttaacgaatcctaaacgtcctttttgtgcagtgttaggaggtgcaaaaatttccacaaagtttaaagtcatcgaagctttacagtctaaagcagatgttttattaatagggggagcgatggctttcacttttttcaaatctgaaggaatacctattggggattcgctttacgaaagcgaattcgttgctgtcgctcgtgaattgttaggtgttgagacacagtctcgctgccgccttttactacccatagacttggtcattgctaaaaaaatggatgaatccttcactgaaacgagaattatttcagttaaagaaggaattcctgatgggtatcaaggggtagatattgggccagacactattaaactttatcaagaagaattgaacagagcagctacgattttttggaacggccctttaggagtatttgaagttcctgctttttctaaagggactcaaactattgctcaaactcttgctgttgtcaacgcgattactattgttgggggaggggattccttagctgctatagaacaagctggggtttctaaacaaataaaccatctttcaactggagggggtgcctctttagaatatatagaatttgggcaattacctgggattgaagctctatcagataaataa

SEQ ID NO: 56805 - protein, 402 aa, Parachlamydia sp. UWE25; identical to SEQ ID NO: 10553

SEQ ID NO: 56806 - DNA, 1245 bp, Picrophilus torridus DSM 9790; identical to SEQ ID NO: 10550
  CDS (1)..(1245): transl_table=11

SEQ ID NO: 56807 - protein, 414 aa, Picrophilus torridus DSM 9790; identical to SEQ ID NO: 10551

SEQ ID NO: 56808 - DNA, 1194 bp, Bartonella quintana str. Toulouse; identical to SEQ ID NO: 10542
  CDS (1)..(1194): transl_table=11

SEQ ID NO: 56809 - protein, 397 aa, Bartonella quintana str. Toulouse; identical to SEQ ID NO: 10543

SEQ ID NO: 56810 - DNA, 1188 bp, Acinetobacter sp. ADP1; identical to SEQ ID NO: 10538
  CDS (1)..(1188): transl_table=11

SEQ ID NO: 56811 - protein, 395 aa, Acinetobacter sp. ADP1; identical to SEQ ID NO: 10539

SEQ ID NO: 56812 - DNA, 1164 bp, Erwinia carotovora subsp. atroseptica SCRI1043; identical to SEQ ID NO: 10534
  CDS (1)..(1164)

SEQ ID NO: 56813 - protein, 387 aa, Erwinia carotovora subsp. atroseptica SCRI1043; identical to SEQ ID NO: 10535

SEQ ID NO: 56814 - DNA, 1215 bp, Mesoplasma florum L1; identical to SEQ ID NO: 10536
  CDS (1)..(1215): transl_table=4

SEQ ID NO: 56815 - protein, 404 aa, Mesoplasma florum L1; identical to SEQ ID NO: 10537

SEQ ID NO: 56816 - DNA, 1209 bp, Propionibacterium acnes KPA171202
  CDS (1)..(1209): transl_table=11
atgaaatctgttgaggatctcggagacttgcgcggtaagcgcgtcgtcattcgctgcgacttcaatgtcccgctcgacggggacaagatcaccgacgacggccgtattaaggctgccctgcctactttgacccagctgcatgaggctggcgctcgcaccaccgtgctcgcgcacctcggtcgtcccaagggtgccgtcgatcccaagtactcgctggcgccagttgccaagcgcctcggtgagcttatgaaccttgacgtcaagcttgctggggacgttgttggtccctccgccactaaaacctctgagtcgctggctgatggcgagatcgccttggtcgaaaacgtccgcttcgagaagggcgagaccagtaaggacgaggccgagcgcgctgagctcgctcagaaatacgcctcgtttggtgagttttacgtctccaacggcttcggcgttgtgcaccgcaagcaggcttccgtctacgacgttgccaagctgctgccgagcgctgctggctccctcgttgccaaggaggtagaggtcctcgaaggcctgaccgccgatccgaagcggccgttcgtcgtcgtcctcggtggtgccaaggtcgccgacaagcttgccgtcatcgataacctgctcaaggccgctgacactctcgttattggtggcggtatggcgtacaccttcctcaaggcgaagggtctcgaggtcggtgactccctacttgacgaagattcgatcgacgcgtgcacgaagtatctcgaacaggccaaggctgcaggcaagcagatcctgcttcccgtagacgtgcgagtggtctccgacatcgatttcgaggcccgcactgtcggtcagatcgacgtcgtgcccgctgacgagattccttccgacaagatggcagtagacatcggtccggagaccgagaaggcttacgccaacgcgatcaagggtgccaagtcagtgttctggaacggaccaatgggcgttttcgagatcaagggcctcgagctcggcaccaaggccgtcgcccaggctcttaccgaggttgacggcctttcggtggtcggcgggggagactccgcctccgccgtgcgtaccctcggtttcgccgacgatcagttcggtcatatttctaccggtggtggcgcctccctcgagcttatggagggcaaggagctacccggaatcgcagtactcaaggagaacaactga

SEQ ID NO: 56817 - protein, 402 aa, Propionibacterium acnes KPA171202
MKSVEDLGDLRGKRVVIRCDFNVPLDGDKITDDGRIKAALPTLTQLHEAGARTTVLAHLGRPKGAVDPKYSLAPVAKRLGELMNLDVKLAGDVVGPSATKTSESLADGEIALVENVRFEKGETSKDEAERAELAQKYASFGEFYVSNGFGVVHRKQASVYDVAKLLPSAAGSLVAKEVEVLEGLTADPKRPFVVVLGGAKVADKLAVIDNLLKAADTLVIGGGMAYTFLKAKGLEVGDSLLDEDSIDACTKYLEQAKAAGKQILLPVDVRVVSDIDFEARTVGQIDVVPADEIPSDKMAVDIGPETEKAYANAIKGAKSVFWNGPMGVFEIKGLELGTKAVAQALTEVDGLSVVGGGDSASAVRTLGFADDQFGHISTGGGASLELMEGKELPGIAVLKENN

SEQ ID NO: 56818 - DNA, 1212 bp, Leifsonia xyli subsp. xyli str. CTCB07
  CDS (1)..(1212): transl_table=11
gtggcgcttcgcaccctcgactcactcggttcgctcgcgggcaagcgcgtcgtcgtccgctgtgatctgaacgtccccctgaaggacgggaagatcacggacgacggccgtgtgcgcgcgtccatccccaccctccacgctctcatcgcccagggcgcgaaggtcgcgatcgtctcgcacctgggccgccccgagggcgcgcccgatgcgcagtacagcctggctccggtcgcccagcggctctccgagctgctgggcaagccggtgacctttgccagcgacaccgtcggcgccggtgcggcggaggccgtctccggactggaggacggcgatgtcgctctgctggagaacctccggttcaacccgggggagaccagcaaggacgagggcgagcgtgaggcgtttgccgccgagctcgccgcgttcggcgacgccttcgtctccgacggcttcggcgtcgtccatcgcaagcaggcgagcgtctacgagctggccaaggcgctcccgagcgccgcgggcgcgctcatcgcgaccgagctcgacgtgctcgaccgcctcaccgagaaccctgagcggccctacacggtcctgctcggcggctcgaaggtgtcggacaagctcggcgtcatcggccacctgctgccgcgcgtcgactcgctgctcatcggcggcgggatgctgttcacctttctcgccgcgctcggccaccgggtcggctccagcctcctcgaggcggaccagatcggcaccgtcaagggctacctggagcaggcgaagcagctgggcgtggagatcgtgctgccgcgagatgtcgttgtcgcctccaggttcggcgtggatgcggagcacctcgttcgtcccgtcgaccgcatcgaggacaccgggtggggcacctctggtctcggtctggacatcggaccggagaccgcagaggtgttctcggagcgcatccgcgctgcgcgcacggtgttctggaacggcccgatgggcgtgttcgagctggccccgttcgcggccggaaccaaggccgtggcgcaggcgctcaccgaggtcgacggcctcggcgtcgtcgggggcggtgactcggccgcggcggttcatgcgctcggcttctcggacgaccagttcgggcatatttctaccggtggcggtgcgagcctcgaattccttgagggcaagcgcctgccgggtctggaggttttgggttggtag

SEQ ID NO: 56819 - protein, 403 aa, Leifsonia xyli subsp. xyli str. CTCB07
MALRTLDSLGSLAGKRVVVRCDLNVPLKDGKITDDGRVRASIPTLHALIAQGAKVAIVSHLGRPEGAPDAQYSLAPVAQRLSELLGKPVTFASDTVGAGAAEAVSGLEDGDVALLENLRFNPGETSKDEGEREAFAAELAAFGDAFVSDGFGVVHRKQASVYELAKALPSAAGALIATELDVLDRLTENPERPYTVLLGGSKVSDKLGVIGHLLPRVDSLLIGGGMLFTFLAALGHRVGSSLLEADQIGTVKGYLEQAKQLGVEIVLPRDVVVASRFGVDAEHLVRPVDRIEDTGWGTSGLGLDIGPETAEVFSERIRAARTVFWNGPMGVFELAPFAAGTKAVAQALTEVDGLGVVGGGDSAAAVHALGFSDDQFGHISTGGGASLEFLEGKRLPGLEVLGW

SEQ ID NO: 56820 - DNA, 1179 bp, Desulfotalea psychrophila LSv54
  CDS (1)..(1179): transl_table=11
atgaagtcgttacgtgaattggaactcgccggtaagcgagtcttggtacgggtggattttaatgtgccgatggatgataagcaacgaataaccgacgatattcgtattcgtatggttcttcccaccctacgctatgtgcttgaacagggtggccgcttaattatctgttctcatatgggtaggcccaagggcaagcgagttgaggagtatagtcttgctcccatagcccgtcatcttgcaggtctgctaggcagagatgtcggcattgctccggattgtattggtgctgaggtggaggcgcaggtggcagcccttggcgtaggcgaggtgcttcttttgcaaaaccttcgtttttacggcgaagaaacggaaaatgatgccgtctttgccggtaagcttgcaggacttgccgatgtctatgtaaatgatgcctttgccgtatctcatcgagcccatgcctccgtggttggagttgccgagcgggtagctgaaaaatgtgccggctttctcctgcagacagagatagattattttcataaatcgatgaatgaccccattcgtcccctggtggccctggtgggtggagccaaggtctcctctaagataggtgccctggaaaatatgcttggtaaggtcgataagatgattattggcggtgccatggccaataccttcttaatgagtcagggcgtcgatgttggtgcctcaaaggtggaggatgacctgcttgtcaccgccaggaattttctgcaggcagcaggggagcgggggatgaaggtctatcttcccgttgattttgtggttgcagatcgttttgccgccgatgcggtgcacaagactgtgcccgccgatagtgttccggagggttggatggccctcgatgtcggcccggcaagtagtattctctttcgagaggccctgcagggtgccggtaccatcgtctggaatgggcccatgggcgcttttgagatggatgcctttgccggagggaccatgagtctctgtcgtgatgttgccgcttcgcaggcgctttcgatcactggtggtggggattctaatgccgcagtgaagaaatcaggcgaggcagataatatctcctatatgtccaccggtggaggggccttcttgcagttgatggaggggaaaaccctacctggggtggatgccttggaagcataa

SEQ ID NO: 56821 - protein, 392 aa, Desulfotalea psychrophila LSv54
MKSLRELELAGKRVLVRVDFNVPMDDKQRITDDIRIRMVLPTLRYVLEQGGRLIICSHMGRPKGKRVEEYSLAPIARHLAGLLGRDVGIAPDCIGAEVEAQVAALGVGEVLLLQNLRFYGEETENDAVFAGKLAGLADVYVNDAFAVSHRAHASVVGVAERVAEKCAGFLLQTEIDYFHKSMNDPIRPLVALVGGAKVSSKIGALENMLGKVDKMIIGGAMANTFLMSQGVDVGASKVEDDLLVTARNFLQAAGERGMKVYLPVDFVVADRFAADAVHKTVPADSVPEGWMALDVGPASSILFREALQGAGTIVWNGPMGAFEMDAFAGGTMSLCRDVAASQALSITGGGDSNAAVKKSGEADNISYMSTGGGAFLQLMEGKTLPGVDALEA

SEQ ID NO: 56822 - DNA, 1182 bp, Borrelia garinii PBi
  CDS (1)..(1182): transl_table=11
atgtcaataaaaacagtaaaagactttaatagctttgcgggcaagcgagctttagtaagatgtgattttaatgttcccctaaaagaggggaacattagcgatgatactagaattaaggctgcattgcccacaatagaatacctgaaagaaaaaggagctagaattgtacttataagtcatttgggtagaccagagggcaaaaaaaatcttaaatattctcttaaacctgttgccaataaattgtcagagcttttgggccaggatgtcaagatgctttctgattgcattggaagagaaattgtaaataatactttacaaatgaaagatggtgatgttgtattgcttgaaaatgtaaggttttatgcggaagaagagaaaaacgataaaaattttgcaaaaaaactttctgagaatggagatgtttttgtaaatgatgcctttggtgcagctcatagggctcatgcttcaacggtgggggtttctgattatttaccatctgttggtggatttttaatggagaaagaagacaaatttcttggagaagtattaaaaaatcccgaaagaccatttgtttcgattattggtgggtctaaggtttcttcaaagattgcagtactggaatcacttttatcaaagtcaaatgtagttgtgattggcggtggaatggcctatacttttttacattccaaaggatattctataggcaaatctcttttagagagcgaatatattgatatagcttcttcttttttaaagaaagcaaaagagttggatgttaaagtaattttaccgcttgatcacattgtagcggacgattttaataaaaattctactcctgagtatattgattcctttgatattcctgaaaataagattggcatggatgttggaggtaagactttaaaagaaatcgaaaaggttataaaaactgctaagactataatttggaatggccctcttggtgtatttgaatttgattcattttcaaaaggaactgcaatggttgccgaaatggtagcatcttgcgcaggtttaactattgttggtggtggagattctgttgcagctgttaataaatttaatttatctgataagatcactcatgtttcaacaggtggcggtgcatcacttgaatatcttgaaggaaagattttaccaggtattaaggttttggagaagtaa

SEQ ID NO: 56823 - protein, 393 aa, Borrelia garinii PBi
MSIKTVKDFNSFAGKRALVRCDFNVPLKEGNISDDTRIKAALPTIEYLKEKGARIVLISHLGRPEGKKNLKYSLKPVANKLSELLGQDVKMLSDCIGREIVNNTLQMKDGDVVLLENVRFYAEEEKNDKNFAKKLSENGDVFVNDAFGAAHRAHASTVGVSDYLPSVGGFLMEKEDKFLGEVLKNPERPFVSIIGGSKVSSKIAVLESLLSKSNVVVIGGGMAYTFLHSKGYSIGKSLLESEYIDIASSFLKKAKELDVKVILPLDHIVADDFNKNSTPEYIDSFDIPENKIGMDVGGKTLKEIEKVIKTAKTIIWNGPLGVFEFDSFSKGTAMVAEMVASCAGLTIVGGGDSVAAVNKFNLSDKITHVSTGGGASLEYLEGKILPGIKVLEK

SEQ ID NO: 56824 - DNA, 1179 bp, Symbiobacterium thermophilum IAM 14863
  CDS (1)..(1179): transl_table=11
atggcgctgatgaccgtacgcgacatcgatgtcaagggcaagcgcgtgttcgtgcgtgtcgacttcaacgtcccgctggaagatggtcggatcacggatgacacccggatcagggcggccgtgcccaccatccggtacctggtggaggaaggggcggtcgctgtgctggcgtcgcacctgggccggcccaagggccagcggaacgagaagtactccctcgccccctgtgcccggcgcctgtccgagctgctgggccgggaggtcgtgttcgcccccgactgcatcggcgaggaggtcgagcggctggtggccgaacagccgcccgggtccgtggtcctgctcgagaacgtccgtttctacgcggaggaggagaagaacgaccccgagttcgccgcgaagctcgcgcgcctcggcgagatcttcgtcaacgacgcctttggcaccgcgcaccgggcgcacgcctcgacccggggggtggccgaccacatgccggttcgggtggcaggcttcctcatgcagaaagaggtcgacatcatgggcaaggccctgtccgaccccgaccggcccttcgtggcgatcatcggcggcgccaaggtctcggataagattatggtgatcgagaacctgttgaccaaggtcgaccggctcatcatcggcggcggcatggccaacaccttcctgcgggccaggggcttcgccaccggcaagtcgctggtggaggaggaccgggtcgacaccgcccgggagctgctggccaagggcggcgacaagatcctcctgcccaccgatctggtggtcgcctcggagttcaaggccgacgccgagcagaaggtcgttccggtggacgccatccccgagggctggatggccctggacatcgggccggagaccgcccgggcctttgccgacgtgatccgcggggctcacaccgtcgtgtggaacggcccgatgggcgtgtttgagatggagcccttcgcgcgcggcaccttcgcggtcgcccaggcgatggcggactgcgagggcgtgacgatcgtgggcggcggcgactccgtggcggctgtcgaggcggcgggcctggccgatcgcatgacccacgtctccacgggcggcggcgcctcgctggagttcctggaggggaaggaactgcccggcgttgcctgcctcgctgtgaagccgtga

SEQ ID NO: 56825 - protein, 392 aa, Symbiobacterium thermophilum IAM 14863
MALMTVRDIDVKGKRVFVRVDFNVPLEDGRITDDTRIRAAVPTIRYLVEEGAVAVLASHLGRPKGQRNEKYSLAPCARRLSELLGREVVFAPDCIGEEVERLVAEQPPGSVVLLENVRFYAEEEKNDPEFAAKLARLGEIFVNDAFGTAHRAHASTRGVADHMPVRVAGFLMQKEVDIMGKALSDPDRPFVAIIGGAKVSDKIMVIENLLTKVDRLIIGGGMANTFLRARGFATGKSLVEEDRVDTARELLAKGGDKILLPTDLVVASEFKADAEQKVVPVDAIPEGWMALDIGPETARAFADVIRGAHTVVWNGPMGVFEMEPFARGTFAVAQAMADCEGVTIVGGGDSVAAVEAAGLADRMTHVSTGGGASLEFLEGKELPGVACLAVKP

SEQ ID NO: 56826 - DNA, 1170 bp, Mannheimia succiniciproducens MBEL55E
  CDS (1)..(1170): transl_table=11
atgtcagtaatcaaaatgaccgatcttgatttagccggcaaacgtcttttcatccgcgccgatttaaacgtgccggtaaaagacggcaaagtgacttcagatgcgcgtatccgcgcaacaattcctactttaaaattagccttggaaaaaggcgccaaagtgatggtaacttctcacttgggccgtccgactgaaggtgaattcaaacctgaagactcattacaaccggtagttgattacttaaaagatgcaggatttaacgtacgcctagcacaaaactacttagacggcgttgaagtaaacgaaggcgaaatcgttgtattggaaaacgttcgtatcaacaaaggcgaaaagaaaaacgatcctgaattgggtaaaaaatatgccgcactttgcgacgtattcgtaatggatgcttttggtacggctcaccgtgcgcaggcttcaacttacggtgttgccgaatatgcgccggttgcttgcgcaggcccgttattagcggctgaattggatgctttgggtaaagccttaaaagaacctcaacgtcctatgcttgcaattgtaggcggttcaaaagtgtctactaaattaactgttttagacagcctttcaaaaattgccgatcaattaatcgtgggcggcggtattgccaatacctttattgccgctgaaggccataacgtcggtaaatctttatatgaagaagatttaattcctgaagcaaaacgtttagcggcagcaactaatatccctgttcctgtggatgtgcgtgtgggtacggaattctctgaaaatgcgccggcaaccgaaaaatcggtaaccgaagttcaagccgacgaatcaattttcgatatcggcgataaatccgcagaagaattggcgaaaattatcaaatccgctaaaaccattctttggaacggtccggtgggcgtgtttgaattccctaatttccgtaaaggtaccgaagtgatttctaacgcgattgcggaagcgactgcaaacggcgcattttctatcgccggtggcggtgataccttagccgctatcgatttattcggtatcaaagataaaatttcttatatttcaaccggcggcggtgcgttcttagaatttgttgaaggtaaggttttacctgcggtggaaatcttagaaaaacgtgcaaacggctaa

SEQ ID NO: 56827 - protein, 389 aa, Mannheimia succiniciproducens MBEL55E
MSVIKMTDLDLAGKRLFIRADLNVPVKDGKVTSDARIRATIPTLKLALEKGAKVMVTSHLGRPTEGEFKPEDSLQPVVDYLKDAGFNVRLAQNYLDGVEVNEGEIVVLENVRINKGEKKNDPELGKKYAALCDVFVMDAFGTAHRAQASTYGVAEYAPVACAGPLLAAELDALGKALKEPQRPMLAIVGGSKVSTKLTVLDSLSKIADQLIVGGGIANTFIAAEGHNVGKSLYEEDLIPEAKRLAAATNIPVPVDVRVGTEFSENAPATEKSVTEVQADESIFDIGDKSAEELAKIIKSAKTILWNGPVGVFEFPNFRKGTEVISNAIAEATANGAFSIAGGGDTLAAIDLFGIKDKISYISTGGGAFLEFVEGKVLPAVEILEKRANG

SEQ ID NO: 56828 - DNA, 1191 bp, Legionella pneumophila subsp. pneumophila str. Philadelphia 1
  CDS (1)..(1191): transl_table=11
atgaacctgattaaaatgagcgacattgatctgtctggcaaaagagttctgattcgtgaggatttaaatgtcccgatcaaagacggtatgattaccagtgatcaaagattgcaagcggccctgcctacaatcaaatccgctttggacagtggcgcagcagtaatcgtattgtctcatcttgggcgtccggaggaaggcaaatacgaaaaaaaattctctttggagcctgttgctgattatttaagggaaaacctggaatatcctgttcgcttcgtcaaagattacctgagcggcgtgggtgtaaaccctggggaattggtcgtatgcgaaaatgtccgatttaatcccggtgaaaaagccaatgacgaagctttggcaaaaaaactggcaagcctttgtgatgtctttgtcatggatgcttttggcacggcacacagggcacaagcgtctacctatggtgtcgctcaatatgctccagttgccgttgctggtcctctgctaatccgtgaacttgaagcgttaaaccaagtgcttaaagcgcctaaaaaacctatcgtcgctattgttggaggagccaaagtctcatccaagctcagtctattgaaacaattggtgggtatggttgatgttcttatccctggcggcggtattgccaatacttttctgaaagcccaagggtttgaaattggtatttccctttacgaacctgatttattggatgaggctcgccatatccttattctggccaaagagaaaggttgccaaattcctctacccaccgacgttgtagtaggcaaaacatttagtgaaacctgccctgctttcaacaaatctctgtctaatgtggctgcggacgatatgatccttgatattggcccagaaaccataagagattatgtagacctcatccatgacgccaacaccatcatctggaatggtccggttggtgtattcgaattcccgcagtttgcttatggaactagagccattgctatagcgattgccgagagtgatgccttttctattgctggtggtggtgataccttggctgctgttgatctttatgatttgaatcaacaaatttcttatatttccacaggaggtggggcatttctcgaatgtctggaaggaaaaaccttgcctgctgttgctattttgcaggagcgcgcaaaacatgttaagacgaactaa

SEQ ID NO: 56829 - protein, 396 aa, Legionella pneumophila subsp. pneumophila str. Philadelphia 1
MNLIKMSDIDLSGKRVLIREDLNVPIKDGMITSDQRLQAALPTIKSALDSGAAVIVLSHLGRPEEGKYEKKFSLEPVADYLRENLEYPVRFVKDYLSGVGVNPGELVVCENVRFNPGEKANDEALAKKLASLCDVFVMDAFGTAHRAQASTYGVAQYAPVAVAGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAADDMILDIGPETIRDYVDLIHDANTIIWNGPVGVFEFPQFAYGTRAIAIAIAESDAFSIAGGGDTLAAVDLYDLNQQISYISTGGGAFLECLEGKTLPAVAILQERAKHVKTN

SEQ ID NO: 56830 - DNA, 1260 bp, Bacteroides fragilis YCH46
  CDS (1)..(1260): transl_table=11
atgcagacaattgacaatttcaattttgccggtaaaaaggcattcgttcgcgtggacttcaatgtacccttggacgaaaacttcaacattacagacgacactcgtatccgtgctgcacttcctaccctgaagaagattctggcagacggtggtagcatcatcatcggttctcacctgggccgtccgaaaggcgttgctgacaaattctctctgaaacacattgttaagcatgtatcagagttactgggcgttgaagttcagtttgccaacgactgtatgggcgaagaagctgctgtaaaagccgctgctctgcaaccgggcgaagtgctgttgcttgaaaaccttcgcttctacgctgaagaagaaggcaaaccaagaggattggctgaagacgcaaccgacgaagaaaaagccgcagccaagaaagccgtaaaagagagccagaaagaatttaccaagaaattggcttcgtatgcagactgctacgtaaacgacgcattcggtacagctcaccgtgctcatgcttctacagcactgatcgctaaatacttcgacaccaacaataagatgtttggctacctgatggaaaaagaagtgaaagccgttgataagatattgaacgacatcaagcgtccgtttactgccatcatgggtggatcaaaagtatcttctaagatcgaaatcatcgaaaacctgctgaacaaggtagacaacctgatcatcacaggcggtatgacttacactttcaccaaagcaatgggtggacagatcggtctgtctatctgcgaagatgacaaactggatctggctcgcgaactgatgcagaaagccaaagacaaaggtgtaaatctggtattagctgttgacgctaagattgctgacgctttctctaacgatgccaatactaaattctgcccggttaacgaaattcctgacggatgggaaggtcttgacatcggtccgaaatctgaagagatctttgccgaagtgatcaagaattctaagacaattctttggaatggtccgacaggtgtattcgaattcgaaaacttcactcacggctctcgttcagtaggcgaagctatcgttgaagctactaagaacggcgctttctcactcgttggcggtggcgactctgtagcttgtgtcaacaagttcggtctggcagacggtgtatcttatgtttctacaggcggtggagcactgctcgaagcaatcgaaggaaaagttcttccgggtattgccgctatccaggaataa

SEQ ID NO: 56831 - protein, 419 aa, Bacteroides fragilis YCH46
MQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLADGVSYVSTGGGALLEAIEGKVLPGIAAIQE

SEQ ID NO: 56832 - DNA, 1194 bp, Burkholderia mallei ATCC 23344
  CDS (1)..(1194): transl_table=11
atgagccaagtaaagcgtcttaccgacctgatcgccgaaggcaagctgtccggcaaacgcgtgttcatccgcgccgatctgaacgtgccgcaggacgatcacggcaacatcaccgaagacacgcgcgtgcgcgcgtcggtgcccgcgatccaggcggcgctcgacgcgggcgcggccgtgatggtcacgtcgcacctcggccgcccgacggaaggcgagttcaagcccgaggattcgctcgcgcccgtcgcgaagcgcctggccgagctgctcggccgcgatgtgccgctcgtcgcgaactgggtcgagaacggggtcgaggtcgcgcccgggcaggtcgtgctgctcgagaactgccgcgtgaacaagggcgagaagaagaactcggacgagctcgcgcagaagatggcgaagctctgcgacgtctacgtgaacgacgcgttcggcaccgcgcaccgcgcggaggcgaccacccacggcatcgcgaagtacgcccccgtcgcgtgcgcgggtccgctgctcgcggccgagctcgacgcgctcggcaaggcgctcggcaacccgaagcgcccgctggtggcgatcgtcgcgggctcgaaggtgtcgacgaagctgacgatcctgaagtcgctcgcggagaaggtcgatcaattgatcgtcggcggcggcatcgcgaacacgttcatgctcgcggcggggcttgcgatcggcaagtcgctcgccgaggccgatctcgtcggcgaggcgaaggcgatcatcgacgaagcccgcaagcgcggcgcgtcggtgccgatcccgaccgacgtcgtcgtcgcgaaggaattctcgccgacggccgccgccaccgtgaagaaggtcgccgacatcgaagccgacgacatgatcctcgacatcggcccggacaccgcgaaggcgctcgccggccagctcgagaaggcgggcacgatcgtctggaacggcccggtcggcgtgttcgagttcgaccagttcggcaacggcacgaagacgctcgccgacgcgatcgcgagctcggccgcgttctcgatcgcgggcggcggcgacacgcttgccgcgatcgcgaagtacggcatccacgacaaggtcagctacatctcgacgggcggcggcgcgttcctcgaattcctcgagggcaagaagctgcccgccgtcgaagtgctggaaacgcgcgcgtaa

SEQ ID NO: 56833 - protein, 397 aa, Burkholderia mallei ATCC 23344
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGPDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 56834 - DNA, 1194 bp, Burkholderia pseudomallei K96243
  CDS (1)..(1194): transl_table=11
atgagccaagtaaagcgtcttaccgacctgatcgccgaaggcaagctgtccggcaaacgcgtgttcatccgcgccgatctgaacgtgccgcaggacgatcacggcaacatcaccgaagacacgcgcgtgcgcgcgtcggtgcccgcgatccaggcggcgctcgacgcgggcgcggccgtgatggtcacgtcgcacctcggccgcccgacggaaggcgagttcaagcccgaggattcgctcgcgcccgtcgcgaagcgcctggccgagctgctcggccgcgatgtgccgctcgtcgcgaactgggtcgagaacggggtcgaggtcgcgcccgggcaggtcgtgctgctcgagaactgccgcgtgaacaagggcgagaagaagaactcggacgagctcgcgcagaagatggcgaagctctgcgacgtctacgtgaacgacgcgttcggcaccgcgcaccgcgcggaggcgaccacccacggcatcgcgaagtacgcccccgtcgcatgcgcgggcccgctgctcgcggccgagctcgacgcgctcggcaaggcgctcggcaacccgaagcgcccgctggtggcgatcgtcgcgggctcgaaggtgtcgacgaagctgacgatcctgaagtcgctcgcggagaaggtcgatcaattgatcgtcggcggcggcatcgcgaacacgttcatgctcgcggcggggctcgcgatcggcaagtcgctcgccgaggccgatctcgtcggcgaggcgaaggcgatcatcgacgaagcccgcaagcgcggcgcgtcggtgccgatcccgaccgacgtcgtcgtcgcgaaggaattctcgccgacggccgccgccaccgtgaagaaggtcgccgacatcgaagccgacgacatgatcctcgacatcggccaggacaccgcgaaggcgctcgccggccagctcgagaaggcgggcacgatcgtctggaacggcccggtcggcgtgttcgagttcgaccagttcggcaacggcacgaagacgctcgccgacgcgatcgcgagctcggccgcgttctcgatcgcgggcggcggcgacacgctcgccgcgatcgcgaagtacggcatccacgacaaggtcagctacatctcgacgggcggcggcgcgttcctcgaattcctcgagggcaagaagctgcccgccgtcgaagtgctggaaacgcgcgcgtaa

SEQ ID NO: 56835 - protein, 397 aa, Burkholderia pseudomallei K96243
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGQDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 56836 - DNA, 1176 bp, Methylococcus capsulatus str. Bath
  CDS (1)..(1176): transl_table=11
atggctttcaaacgcatgaccgacatcgatctcgccggcaagcgcgtcctgatccgggaagacttcaacgtccccgtcaaagatggccgggtcaccagcgacgcccgcatccgcgccgccctcccgaccatccgccacgcgctggacgccggcgctgcggtgatgctgatgtcgcatctcggccgccccaccgaaggggaatatgccgaggagttttccatgaaacccgttgccgaccggctgtccgaactattggggcagccggtgacactggtgaaggactacctgggtggcgccgacccggcggtcgggtcggtcgtgctattcgagaacgtgcgtttcaacaagggcgagaagaaggacgacgaggtcttggcgcgccagctcgccgcgctgtgcgacgtctacgtgatggatgccttcggtacggcgcaccgcgccgaggcttcgacgcacggcgtgggcaaatacgctcccaccgcctgtgccggcctgctgctggcgacggaattggatgcactgggcagagcgctccacgacccggcgcgccccttggtcgccatcgtcggcggctcgaaagtatcgaccaaactgacggttctggattccctttcgcaggtggtcgatcagctcatcgtcggtggcggtatcgccaacaccttcatcaaagccgccggcttcaatgtcgggaaatcactgtacgaggaggacctggtggccgaagccaggcgcctgatggaagccgccaaggccaagggcggggagatccccgtaccggtcgacgtggtggtcggcaaacgcttcgatgccgcggaacccgccatggtcaagagcgtcgcagacatcgccgaggacgacatgatcctcgacatcggtccggagaccagccgccgctacgccgagttcatcggccgcgccggcacggtggtctggaatggccccgtaggtgtcttcgaattcgaccagttcggggaaggcacccgccgattgggtctggccatcgccgaaagccatgcattttccatcgccggagggggagacacactggcagccatcgacaaatacggcatcgccgaccgcatctcctacatctcgacggggggcggcgccttcctggaatttctcgaaggcaagcaactgccggcggttgccatgctggagagccgcgcggactga

SEQ ID NO: 56837 - protein, 391 aa, Methylococcus capsulatus str. Bath
MAFKRMTDIDLAGKRVLIREDFNVPVKDGRVTSDARIRAALPTIRHALDAGAAVMLMSHLGRPTEGEYAEEFSMKPVADRLSELLGQPVTLVKDYLGGADPAVGSVVLFENVRFNKGEKKDDEVLARQLAALCDVYVMDAFGTAHRAEASTHGVGKYAPTACAGLLLATELDALGRALHDPARPLVAIVGGSKVSTKLTVLDSLSQVVDQLIVGGGIANTFIKAAGFNVGKSLYEEDLVAEARRLMEAAKAKGGEIPVPVDVVVGKRFDAAEPAMVKSVADIAEDDMILDIGPETSRRYAEFIGRAGTVVWNGPVGVFEFDQFGEGTRRLGLAIAESHAFSIAGGGDTLAAIDKYGIADRISYISTGGGAFLEFLEGKQLPAVAMLESRAD

SEQ ID NO: 56838 - DNA, 1233 bp, Nocardia farcinica IFM 10152
  CDS (1)..(1233): transl_table=11
atggctgtcaagacactccaggatctcctgaacgagggtgtcgaaggtcggggcgtgctggtgcgctccgacctgaacgtccccctcgacgacaacgggcagatcaccgatcccggccgcatcatcgcctcgatcccgacgctgaaggccctggtcgaggcgggcgccaaggtggtcgtcaccgcgcacctcggccgtcccaagggcgagccggacccgaagttctcgctcgcgccggtggcggcgaagctggccgaactgctcggccgcaacgtgcagctggccggtgacgtggtgggctacgacgcgctctcgcgctcggagggcctcaccgacggtgacgtgctgctgctggagaacgtgcgtttcgatccgcgcgagaccagcaaggacgaggccgagcgcggcaagctcgcggcggccctggtcgagctggtcggcgaggacggcgcgttcgtctccgacggtttcggcgtggtgcatcgcaagcaggcctcggtctacgacgtggccaagttgctgccgcactacgcgggcacgctggtcgccgccgaggtggacgtgctggccaagctcaccgacaacaccgagcggccctacgccgtggtgctgggcggctcgaaggtctccgacaagctcgccgtcatcgaggcgctggcgcccaaggtcgacaccctggtgatcggcggcggcatgtgcttcaccttccttgccgcacagggcctttcggtcggctcctcgctgctgcaggaggagatgatcgacacctgcaaggggctgctcgagcggtacgccgacgtcatccacctgccgcgcgacgtggtggtcgccgactcgttctccgccgacgcggagtcgaagtgcgtgccggccaacgagatcccggacggctggatgggtctggacatcggcgcggagtcggtggaccggttcgcggcgctgctgaccgaggccaagacggtgttctggaacggcccgatgggcgtgttcgagttcgagaagttcgccgcgggcacccgcggggtcgccgaggcgatcgtggcggccaccggcaagggggcgttcaccgtcgtcggcggcggcgactcggccgcggcggtccgcgcgctcggcctgcccgaggacggtttctcgcacatctccaccggcggcggcgcgtcgctggaatacctggagggcaaggaacttcccggcatcagtgtcctcgaggacaccgctccggagggcagctga

SEQ ID NO: 56839 - protein, 410 aa, Nocardia farcinica IFM 10152
MAVKTLQDLLNEGVEGRGVLVRSDLNVPLDDNGQITDPGRIIASIPTLKALVEAGAKVVVTAHLGRPKGEPDPKFSLAPVAAKLAELLGRNVQLAGDVVGYDALSRSEGLTDGDVLLLENVRFDPRETSKDEAERGKLAAALVELVGEDGAFVSDGFGVVHRKQASVYDVAKLLPHYAGTLVAAEVDVLAKLTDNTERPYAVVLGGSKVSDKLAVIEALAPKVDTLVIGGGMCFTFLAAQGLSVGSSLLQEEMIDTCKGLLERYADVIHLPRDVVVADSFSADAESKCVPANEIPDGWMGLDIGAESVDRFAALLTEAKTVFWNGPMGVFEFEKFAAGTRGVAEAIVAATGKGAFTVVGGGDSAAAVRALGLPEDGFSHISTGGGASLEYLEGKELPGISVLEDTAPEGS

SEQ ID NO: 56840 - DNA, 1194 bp, Rhodobacter sphaeroides 2.4.1
  CDS (1)..(1194)
atgggctggaagacactcgacgacatggatcttgccggcaaggtcgtgctggtgcgcgtggatgtgaacgtgccgatggaaaatggcgaagtcaccgacgccacccggatcgagaagatcgtccccaccgtcgaggatatcctgaagaagggcggcaagcccgtcctgctcgcccatttcggccgtccgaagggcaaggtcgtggacgagatgagcctccgcctcgtgctgcccgcgctgcagaacgcgctgcctggcaccaaggtgagctttgccgccgactgcgtgggccccgagcccgagcaggcggtggccgccatgctcgagggcgaggtgctcctcctcgagaacacccgcttccatgccggcgaggagaagaacgaccccgagctggccgccgcgatggcgaagctggggcaggtctatgtcaacgatgccttctcggccgcgcaccgcgcccatgcctcgaccgagggcctcgcccgtcttctgccctcggccgccggccggctgatggaggccgagctgaaggcgctcgaagccgctctcggccatcccgagcgccccgttgtggccgtggtgggcggggccaaggtctcgaccaagctcgaccttctgggcaatctcgtgggccgggtcgatcatctggtgatcggcggcggcatggccaacaccttcctcgtggcgcaggggatcgaggtcggcaagtcgctggccgagcgcgacatggccgatacggcgcgcgagatcctctccaaggcgaaggccgcgggctgcacgatccatcttccgctcgatgtggtggtggcgcgcgagttcaaggcgggggccgcgaacgagacggtcgagacggcggcctgcccggccgacgcgatgatcctcgatgccggtccgaagaccgtggccgccctctccgaagtgttcgcctcggctaagacgctgatctggaacggcccgctcggcgccttcgagatcgagcccttcgacgccgcgacgaatgcggcggcgcttcaggtggcgcagctcaccaaggcgggccagctcatttcggtcgcgggcggcggcgatacggtggccgccctcaacaaggcgggcgcggccgaaggcttctcctacatctcgacggcgggcggtgccttcctcgaatggatggagggcaaggagctgcccggagtggccgcgctcacggtctga

SEQ ID NO: 56841 - protein, 397 aa, Rhodobacter sphaeroides 2.4.1
MGWKTLDDMDLAGKVVLVRVDVNVPMENGEVTDATRIEKIVPTVEDILKKGGKPVLLAHFGRPKGKVVDEMSLRLVLPALQNALPGTKVSFAADCVGPEPEQAVAAMLEGEVLLLENTRFHAGEEKNDPELAAAMAKLGQVYVNDAFSAAHRAHASTEGLARLLPSAAGRLMEAELKALEAALGHPERPVVAVVGGAKVSTKLDLLGNLVGRVDHLVIGGGMANTFLVAQGIEVGKSLAERDMADTAREILSKAKAAGCTIHLPLDVVVAREFKAGAANETVETAACPADAMILDAGPKTVAALSEVFASAKTLIWNGPLGAFEIEPFDAATNAAALQVAQLTKAGQLISVAGGGDTVAALNKAGAAEGFSYISTAGGAFLEWMEGKELPGVAALTV

SEQ ID NO: 56842 - DNA, 1212 bp, Lactobacillus gasseri
  CDS (1)..(1212)
atggctaaattaatcgtttcagaccttgatcttaaaggtaaaaaagttttagttcgtgttgactttaatgttccaattaaaaatggtgttattggtgatgacaaccgtatcgttgctgcattgccaactattaagtacattattgaacatggtggtaaagcaatcttactcagtcacttaggccgtgtaaagtcagatgctgacaagaaggaattatcattacgtccagtagcagaacgcttaagtgagttattaaagaagcctgtaacttttgtaccagaaaatgaaggtaaagaagttgaagaaaccatcgataaaatgaaagatggcgacgttattgttcttgaaaacactagattccaagatattgacaatgactttggtaaacgtgaatctaagaacgatccaaaacttggcgaatactgggcaagtcttggcgatgtatttgtaaacgatgcatttggtactgctcacagaagtcacgcttcaaatgtaggtatcgcaactgctatgaagaaggctggtaaacctgcagcagctggtttcttacttgaaaaagaaatcaagttcttaggtgatgctgttgaaaacccagttcacccatttgtaactatccttggcggtgcaaaagtatcagacaagattggtgttattgaaaacttaattcctaagtcagatcacattttaattggtggtggtatggcttacacattcttagctgcacaaggccacaagattggtaaatcattatttgaagctgataaagttgaacttgcaaaagaattattagcaaaagctggcgataagattgtattgcctgtagataatgtcgcagcaactgaattctcaaacgatgcacctcacgaagttgttggtgatgatattcctgataacgaaatgggtcttgacattggtcctaagactgttgagaaatttagagacatcttaaaggatgctaagaccgtcgtatggaacggacctatgggtgcattcgaaatgccaaactacgcagaaggtaccttggaagttggtcgcgcattagctgatttgaaagatgccgttactattatcggtggtggtgactcaactgctgctgctaagcaattgggaattgctcctaagatcagccacatttctactggtggtggtgcttcacttaactaccttgaaggtaaagaattaccaggaatcgcttgtgtttctgacaagtaa

SEQ ID NO: 56843 - protein, 403 aa, Lactobacillus gasseri
MAKLIVSDLDLKGKKVLVRVDFNVPIKNGVIGDDNRIVAALPTIKYIIEHGGKAILLSHLGRVKSDADKKELSLRPVAERLSELLKKPVTFVPENEGKEVEETIDKMKDGDVIVLENTRFQDIDNDFGKRESKNDPKLGEYWASLGDVFVNDAFGTAHRSHASNVGIATAMKKAGKPAAAGFLLEKEIKFLGDAVENPVHPFVTILGGAKVSDKIGVIENLIPKSDHILIGGGMAYTFLAAQGHKIGKSLFEADKVELAKELLAKAGDKIVLPVDNVAATEFSNDAPHEVVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 56844 - DNA, 1218 bp, Magnetospirillum magnetotacticum MS-1
  CDS (1)..(1218)
atgttccggaccatcgacagcttcgacgtcaagggcaagcgggtgctggtgcgcgccgatctcaacgttccggccaaggacggcaaggtcaccgataccacccgtatcgaccgctccgccgccaccttgaaggagctggcgggcaagggcgccaaggtcatcgtactgacccatttcggccgccccaagggccgtgacgccaagtactcccagaagctgctggtcgagccgctggcgcgggcggtgggacagcccgtcctgtgggccgatgactgcatcggcgtcgaggtcgagcagatgatcgccaagatgaaggacggcgagatcgcccttttggaaaacgtccgcttctacgagaacgaggaagagaacgacatcggctttgccaagatgctggccggtctcggcgatatctatgtcaacgacgccttctcgaccgcgcaccgcgcccatgcttccaccgaaggcgtggcccatctactgccctgtgccgccgggcgtctgatgcaggccgagttggaagcgctgggcaaggcgctggaacatcccgagaagcccgtggccgccatcgtcggcggcgccaaggtctccaccaagctggacctgctgggcaatctggtggcccgcgtcgattacctgatcatcggcggcggcatggccaacaccttcctgttcgcccagggcaagcaggtgggcaagtccttgtgcgagaaggatctggccgacaccgcgcgcgagattctggaaaaggccaaggccgcccattgccatatcgtcctgccggtcgatgccgtggtggcgggggagttcgccgagaatgccgccaatcaggtggtttccgtcgatgctgtgcccgccgacaagatgatcctggatgccggtccggcctcggccgaggccatcatcgaccgcctgggcggctgcaagaccctggtgtggaacggccccctgggcgccttcgagatcgcgcccttcgacaaggccaccaacgcggtggctcaatgggccgccgagcgcaccgttcagggcaagctgctgaccgtgggcgggggcggtgacaccgtctcggccctggccaaggcgggcgtcgaggacaagttctcctacatctccacggcgggcggcgccttcctggaatggctggaaggcaaggtcctgcccggcgtcgcggccctcgaggtcaagaactgcggctcgggctgcggctgcggcggctga

SEQ ID NO: 56845 - protein, 405 aa, Magnetospirillum magnetotacticum MS-1
MFRTIDSFDVKGKRVLVRADLNVPAKDGKVTDTTRIDRSAATLKELAGKGAKVIVLTHFGRPKGRDAKYSQKLLVEPLARAVGQPVLWADDCIGVEVEQMIAKMKDGEIALLENVRFYENEEENDIGFAKMLAGLGDIYVNDAFSTAHRAHASTEGVAHLLPCAAGRLMQAELEALGKALEHPEKPVAAIVGGAKVSTKLDLLGNLVARVDYLIIGGGMANTFLFAQGKQVGKSLCEKDLADTAREILEKAKAAHCHIVLPVDAVVAGEFAENAANQVVSVDAVPADKMILDAGPASAEAIIDRLGGCKTLVWNGPLGAFEIAPFDKATNAVAQWAAERTVQGKLLTVGGGGDTVSALAKAGVEDKFSYISTAGGAFLEWLEGKVLPGVAALEVKNCGSGCGCGG

SEQ ID NO: 56846 - DNA, 1218 bp, Leuconostoc mesenteroides subsp. mesenteroides ATCC 8293
  CDS (1)..(1218)
atggctaaattgactgtttcagatttggaactttcaggtaagaaagtattgatgcgcgttgatttcaacgtgcctatcaaggcaggcgttatcggaaacgataaccgtattgtggcagctttgccaacaatcaagtatgttttggaaaacaatggtcgcgcaattttgttctctcatttgggacgtattaagtctgaagacgataagaaagaattgtcattagcaccagttgccgcacgcttgggtgaattattgggtaaggacgttaagttcgtgccacaaactcgcggtgaagaattagaatcagcaatcaacgctttgcaagatggtgaagttttgatggttgaaaacacacgttttgaagacgttgttgatggtgaagtggtcaaaaacgaatcaaagaacaatcctgaattgggtaagtattgggcatcattgggtgatgatttgttcatcaacgatgcctttggtacagctcaccgtgcccacgcttcaaacgtaggtattgcttcaaatgtttcacaagcagctgctggcttcttgatggaaaaagaaatcaagttcttgggtgatgctgttgcgaacccagttcgtcctttcgttgctattatcggtggtgcaaaggtttctgataaaattgaaatcgtaaagtcattattgaacaaggctgataaggttatcgttggtggtggaatggcctatacattcgatgctgctaagggtaacaagattggtaattcattgtttgaagctgataaagttgaattggctaaggaattgatggcagaagctggcgacaagttggttttgccaattgattcaattgctgctgacgcattttcaaatgatgcaaagactgaagttgttgatgctgaagatggtattcctgacggctacatgggtctagatattggtcctaagtctgttaagttgttgcaagacacattgtctgatgcaaagactgttgtttggaacggacctatgggtgtgttcgaaatgtctaattttgcaaagggtactttggcaattggtgaagaattggttaaagtgactgaaaatggtggtacaacaatcgttggtggtggtgattcaactgctgcggtacaacaattgggtgttgccgacaagttgacccacatttcaactggtggtggtgcttcacttgaataccttgaaggtaaggaattgcctggaatcgcttcaatttcggaaaagtaa

SEQ ID NO: 56847 - protein, 405 aa, Leuconostoc mesenteroides subsp. mesenteroides ATCC 8293
MAKLTVSDLELSGKKVLMRVDFNVPIKAGVIGNDNRIVAALPTIKYVLENNGRAILFSHLGRIKSEDDKKELSLAPVAARLGELLGKDVKFVPQTRGEELESAINALQDGEVLMVENTRFEDVVDGEVVKNESKNNPELGKYWASLGDDLFINDAFGTAHRAHASNVGIASNVSQAAAGFLMEKEIKFLGDAVANPVRPFVAIIGGAKVSDKIEIVKSLLNKADKVIVGGGMAYTFDAAKGNKIGNSLFEADKVELAKELMAEAGDKLVLPIDSIAADAFSNDAKTEVVDAEDGIPDGYMGLDIGPKSVKLLQDTLSDAKTVVWNGPMGVFEMSNFAKGTLAIGEELVKVTENGGTTIVGGGDSTAAVQQLGVADKLTHISTGGGASLEYLEGKELPGIASISEK

SEQ ID NO: 56848 - DNA, 1161 bp, Azotobacter vinelandii
  CDS (1)..(1161)
atgaccgtgttgaagatgaccgacctcgacctcaagggtaagcgcgtactcatccgtgaagacctcaacgtgccggtgaaggacggtgtggtgaagagcgacgcccgcatcctcgcttcgctgccgaccatcaagctggcgctggagaagggcgcggcggtgatggtctgctcgcacctgggccgcccgaccgagggcgaatattccgaggagaacagcctgaagccggtcgccgactacctgtccggggccctcggtcgcgaggtgccgctgctcggggaatacctggacggggtgaaggtcgagccgggccaggtggtgctgttcgagaacgtgcgtttcaacaagggcgagaagaagaacgccgacgagctggcgcagcggtacgccgcgctctgcgacgtgttcgtcatggacgccttcggcaccgcccaccgcgccgagggttcgacccacggcgtcgccaggttcgccaaggtcgcctgcgccggtcccctgctggccgccgagctggaggcgctgggcaaggcgctggacaacccgcagcggccgatggccgccatcgtcgccggttccaaggtgtccaccaagctcgacgtgctcaactccctgagccaggtctgcgaccagttgatcgtcggcggcggcatcgccaacaccttcctcgccgcggccggatacaaggtcggcaagtcgctctacgaggccgatctggtcgacaccgccaaggccatcgccgccaaggtcagcgtgccgctgccggtggacgtggtggtcgccaaggcgttcgccgagtccgccgaagccaccgtcaaggccatcgacgaggtggccgatgacgacatgatcctcgacatcggcccgcagaccgccgcgcagttcgccgaactgctgaaatcctcccggaccatcctgtggaacggtccggtcggcgtgttcgagttcgaccagttcggcaacggcaccaaggtcctggccgaggccatcgcggcgagcccggccttctccatcgccggtggcggcgataccctggcggccatcgacaagtacggcgtgggcgagaaaatctcctacatttccaccggtgggggcgccttcctcgaattcgtcgagggcaaggtgctgccggccgtggcggtgctggaagagcgcgccaggtaa

SEQ ID NO: 56849 - protein, 386 aa, Azotobacter vinelandii
MTVLKMTDLDLKGKRVLIREDLNVPVKDGVVKSDARILASLPTIKLALEKGAAVMVCSHLGRPTEGEYSEENSLKPVADYLSGALGREVPLLGEYLDGVKVEPGQVVLFENVRFNKGEKKNADELAQRYAALCDVFVMDAFGTAHRAEGSTHGVARFAKVACAGPLLAAELEALGKALDNPQRPMAAIVAGSKVSTKLDVLNSLSQVCDQLIVGGGIANTFLAAAGYKVGKSLYEADLVDTAKAIAAKVSVPLPVDVVVAKAFAESAEATVKAIDEVADDDMILDIGPQTAAQFAELLKSSRTILWNGPVGVFEFDQFGNGTKVLAEAIAASPAFSIAGGGDTLAAIDKYGVGEKISYISTGGGAFLEFVEGKVLPAVAVLEERAR

SEQ ID NO: 56850 - DNA, 1155 bp, Desulfitobacterium hafniense DCB-2
  CDS (1)..(1155)
atgctagaggatccctctttgtgctttgttgattttaacgtacctatggatgaccatggcaatattaccaacgacacgaggattcgggcggctctgcctaccattcactatctgattgacgaaggggctaaaattatcctcgcttcccatttgggacgtcccaagggaaaaccggatccgaactattccctggctccggtggccaaacgtcttggtgaattgctcaagcgaccggtggccatggcgaccgattgtatcggtccggaggtagagaaagcagcagctcagctgcaggaaggtgaagtccttcttctagaaaatgtccgttatcatgccgaggaagaaaagaatgaaccggagtttgtcaagcaattagcccgcttagctgaagtgtatgttaacgatgctttcggtacagcccaccgggctcatgcttccacagaaggaatcgctcatcatcttcccggggtggccggctttctcctccaaaaggaaattgaaagtatgggcaaggctctggagaatccggagcggccttttgtggccatcattggcggagccaaggtcagtgacaaaatcggggtcattgagaacctgctccataaagtggacgctttgatcattggcggcggcatggccaataccttcctgaaagcccagggctattctctgggtaagtccctggtggaaggagataaattatccctggctcaggagattcttgagcaagggcgggaactccaggtggacattcttttgccccaggatgtggttgcggccaaagaatttaaagccgatgccccctatcgggtcacccctgtccgggagatcgccgaggacgaaatggctttggatatcggaccggaaagtgccggactgttcagtgcaagaatacaaaaggcccggactatcgtctggaacggccccatgggtgtctttgaaatggaacaatttgccaaggggacggagaaagttgctcaggctgtggccttatgtccgggtctgaccattgtcggcggtggagattccgtggccgccgtagaaaaaatgggtgtaggggagcaaatgagccatatctccacaggagggggggcttccctgaagctcctgaaaggcaagaacctgcccggtatagcggcactacaaaacatctaa

SEQ ID NO: 56851 - protein, 384 aa, Desulfitobacterium hafniense DCB-2
MLEDPSLCFVDFNVPMDDHGNITNDTRIRAALPTIHYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLKGKNLPGIAALQNI

SEQ ID NO: 56852 - DNA, 1203 bp, Nostoc punctiforme PCC 73102
  CDS (1)..(1203)
atgtccaaaaaaagtttagcaagtttatcttcagctgatatatctgggaaacgtgccttagtgcgggttgactttaatgtgcctgtggacgatcaaggcaagattaccgacgatactcgcattcgcgccgctctaccaaccatccaagatttaacgcagaagggtgctaaagtcattctcgcaagtcattttggccgtcccaaaggtgtggatgacaaattacgcctaactcccgttgccaagcgtctctctgagttactggggcaagaagtcattaaaactgatgactccatcggcgatgaagttgcagcgaaagttgccgctttgcaaaatggccaagtgctattactagaaaatgtccgtttttatccagaagaagagaaaaacgatgcagaatttgccaaaaaattggcagccaatgctgatttttatgtaaatgatgcttttggtactgcacaccgcgcccatgcttctactgaaggcgtgactaaattccttagcccttctgtggctggatatttagttgagaaggaattgcaatatctgcaaaacgctattgaaaatccccaacgtcctttggcggcaattattggcggttccaaagtttccagcaaaattggtgtaattgaaaccctgctggagaagtgcgacaagctgattattggcggtgggatgattttcaccttctacaaagcccgtggtttgagtgttggtaagtcgttggtagaagaagacaagctagaactagcgaagtctttagaagctaaggctaaagaacggggtgttgctttattgctgcctacagatgtggtattggcagataactttgcccctgatgccaattctcaaaccgttagcattgagaatatccccgatggttggatgggtttggatattgggccagactcggtgaaatttttccaagaagcccttgcagataccaaaacggttatttggaacgggccaatgggtgtatttgagtttgataagtttgcggcaggtacggaagcgatcgctcatactctcgctgaaatcggtaaaactggtacaaccaccatcatcggtggtggtgactcagtagcggctgtggaaaaggttggtttagcagaccaaatgagccacatttcgaccggcggcggcgctagcttggagttacttgaaggcaaagtattgcctggaattgcagctttagatgatgcgtaa

SEQ ID NO: 56853 - protein, 400 aa, Nostoc punctiforme PCC 73102
MSKKSLASLSSADISGKRALVRVDFNVPVDDQGKITDDTRIRAALPTIQDLTQKGAKVILASHFGRPKGVDDKLRLTPVAKRLSELLGQEVIKTDDSIGDEVAAKVAALQNGQVLLLENVRFYPEEEKNDAEFAKKLAANADFYVNDAFGTAHRAHASTEGVTKFLSPSVAGYLVEKELQYLQNAIENPQRPLAAIIGGSKVSSKIGVIETLLEKCDKLIIGGGMIFTFYKARGLSVGKSLVEEDKLELAKSLEAKAKERGVALLLPTDVVLADNFAPDANSQTVSIENIPDGWMGLDIGPDSVKFFQEALADTKTVIWNGPMGVFEFDKFAAGTEAIAHTLAEIGKTGTTTIIGGGDSVAAVEKVGLADQMSHISTGGGASLELLEGKVLPGIAALDDA

SEQ ID NO: 56854 - DNA, 1206 bp, Bifidobacterium longum DJO10A
  CDS (1)..(1206)
atgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgcttggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaa

SEQ ID NO: 56855 - protein, 401 aa, Bifidobacterium longum DJO10A
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAAGAFTIVGGGDSASAVRNLGFPEDGFSHISTGGGASLEFLEGKELPGLKVLE

SEQ ID NO: 56856 - DNA, 1179 bp, Desulfovibrio desulfuricans G20
  CDS (1)..(1179)
atgaacgtactgaaaatgactgatcttgatctgcgcggaaagcgtgtgcttatccgcgaggacctgaacgctcccatcaaggacggggcggtggccaacgacaacaggctgcgcgcagccgcacctaccatccgccttgccatgcaggcaggagcacgggttatggtgatgtcgcatctgggccgcccggcagaaggcgcgtttgacgaatcggcatccatggcacctgtggcggcacggctggccgatattctgggctgccccgtgccggtggtgcgggactggctggacggggtggatgtgcccgaaggcggcgtggtgctgacagagaatgtacgcttcaacaagggcgaaaaaaagaacgacgaagagctgggcaggcgcatggcggccctgtgcgatgtttatgtgatggatgctttcggcacggcgcaccgtgcgcaggcttccacccatgccgttgccgcatttgctcccgtggcctgcgcgggtccgctgctggcggcggagctggaagctctgggcaaggctcttggcgccccgcgccaccctgtggttggcatcatcggcggttccaaggtctcgaccaagctcactctgctggaaacgctttcctccaaggtcgacaagcttattgtgggcgggggcattgccaatacgtttatccgtgccgcaggttttgccgtgggcaaatcactgtatgaagaagatctggtggccgaagccgcccgcctgatgcaggccgcagccgcagccggaggagagattcccgtgcctgtggatgtggtggtggccacggagtttgccgaaactgcaacgcctgtctgcaagccggtggatcaggtggccgataatgagatgattatggacatcgggccgcaaaccgccgccatgtatgcagaggtgctgcgcggagcaggaaccatcgtgtggaacggacctgtcggggtgttcgagtttgatgccttcggtgccggtacagaagcgctgtgcagggctgtggcgcaaagcagcgccttttccatcgccggcggcggtgacactgtggccgctgtggataaatacggcgtccgtgacggcgtatcctatatatccacgggcggaggggcttttctggagtttctggaaggcaaggagctgccggcagtggccatgctggaacagcgcgcaaaagcctga

SEQ ID NO: 56857 - protein, 392 aa, Desulfovibrio desulfuricans G20
MNVLKMTDLDLRGKRVLIREDLNAPIKDGAVANDNRLRAAAPTIRLAMQAGARVMVMSHLGRPAEGAFDESASMAPVAARLADILGCPVPVVRDWLDGVDVPEGGVVLTENVRFNKGEKKNDEELGRRMAALCDVYVMDAFGTAHRAQASTHAVAAFAPVACAGPLLAAELEALGKALGAPRHPVVGIIGGSKVSTKLTLLETLSSKVDKLIVGGGIANTFIRAAGFAVGKSLYEEDLVAEAARLMQAAAAAGGEIPVPVDVVVATEFAETATPVCKPVDQVADNEMIMDIGPQTAAMYAEVLRGAGTIVWNGPVGVFEFDAFGAGTEALCRAVAQSSAFSIAGGGDTVAAVDKYGVRDGVSYISTGGGAFLEFLEGKELPAVAMLEQRAKA

SEQ ID NO: 56858 - DNA, 1170 bp, Haemophilus somnus 2336
  CDS (1)..(1170)
atgtcagtaattaaaatgaccgacctagatttagcaggtaagagagtatttattcgtgcagatttaaatgtgccggtaaaagaggggaaagtcacttccgatgcacgtatcaaagcaactattcctacgttaaaacttgcacttgagaaaggtgctaaagtgatggtaacttctcatttaggtcgtccgacagagggggaatttaaacctgaagattcattacagcctgttgttgattatttgaaaggtgccggttttaacgttcgtttagcacaagattatctaaacggtgtagaagtcaatgaaggtgaaattgttgttcttgaaaacgtacgtgtgaataaaggtgagaagaaaaatgatccggaattaagtaaaaaatatgccgcactttgtgatgtatttgttatggatgctttcggtacggctcaccgtgcacaagcctcaacttacggtgtagcggagtttgcccctgttgcttgtgccggtccattattagcggcggaattagaggcgttaggtaaagcattaaaagagcctcagcgtccaatgttagcgattgtgggaggttcaaaagtatccactaaattaactgtcttggacagcttatcaaaaattgctgaccaactgattgttggtggcggtattgcgaatactttcattgctgcagaggggcataatgtgggtaaatccttatatgaagcggatttaattcctgaagcacaacgtttatcaaaagtaacgaatattcctgttccagttgatgtgcgtgtgggcactgaattttcagaaaccgcactatcaacagaaaaaagtgtagccgacgtttccggagaagaatccatttttgatattggtgataaatcagcagagcaattggctgatattatccgcaatgcaaaaactattctttggaatggtcctgtgggggtttttgaattccctaactttcgtaaaggtactgaaatcgtttctaatgcgattgctgaagcaaccgcaaatggtgctttctctattgctggtggtggtgatactttggcagcgattgatttattcggtatcaaagataaaatttcttatatttcgaccggtggtggtgcattcttagagtttgtagagggcaaagtattaccagcggttgaaattttagaaaaacgagcaaatggttaa

SEQ ID NO: 56859 - protein, 389 aa, Haemophilus somnus 2336
MSVIKMTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFVMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 56860 - DNA, 1176 bp, Actinobacillus pleuropneumoniae serovar 1 str. 4074
  CDS (1)..(1176)
atgtcagtgattaaaatggcagaccttgatcttgccggtaaacgtttatttatccgtgccgatttaaacgtaccggtaaaagatggcaaagtgacatctgacgcacgtattcgtgcaaccattcctaccttaaaattagctttacaaaaaggtgctaaagtaatggtgacttctcacttaggtcgtcctactgaaggtgtattcgaagaagcaaactctttacaacctgtggttgattacttaaacgcatcggatttaggcgtacctgtacgtttagtacgcgattacctagacggcgttgaagttgcggaaaacgaaatcgtagtacttgaaaacgttcgtatcaacaaaggcgaaaagaaaaacgatcctgaacttgcgaaaaaatatgcggcgctttgtgacgtattcgtgatggatgcattcggtacggcacaccgtgcggaaggttcgacttacggtgttgcggaatacgcgccggttgcttgtgcgggtcctctattagcggcggaattggatgcgctaggtaaagccttaaaagaaccgcaacgtccgatgttagcgatcgtaggcggctcaaaagtttctactaaattaaccgtattagacagcctttcaaaaattgcagaccaattaatcgttggcggcggtatcgcaaatactttcattgctgcggaaggtcacccggtaggcaaatcgttatacgaagcggatttaattcctgaagcgaaacgtttagcggcggcaaccaatattcctgttccggttgatgtacgcgtcggtaccgaattctctgaaatcgcaccggcaacggaaaaagcggtatctgaagttcaagcggacgaatcaattttcgatatcggtgacaaatctgcagaagaattggcaaatatcatcaaatcggcaaaaaccattctttggaacggtccggtcggtgtatttgaattccctaacttccgtaaaggtaccgaagtgatttcaaacgctatcgcagaagcgaccgcaaacggcgcattctcgatcgcaggtggcggtgataccttagcggcaatcgatttattcggtattgcggataaaatttcttatatctcaaccggcggcggcgccttcttagaattcgtagaaggtaaagtattaccggcggtcgaaattttagaaaaacgtgcaaacggctaa

SEQ ID NO: 56861 - protein, 391 aa, Actinobacillus pleuropneumoniae serovar 1 str. 4074
MSVIKMADLDLAGKRLFIRADLNVPVKDGKVTSDARIRATIPTLKLALQKGAKVMVTSHLGRPTEGVFEEANSLQPVVDYLNASDLGVPVRLVRDYLDGVEVAENEIVVLENVRINKGEKKNDPELAKKYAALCDVFVMDAFGTAHRAEGSTYGVAEYAPVACAGPLLAAELDALGKALKEPQRPMLAIVGGSKVSTKLTVLDSLSKIADQLIVGGGIANTFIAAEGHPVGKSLYEADLIPEAKRLAAATNIPVPVDVRVGTEFSEIAPATEKAVSEVQADESIFDIGDKSAEELANIIKSAKTILWNGPVGVFEFPNFRKGTEVISNAIAEATANGAFSIAGGGDTLAAIDLFGIADKISYISTGGGAFLEFVEGKVLPAVEILEKRANG

SEQ ID NO: 56862 - DNA, 1203 bp, Psychrobacter sp. 273-4
  CDS (1)..(1203)
atgaattttttgcgtatgagcgagctgagtttgaccaataaagtagtgttgattcgtgaagacctcaatgtgcctatcaaagaaggtaaggtcgctagtgacgcacgcttacaagccagcctgccgacgattaagatggcgttagagaagggcgcagcggtgattgtttgctcgcatttgggtcgcccgacagaaggaagttctgaagccatttattcattagcgcctgttgctgactatttaagcgataaattatcagcgcctgttacgcttaataatgactacctcgctcaaggcgtagctatcaaagcgggcgaggtcgtattgttagaaaacgtacgttttaatgaaggcgaaaagaaaaataacgcggcgctcgcgcaaaaatatgctgatttgtgcgatgtatttgtgatggacgcttttgggacagcacatcgtgctcaggcgtcgacagaaggcgtgacccaagcgatgcaccaagctggcaagacggcttgtgctggacctttattggcagccgagcttgatgcattgagtttggcgcttgaaacgccagcacagcccatgttagctatcgttggtggctcaaaagtctctaccaaattagaggttttgcatagtttggctgagctctgctcgcagattatcgttggtggcgggattgccaataccttcttagccgcgcaaggtcatagcgttggagcttcactttatgaagcagatctggtcgatacagctcgtgaaataatgggtaaaaccgagattttattacctgaatatgtcgtcgttgctaataaaaatgacattgattttgcagattttacaggctcattgcaaaaggcagttgcgaccatcaagtctgttgataatatcggcgacaatgacatgatattggatatcgcgccagacagtgctataaagttggctgctgctattaccaatgccaaaactatcttatggaatggtccagtaggggtttttgaagtggatgcgtttggtcagggcactcagatagtggcagaagcggtcaaaaatagccaaggtttttctatcgcgggcggcggtgatacgcttgctgcgattgataaatatcaagtggcagatggcgtcagctacatgtcaacgggtggtggtgctttcttagagtttgtagaaggtaaagtcttgccggcggttgctgctttacaaattaatgaataa

SEQ ID NO: 56863 - protein, 400 aa, Psychrobacter sp. 273-4
MNFLRMSELSLTNKVVLIREDLNVPIKEGKVASDARLQASLPTIKMALEKGAAVIVCSHLGRPTEGSSEAIYSLAPVADYLSDKLSAPVTLNNDYLAQGVAIKAGEVVLLENVRFNEGEKKNNAALAQKYADLCDVFVMDAFGTAHRAQASTEGVTQAMHQAGKTACAGPLLAAELDALSLALETPAQPMLAIVGGSKVSTKLEVLHSLAELCSQIIVGGGIANTFLAAQGHSVGASLYEADLVDTAREIMGKTEILLPEYVVVANKNDIDFADFTGSLQKAVATIKSVDNIGDNDMILDIAPDSAIKLAAAITNAKTILWNGPVGVFEVDAFGQGTQIVAEAVKNSQGFSIAGGGDTLAAIDKYQVADGVSYMSTGGGAFLEFVEGKVLPAVAALQINE

SEQ ID NO: 56864 - DNA, 1182 bp, Dechloromonas aromatica RCB
  CDS (1)..(1182)
atgaacgttatcaagctgaccgacctcgatgtttccggcaagcgtgttttcatccgcgccgacctcaatgtgccgcaggacgaagccggcaacatcaccgaggacacccgcatccgcgcctcgctgccgtcgatcaagtactgcctggaaaaaggcgccgccgtcatggtcacctcccacctcggccggccgaccgaaggcgaactgaatcacgaagacagcctgatgccggtcgccgtgcgtctcggccagatgctgcatacctccgtccgcctgatcaccgactgggtcgatggcggctttgaagtcaagccgggcgaagtcgtcctgctcgaaaactgccgcgtcaacaagggcgagaagaagaacaatgacgaactggcccagaagatggccaagctgtgcgacatctacgtcaatgacgccttcggtaccgcccaccgtgccgaagccaccacccacggcatcgccaagtacgccccggtcgcctgtgccggcatgctgatgggcgctgaaatcgatgcgctgtccaaggcactgcatgagcctaaacgtccgttggtcgccatcgtcggcggctccaaggtgtcgtccaagctgaccatcctcaagtcgctggccagcaaggtcgaccagttgatcgtcggtggcggcatcgccaacactttcctgcttgccgacggcaagcggattggccactcgctggccgagccggatctggtcaaggaagcccacaccatcatggacatcatgaaggaacgcggcgccgaagtccccctgccaaccgacgtcgtcgtcgccgacgaagtctcggccctggcccgcgccaacaagatttcggtcgatgacgtacacgccaacgaccgcatcctcgacgtcggtccgaagaccgccgccaagtttgccgaaatcatcgccaatgccggcaccatcgtctggaacggcccggtcggcgttttcgaattgccgcaatttgccggcggcaccaagatgatggcctccgccatcgcccactccgaggctttctcgattgccggcggcggtgacacgctggctgccatcgccaagttccatatcgccgacgatgttggctatatctcgacgggcggcggcgccttcctggagttcctcgaaggcaagaccctgccggccatcgccatcctcgaagaacgcgccgcataa

SEQ ID NO: 56865 - protein, 393 aa, Dechloromonas aromatica RCB
MNVIKLTDLDVSGKRVFIRADLNVPQDEAGNITEDTRIRASLPSIKYCLEKGAAVMVTSHLGRPTEGELNHEDSLMPVAVRLGQMLHTSVRLITDWVDGGFEVKPGEVVLLENCRVNKGEKKNNDELAQKMAKLCDIYVNDAFGTAHRAEATTHGIAKYAPVACAGMLMGAEIDALSKALHEPKRPLVAIVGGSKVSSKLTILKSLASKVDQLIVGGGIANTFLLADGKRIGHSLAEPDLVKEAHTIMDIMKERGAEVPLPTDVVVADEVSALARANKISVDDVHANDRILDVGPKTAAKFAEIIANAGTIVWNGPVGVFELPQFAGGTKMMASAIAHSEAFSIAGGGDTLAAIAKFHIADDVGYISTGGGAFLEFLEGKTLPAIAILEERAA

SEQ ID NO: 56866 - DNA, 1149 bp, Synechococcus elongatus PCC 7942
  CDS (1)..(1149)
atgcgtgtcgacttcaatgtccctttggacggcaatgggaaaattacggatgacacccgcatccgtgcggctctgccgacgattcgctacctgtcggaaagtggtgccaaggtgattctggtcagccactttggtcgtcccaaaggcaagcccgtcgagagcatgcgcttaacgccggtggctgagcgcctctcggaattgctgggtcgccctgttgttaagacaaccgatgctgtgggtgccggtgccgaagcgcaagtggcagccaccagcaatggccaagtcgtgttgttggagaacgtgcgtttccacgctgaggaagaagccaacgacgctgaatttgcgaaagcactagctagcttggccgatatctacgtcaatgatgcctttggtgctgctcaccgggctcacgcttccacggctggcgtgactgaatatctttcgccttgcgtggctggttacctgttggagaaagagttgcaatacctacaagccgcgatcgacaatccccaacggcccttggctgcgatcgtcggcggttcgaaagtttccagcaaaattggcgtgatcgaaacgctgctggataagtgcgacaaactgctgattggtggcggcatgatctttaccttctacaaagcccaaggactttcggtcggcggctcactggtagaagaggacaaactcgatctggcgcgatcgctgatggctaaagcgcaagaaaaaggcgtgcaactgttgctgcccgtggatgtagtagtggccgataagtttgcgccggatgctaatgccaaaaccgtggcgatcgatgcgattcccgatggctggatgggcctagatatcggacctgagtcggtcaagcaattcgaggaagccttggccgattgccgctcggtcatttggaatggcccgatgggcgtatttgagttcgatcaattcgctgtcggtaccgaagcgatcgctcgtagcttggcaggactgacccgcaagggtgcaaccacgatcattggtggtggtgactcggtcgctgccgttgagaaagtcggtgttgcttcggaaatgagccacatttccaccggtggtggtgccagcttggaactgctggaaggcaaagtcctgccgggtgtggctgcactggatgacgctgcctaa

SEQ ID NO: 56867 - protein, 382 aa, Synechococcus elongatus PCC 7942
MRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHASTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEEALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 56868 - DNA, 1119 bp, Ralstonia eutropha JMP134
  CDS (1)..(1119)
atgaatgtgccgcaggatgacgccggcaatatcaccgaggacacccgcatccgcgcttcggtgccggccatcgaggcctgcctggctgctggcgccgccgtgatggtcacgtcgcacctgggccgcccgaccgaaggcgagttcaagccggccgattcgctggcgccgattgccacgcgcctgtccgaactgctgggcaagccggtgaagctggtgcagaactgggtcgatggcgtggaggtcgctccgggtcaggtggtgctgctggaaaactgccgcgtgaacaagggcgaaaagaagaacagcgacgaactggcgcagaagatggccaagctgtgcgacgtgtacgtcaatgacgcgttcggcaccgctcaccgcgccgaagcgaccacgcacggcatcgccaagtacgcgccgatcgcctgcgccggcccgctgctggccgccgagatcgacgcgctgggcaaggcgctgggccagccggcgcgtccgctggtcgccatcgtggccggctcgaaggtctcgaccaagctgaccatcctgaagtcgctggccgacaaggtggacaacctgatcgtcggcggcggcatcgccaacaccttcatgctggccgccggcctgaagatcggcaagtcgctggccgaagccgacctggtggccgatgccaagaccatcatcgacatcatggccaagcgcggtgcctcggtacccattccggtcgacgtcgtgtgcgccaaggcgttcagcgccaccgccgccgccaccgtcaaggacgtcaaggacgtggccgacgacgacatgatcctcgacatcgggccgaagaccgccgcgcaattggccgaccagctcaaggctgccggtaccatcgtgtggaacggcccggtgggcgtgttcgagttcgaccagttcggcaacggcaccaaggtgctggccgaagccatcgccgattccaaggcattctcgatcgccggcggcggcgacacgctggccgccatcgccaagtacggcattgccgaccgcgtgggctatatctcgaccggcggcggcgcgttcctggagttcctggaaggcaagaagctgcccgcattcgaagtgctggagcaacgcgcagcaggctga

SEQ ID NO: 56869 - protein, 372 aa, Ralstonia eutropha JMP134
MNVPQDDAGNITEDTRIRASVPAIEACLAAGAAVMVTSHLGRPTEGEFKPADSLAPIATRLSELLGKPVKLVQNWVDGVEVAPGQVVLLENCRVNKGEKKNSDELAQKMAKLCDVYVNDAFGTAHRAEATTHGIAKYAPIACAGPLLAAEIDALGKALGQPARPLVAIVAGSKVSTKLTILKSLADKVDNLIVGGGIANTFMLAAGLKIGKSLAEADLVADAKTIIDIMAKRGASVPIPVDVVCAKAFSATAAATVKDVKDVADDDMILDIGPKTAAQLADQLKAAGTIVWNGPVGVFEFDQFGNGTKVLAEAIADSKAFSIAGGGDTLAAIAKYGIADRVGYISTGGGAFLEFLEGKKLPAFEVLEQRAAG

SEQ ID NO: 56870 - DNA, 1182 bp, Methylobacillus flagellatus KT
  CDS (1)..(1182)
atgaccgtaatcaacatgacggaccttgacctcgcgggcaagcgcgtcttcattcgcgccgatcttaacgtgccggtcagcgatggcaaagtcacttccgatgcgcgtatcaccgcctccattcccaccatacgccatgccctggatgccaaggcacgcgttatggtgacttcccaccttggtcgcccggaagaaggcgtatattcggaggaaaactccttgcagcccgtggctgacgtgctggccgacaagctgggtcagccggtgcgcctgatcaaggactgggtcgacggtggctttgaagtggcggaaggcgaagtggtcttgctggaaaattgccgcttcaataaaggtgagaaaaaaaacgccgaagaaaccgcgcgcaagtatgccgcgctatgcgatgtattcgtgatggacgctttcggtacagctcaccgcgcagaggcctccacctacggggtggcgcaatatgcaccggtcgcggcggcgggcttgctactggtcggcgagctggatgcactgggcaaggccctgtgcgaacctgcccgccccatggtcgcgattgtcggcggctccaaggtctccaccaagcttaccgtgctggaaagcctggctgaaaaggtcgaccagctcgtggtaggcggcggtattgccaataccttcctcaaggcagctggaaaaccgattggccgctcactgagcgaggacgacctggtacctactgcccaatgcctgatggaaaaaatggcgaagcgtggtgcggccgtgccaatcgcggtggatgtggtctgcggcaagcagttcgacgccaatgagcctgccgtactcaaatcggcggaggacgtggccgacgacgacatgatcttcgacattggccccgagtcggccaagcaactggccgagatcatcctcaatgcaggcaccgtggtctggaacggcccggtcggcgtattcgagttcgaccagttcggcgaaggcaccaagaccatcgccgacgccattgccaagaccaaggccttcaccctggccggcggcggcgacaccattgctgcgatccagaaatacgatatctatgacaaggtgtcttatatctcgacggcgggcggggcatttctggaattccttgaaggcaagaaattgccggcggtggagattttggaacagcgtgctaaaggttga

SEQ ID NO: 56871 - protein, 393 aa, Methylobacillus flagellatus KT
MTVINMTDLDLAGKRVFIRADLNVPVSDGKVTSDARITASIPTIRHALDAKARVMVTSHLGRPEEGVYSEENSLQPVADVLADKLGQPVRLIKDWVDGGFEVAEGEVVLLENCRFNKGEKKNAEETARKYAALCDVFVMDAFGTAHRAEASTYGVAQYAPVAAAGLLLVGELDALGKALCEPARPMVAIVGGSKVSTKLTVLESLAEKVDQLVVGGGIANTFLKAAGKPIGRSLSEDDLVPTAQCLMEKMAKRGAAVPIAVDVVCGKQFDANEPAVLKSAEDVADDDMIFDIGPESAKQLAEIILNAGTVVWNGPVGVFEFDQFGEGTKTIADAIAKTKAFTLAGGGDTIAAIQKYDIYDKVSYISTAGGAFLEFLEGKKLPAVEILEQRAKG

SEQ ID NO: 56872 - DNA, 1203 bp, Crocosphaera watsonii WH 8501
  CDS (1)..(1203)
atgtctaagaaaacgatcgccaatttatcagcagcggatctcgctggaaaacgagtattagtaagggttgattttaacgttcctttcgacaacggaagcatcaccgatgacacccgtattcgtgcagctttacccaccatcaaagaattgatcagcaatggggcaaaagttatcctctgtagccacatgggtcgtcccaagggtaaagtagttgatagcatgagtttaacgccggttgcagcccgtttaggggagttattagggcaaaaagtcaccatgtgtgatgattgtgttggagagtccgttacagccgccattggtgggctagaaaatggtcaagttgctctactggaaaatctccgtttccactcagaagaagaaggtaacgatcccgaatttgccaagcagttagcagctaacgccgatttatacgttaacgatgcctttggaactgctcaccgcgcccacgcttctactgaaggggtgacacactatttaagtcctagtgttgctggttatttgattgagaaagaactgcaatatttacaagctgcgatcgaaaacccccaacgtcctttagtggctattatcggtggttctaaagtttctagtaaaattggtgtaattgaaaccctactggaaaaatgcgataagctcatcattggcggtggcatgattttcaccttttataaagcccgtggcttaaatgttggtaagtctttggtagaagacgataagttagaattagctaagtctctcgaagccaaagccaaagagaaaggtgtggatttcttgttaccttctgatgtagttttagccgataactttgcccctgatgctaatgctaaaactaccagtattgacaacattgaagacggttggatgggcttagatattggccctgattccattaaactgttccaagacgctttatctgattgtaaagcagtcatttggaatggtccgatgggagtatttgaattcgataaatttgctgctgggaccgaagcgatcgcccgtaccttagctgagttaaccggcacaggaaccactactattatcggcggtggtgactctgttgctgctgttgaaaaagttggtgtggctgagaaaatgagccacatttctactggtggtggtgctagtttagaactgttagaaagtaaagttttacctggtattgctgccttagacgaagcgtga

SEQ ID NO: 56873 - protein, 400 aa, Crocosphaera watsonii WH 8501
MSKKTIANLSAADLAGKRVLVRVDFNVPFDNGSITDDTRIRAALPTIKELISNGAKVILCSHMGRPKGKVVDSMSLTPVAARLGELLGQKVTMCDDCVGESVTAAIGGLENGQVALLENLRFHSEEEGNDPEFAKQLAANADLYVNDAFGTAHRAHASTEGVTHYLSPSVAGYLIEKELQYLQAAIENPQRPLVAIIGGSKVSSKIGVIETLLEKCDKLIIGGGMIFTFYKARGLNVGKSLVEDDKLELAKSLEAKAKEKGVDFLLPSDVVLADNFAPDANAKTTSIDNIEDGWMGLDIGPDSIKLFQDALSDCKAVIWNGPMGVFEFDKFAAGTEAIARTLAELTGTGTTTIIGGGDSVAAVEKVGVAEKMSHISTGGGASLELLESKVLPGIAALDEA

SEQ ID NO: 56874 - DNA, 1185 bp, Exiguobacterium sp. 255-15
  CDS (1)..(1185)
atgaataagaaatcaattcgcgatatcgatgtaaaaggaaaacgcgtgtttacacgtgtggacttcaacgtaccgctagaagacggcaaaatcacagatgatacacgcatccgtgctgcccttccgacaatcaaacacttggttgacggtggagcgaaagtcatcctcgcaagccatatgggacgtccaaaaggcgagaaaaaccctgagttctcacttgcaccagtcgtagcacgccttagcgaactgcttggtaaggacatcaagctcgttgaagaagcatacggtccggtcgctgaagaagcagtcagcaagcttgaagaaggagacgtcatcgttcttgaaaacgttcgtttctacccaggcgaaacgaaaaacgatcctgaactcgcagaaggttttgcgaaacttgcagacgttttcgtcaacgacgcatttggtgcagcgcaccgtgcgcacgcttctacagaaggaatcgcccatcatgtcgagactgctgtagcaggattgttgatcgaaaaagaacttcaagttctcggtaaagctctctcaaacccggatcgtccgtttacagcgatcatcggtggttcgaaagtcgctgacaaaatcggcgtcatcgatcacttgcttgatatcgtcgacacgttgatcatcggcggaggattatcttatacattcctcaaagctcaaggttatgaagtcggtacgtcacttcttgaagtcgacaaaatcgaacaggcgaaggaattcatgaaaaaagcagaagacaaaggcgtgaaattcttgatgccggttgactgtgtcatcacgaaggaattcggcgaagaaacatatgttggatcacgcgacatcgacagtatcccagcggatcacatgtcactcgatatcggtccaaaaacggtagaactgtatgcagaagcaatcaaggcttcgaaacttgttgtctggaacggaccaatgggtgtgttcgaacttgataaatatgcaaacggaacaaaaggtgtcgctcaagcattagcggacagcgatgcatactcgatcatcggtggtggagattctgctgcagcggctgagaagtttggtcttgcagataaaatgagtcacatttcaacaggtggcggcgcaagcctcgagttcatggaaggaaaagctcttccaggtgtcgaagcgcttaacgacaagtaa

SEQ ID NO: 56875 - protein, 394 aa, Exiguobacterium sp. 255-15
MNKKSIRDIDVKGKRVFTRVDFNVPLEDGKITDDTRIRAALPTIKHLVDGGAKVILASHMGRPKGEKNPEFSLAPVVARLSELLGKDIKLVEEAYGPVAEEAVSKLEEGDVIVLENVRFYPGETKNDPELAEGFAKLADVFVNDAFGAAHRAHASTEGIAHHVETAVAGLLIEKELQVLGKALSNPDRPFTAIIGGSKVADKIGVIDHLLDIVDTLIIGGGLSYTFLKAQGYEVGTSLLEVDKIEQAKEFMKKAEDKGVKFLMPVDCVITKEFGEETYVGSRDIDSIPADHMSLDIGPKTVELYAEAIKASKLVVWNGPMGVFELDKYANGTKGVAQALADSDAYSIIGGGDSAAAAEKFGLADKMSHISTGGGASLEFMEGKALPGVEALNDK

SEQ ID NO: 56876 - DNA, 1179 bp, Rubrobacter xylanophilus DSM 9941
  CDS (1)..(1179)
atggacaagcggagcgtgagggacctcgagctgcgcgggaagaaggtgctcgtccgggtggacttcaacgtgccggtaaagggcggcgaggtgaccgacgacacccgcatccggcgggcgctgcccaccatccgctacctgctgcagcggggggcgagggtcgccctgatctcccacctgggccgcccgaagggcgagcccgacccccgctacaggatggaccccgtggcccggcggctcgaggagctgctcggggagccggtcaggaagctggataccgccacgggccctgaggtcggcagggcgctggaggagctggagcggggcgtgatcctgctggagaactcccgcttctaccccggggagacaaagaacgaccccgccttcgccgccgagctggccgggcccttcgacctctacgtcaacgacgccttcggggcggcccacagggcccacgccaccaccgtgggggtcgccgagcggctgcccgccgccgccggcttcctgctggagcaggagctggactacctggatggggtgctgcgcagcccggagcggcccttcgtggccatcctcggcggggccaaggtctcggacaagctgggggtcatcgagagcctgctcggggtggccgaccgcctcctcgtcgggggggcgatgtgcttcaccttcctgaaggccaggggcctcggggtcggagcctcgctggtcgaggacgactacctcggggaggcgcgtcgcctcatggagggggccgccgacaggctcgtgctcccggtggacgtggtcgtcgccgagaggatggaggagggggcccggacccggaccgtcccggtggaggagatcccggagggctggatgggcctggacatcggcccccggacggtcgagctcttccgccggcacatcctgcaggccaggaccatcttctggaacggccccatgggggtcttcgagatcgacgcgttcgccaggggcaccgagggcgtggccagggccgtcgccgagagcggggccacgagcgtcgtggggggcggcgactcggtcgccgccgtcaggaagctcggcctggaggacaggatgagccacatctccaccggcggcggggcctcgctggagtacgtcgagggcagggagctgcccggcgtggccgtgctgcccgagagggaggaggtctag

SEQ ID NO: 56877 - protein, 392 aa, Rubrobacter xylanophilus DSM 9941
MDKRSVRDLELRGKKVLVRVDFNVPVKGGEVTDDTRIRRALPTIRYLLQRGARVALISHLGRPKGEPDPRYRMDPVARRLEELLGEPVRKLDTATGPEVGRALEELERGVILLENSRFYPGETKNDPAFAAELAGPFDLYVNDAFGAAHRAHATTVGVAERLPAAAGFLLEQELDYLDGVLRSPERPFVAILGGAKVSDKLGVIESLLGVADRLLVGGAMCFTFLKARGLGVGASLVEDDYLGEARRLMEGAADRLVLPVDVVVAERMEEGARTRTVPVEEIPEGWMGLDIGPRTVELFRRHILQARTIFWNGPMGVFEIDAFARGTEGVARAVAESGATSVVGGGDSVAAVRKLGLEDRMSHISTGGGASLEYVEGRELPGVAVLPEREEV

SEQ ID NO: 56878 - DNA, 1197 bp, Mesorhizobium sp. BNC1
  CDS (1)..(1197)
atggccggtttcaagacattggacgatttgaaggatgtagcgggaaagcgtgtgcttctgcgcgtggacttgaatgtgccggtaaaggatggggaggttacggacacgacccgcatcgagcgtgttgcgccgaccattacggagctttccgacaagggtgccaaggttatcttgcttgcccatttcggtcggcccaagggcaagccggatgcagaggcttctctacagccgattgcacatgcggtggaagcagtcctcgatcggcgcgtccacttcgcatccagctgcataggcgaaccggcgaagaaggccgtggacgaaatgacgggcggggacatcctgcttctggaaaacacccgctttcacgcgggcgaggaaaagaacgacccggaatttacgaaggcgctcgcggcaaatggcgacatctatgtcaacgatgccttttctgccgcccatcgcgcgcatgcctcgacggaagggctggcgcatctccttcccgcttatgcgggacgcaccatccaggcggagctcgaagctctccagcgcggtcttggagatccgaaacgccctgtggtggcgatcgtcggcggcgcgaaagtctccaccaaaatcgatctgctcaccaatctcgtgaagaaggtcgactgtctcgttatcggaggcgggatggccaacaccttccttgcagcgcgcggcacttccgtcggcaagtcgttatgcgagcacgatcttagggaaacagccaaacagatcatgatcgatgcggctgaggccggctgtgcgatcatcctgccagtcgacgcggtggtggcacggaaattcgaagctggggcggaaaccgagacggtcgacatcgacgccgtgccggaagatgctatgatcctcgatgtcgggccgaagtcggtcgaaaaggtgaaagagtggctggaccgggccgacacgctggtttggaatgggcctctcggcgctttcgagctttcgcctttcgacaaggctaccatggaggtagcaaagtatgccgcccggcgaacccgtgagagcctcctggtgtcggtcgcaggcggcggcgatacggtagcagcactcaaccaggcggatgtgtctgatgacttcagctatgtctcgaccgccggtggcgctttccttgagtggatggaaggcaaggaccttccgggcgttgcagcgcttcagaagtga

SEQ ID NO: 56879 - protein, 398 aa, Mesorhizobium sp. BNC1
MAGFKTLDDLKDVAGKRVLLRVDLNVPVKDGEVTDTTRIERVAPTITELSDKGAKVILLAHFGRPKGKPDAEASLQPIAHAVEAVLDRRVHFASSCIGEPAKKAVDEMTGGDILLLENTRFHAGEEKNDPEFTKALAANGDIYVNDAFSAAHRAHASTEGLAHLLPAYAGRTIQAELEALQRGLGDPKRPVVAIVGGAKVSTKIDLLTNLVKKVDCLVIGGGMANTFLAARGTSVGKSLCEHDLRETAKQIMIDAAEAGCAIILPVDAVVARKFEAGAETETVDIDAVPEDAMILDVGPKSVEKVKEWLDRADTLVWNGPLGAFELSPFDKATMEVAKYAARRTRESLLVSVAGGGDTVAALNQADVSDDFSYVSTAGGAFLEWMEGKDLPGVAALQK

SEQ ID NO: 56880 - DNA, 1185 bp, Ehrlichia canis str. Jake
  CDS (1)..(1185)
atgttaaggtctcatgattttactttttgtaatatgaaaaaaatacaagatttcagttgtagtggtaagacagtgttactgcgtgcagacttaaatgtaccaatggataatggtgtagtgttggatgatactaggattgttagattgactacaactattaagtacttactgagtaatgatgcaaagattgtaataatgtcgcactatggccgccctaagtcttatgataaagaattttctttgaagtttttgattgagtacctaaataagatatttacaacaaatgtaatatttatagatggtgtaattggggattatgtagaacaaactatacaatctgcttcattaggttcaatattattactagaaaatttgagattttatgcagaagaagaaacaaatgatttagcgtttgctaaacagcttgctttattggctgatatatatgttaatgatgctttttcttgtttacaccgtaaacatgcatctatagatgcgattactagattaattccttcttttattggctttaattttcaggaagaaatgaaatatttgaattgtgttgtttctaatagtgaaaaaccagttgcagttatagttggtggctcaaaaatatcaacaaaaattcacatgttgaaaaatctgactaaaaaggtggattttttaatagtaggtggagctattgcaaataactttttactatcgcaaggtctgaaaataggaagatcattatatgaagaattagaaaaagatcttgtaaaagaaataatggatcttgctaaaagacatgagtgtaaaattattgttccagttgattatgtagtggctaagaattctatttatgggaaaagttcaataaaagataatgatactatagaatctgatgatgtaatattagatataggacctcaaacgattaatatagttactgcaacagtaaataagtgtagaacgattttatggaatggtccatgtggtatgtttgaaaaggagcagttttcaaaaggaacatttagtgttgcaaacttattagcaaaattaactaaggcaggtaaacttaaaagtattgttggtggtggtgatagtatatgtgcaatcaagttatctggtctttcaaatgatgactttacttatatttcaacaggtggaggtgctttactgcactttcttagtattgcgtag

SEQ ID NO: 56881 - protein, 394 aa, Ehrlichia canis str. Jake
MLRSHDFTFCNMKKIQDFSCSGKTVLLRADLNVPMDNGVVLDDTRIVRLTTTIKYLLSNDAKIVIMSHYGRPKSYDKEFSLKFLIEYLNKIFTTNVIFIDGVIGDYVEQTIQSASLGSILLLENLRFYAEEETNDLAFAKQLALLADIYVNDAFSCLHRKHASIDAITRLIPSFIGFNFQEEMKYLNCVVSNSEKPVAVIVGGSKISTKIHMLKNLTKKVDFLIVGGAIANNFLLSQGLKIGRSLYEELEKDLVKEIMDLAKRHECKIIVPVDYVVAKNSIYGKSSIKDNDTIESDDVILDIGPQTINIVTATVNKCRTILWNGPCGMFEKEQFSKGTFSVANLLAKLTKAGKLKSIVGGGDSICAIKLSGLSNDDFTYISTGGGALLHFLSIA

SEQ ID NO: 56882 - DNA, 1191 bp, Listeria monocytogenes str. 1/2a F6854
  CDS (1)..(1191): transl_table=11
atggctaaaaaagttgtaactgatttagatttaaaagacaaaaaagttttagttcgtgttgactttaacgtgccaatgaaagacggtaaaatcactaacgataaccgtattgtagctgcacttccaacaattgagtacatcttagaacaaaacggtaaagcaattctattttctcaccttggaaaagtaaaaacagaagaagataaagaaggaaaatctcttcgtccagtagccgctcgtttaagcgaattacttggaaaagaagtgaaattcgttcctactactcgtggtccagaacttgaagcagcaattgctgagttaaaagacggcgaagtacttctttttgaaaatacacgttttgaagatattgatggtaaaaaagaaagcaaaaatgatccagaacttggaaaatactgggctagccttggcgacgttttcgtaaatgacgcttttggtactgctcaccgtgcgcacgcgtctaacgttggaatcgcttctaacttagaatcagcggccggatttttgatggaaaaagaaattaaattcatcggcggtgtagttgataatccagcacgtccactagtagcaatcctaggtggtgcaaaagtttctgacaaaatcggtgttatcgaaaacttacttacaaaagcagacaaagtacttgtcggcggcggaatgactttcactttcatggcagctcaaggtcaagaaattggtaaatctcttttagaagcagataaagttgaacttgctaaaggcttacttgaaaaagctggcgataaattagtattaccagttgatgcagttgtatctaaagaattcagtaacgatgctcctttccatacagttagtgcagatagcattccagctgatgaaatgggactagatattggtcaagctacaatcgacttatttacaaaagaacttcaaggcgctaaaacagttgtatggaatggtccaatgggcgtattcgaacttagcaactttgctaaaggtacaattggcgtttgtgaagctattgcaaacttaactgatgcaacaactatcatcggtggtggggattctgcagcagcagctatggacttaggttttgctgataaattcacacatatttctactggtggcggcgcatctttagagtatcttgaaggtaaagagcttcctggtgttgcttctattagcgacaaataa

SEQ ID NO: 56883 - protein, 396 aa, Listeria monocytogenes str. 1/2a F6854
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEAAIAELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 56884 - DNA, 1182 bp, Rubrivivax gelatinosus PM1
  CDS (1)..(1182)
atggccttcatgaccctggaccagatcaacctgcgcggccagcgggtgttcatccgctgcgacttcaacgtgccgctcgatgccgccggtcgcatcaccgacgacacccgcatccgcgccagcatccccggcatccgccacgcgctgacccagggggcgcgcgtcatgctcgcctcgcacctcggtcgacccggcgagggcgcactgacgccggccgactcgctcgcaccggtagcgcgccgtgtcggtgaactgctcgaccgcgaggtgccgctggtcggcgactggctcgcacggcctttcgacgtcacccccgggcaggccgtgatgctggagaactgccgcgccaatgtgggcgaaaaggccaactcgcgcgagctggcgctgcgcatggccgaactgtgcgatgtctatgtgaacgacgccttcggcaccgcccaccgcgccgaggccacgacggaagccctggcgcgcgttgccccggtggcctgcgccggcccgctgatggcgtcggagctgaacgcgctcggacgcgcactggctcggccggcccggcctctggcggccatcgtcggcggttcgaaagtgtcgaccaagctgtcggtgctgaagtcgctggccgaccaggtcgagttgctggtggtcggtggcggcatggccaacaccttcctgctggccgcggggcagaaggtgggcaagtcgctgtgcgagccggacatggtcgagacggccgcgcaggtggcctcgacgctcgccgcgcgcggcgccgagctcttcatgccgatcgacgtggtgaccgccaccgagttctccgaggacgccatcccggcgatcaaggcgctgagcgaggtcgggcccgacgacctgatcctcgacttcggtcctcggtcgatgcaggccctcgtcgagcgactggcgccctgcaagaccatcgtgtggaacggcccgctgggcgtgttcgagatcgagcagttctcctacggcacccgcacgctggccaccgccatcgccgcatcgcaggccttctcgatcgccggtggcggcgacaccgtcgccgcgatcaaccgcttcgacgtggccaaggacatcgactatgtctccaccgccggcggtgccttcctcgagttcctcgagggcagaacgctgcccgctgtgaaggcgctccaggaccgcgccgcctga

SEQ ID NO: 56885 - protein, 393 aa, Rubrivivax gelatinosus PM1
MAFMTLDQINLRGQRVFIRCDFNVPLDAAGRITDDTRIRASIPGIRHALTQGARVMLASHLGRPGEGALTPADSLAPVARRVGELLDREVPLVGDWLARPFDVTPGQAVMLENCRANVGEKANSRELALRMAELCDVYVNDAFGTAHRAEATTEALARVAPVACAGPLMASELNALGRALARPARPLAAIVGGSKVSTKLSVLKSLADQVELLVVGGGMANTFLLAAGQKVGKSLCEPDMVETAAQVASTLAARGAELFMPIDVVTATEFSEDAIPAIKALSEVGPDDLILDFGPRSMQALVERLAPCKTIVWNGPLGVFEIEQFSYGTRTLATAIAASQAFSIAGGGDTVAAINRFDVAKDIDYVSTAGGAFLEFLEGRTLPAVKALQDRAA

SEQ ID NO: 56886 - DNA, 1194 bp, Rubrivivax gelatinosus PM1
  CDS (1)..(1194)
ttgaaggttctgcggttctccgatctcatccagcaaggtcgcgtcgccggccaacgtgtcttcatccgggccgatctgaacgtgccgcaggacgacgccgggcgcatcaccgaggacacccgcatccgcgcctcgatcccctgcatcgagatggcgctggcggccggtgcggccgtgatggtgacctcgcacctgggccgtccgaccgagggcgagttcaaggccgaggactccctggcgccggtcgcgcgccgtctggccgagttgctgggccgcaaggtgccgctgctgcaggactggaccggcggtgtcgaagtcgcgccgggtgaactggtgctgctcgagaactgccgcgtcaacaagggcgagaagaagaacgacgaaacgctggcccggaagatggccgcgctctgcgacatcttcgtgcacgacgccttcggcaccgcgcaccgcgccgaggcctcgacctatggcattgcgcagttcgccaaggtggcctgtgccggcccgctgctggcggccgagatcgacgccatcaccaaggccctgaagagcccgaagcgcccgctggtggccatcgtggcgggctccaaggtcagcaccaagctgtcgatcctgaagtcgctggcggccaacgtcgaccagctgatcgtcggcggcggcatcgccaacacgttcatgctggcggtcggtctgtccatcggcaagtcgctggccgagcccgatctggtggatgaggcgcgcgccatcatcgacatgatgaaggcgcgtggcgccgcggtgccgatcccgatcgacgtggtcgtggccgacgagttctctgccatcgcacgcgccaacaaggtgaccgccaccgaggtgcggcccgatgacctgatcctcgacatcggcccgcgcaccgcggccgagctggccggcatcatcgcgcgcgccggcacggtggtctggaacgggccgatgggcgtgttcgaatacgaccagttcgccggcggaacgcgcacgctggctgcggccatcgcccattcgccggctttcagcatcgccggcggcggcgacacactggcggcgatcgcaaagtacggcatcgagaaggacatcggctacatctccaccggtggcggcgccttcctcgaggtgctggagggcaagaccctgccggccttcgagatcctcgagcagcgggccgccggctga

SEQ ID NO: 56887 - protein, 397 aa, Rubrivivax gelatinosus PM1
MKVLRFSDLIQQGRVAGQRVFIRADLNVPQDDAGRITEDTRIRASIPCIEMALAAGAAVMVTSHLGRPTEGEFKAEDSLAPVARRLAELLGRKVPLLQDWTGGVEVAPGELVLLENCRVNKGEKKNDETLARKMAALCDIFVHDAFGTAHRAEASTYGIAQFAKVACAGPLLAAEIDAITKALKSPKRPLVAIVAGSKVSTKLSILKSLAANVDQLIVGGGIANTFMLAVGLSIGKSLAEPDLVDEARAIIDMMKARGAAVPIPIDVVVADEFSAIARANKVTATEVRPDDLILDIGPRTAAELAGIIARAGTVVWNGPMGVFEYDQFAGGTRTLAAAIAHSPAFSIAGGGDTLAAIAKYGIEKDIGYISTGGGAFLEVLEGKTLPAFEILEQRAAG

SEQ ID NO: 56888 - DNA, 1164 bp, Pseudomonas fluorescens PfO-1
  CDS (1)..(1164)
atgaccgtgttgaagatgtccgacctcgatctgcaaggtaagcgcgtattgatccgcgaagacctcaacgtcccagtcaaggacggtgttgtcaccagcgatgcgcgtatcctggcttcgctgccgaccatcaagctggccctggaaaaaggcgcggccgtgatggtctgctcgcacctgggtcgtccgaccgaaggcgaattctctgccgagaacagcctcaagcctgtcgccgactacctgagcaaggccctgggccgcgaagtgccgctggtggccgactacctgggcggcgttgacgtcaaggccggcgacatcgtgctgttcgaaaacgtgcgcttcaataagggcgagaaaaagaacgccgacgaattggcccagcaatatgccgccctgtgcgacgtgttcgtgatggacgctttcggcaccgctcaccgtgctgaaggttcgacccacggcgtcgccaagttcgccaaagtcgccgctgccggcccgctgctggctgctgagctcgacgcactgggcaaagccctgggcgccccggccaagccgatggcggccatcgttgccggctccaaggtctcgaccaagctcgacgtactgaacagcctgagccagatctgcgatcaactgatcgtcggcggcggcatcgccaacaccttcctcgcggcggccggtcacccggtcggcaagtcgctgtacgagccggacctgctggacaccgcgcgcgccatcgccgccaaggtcagcgtgccgctgccggtcgacgtggtggttgccaaggaattcgctgaaagcgccgaagcgaccgtgaaactgatcgctgacgtcgctgccgacgacatgatcctcgacatcggcccgcaaaccgcggccaacttcgccgaactgctgaagtcgtcgaaaaccatcctgtggaacggcccggtcggcgtgttcgaattcgaccagttcggcaacggcaccaaagtgctggccgaagccatcgcagaaagcgcggcgttctcgattgccggcggtggcgacaccctggcggccatcgataaatatggcgtagcggaaaagatctcctacatttccaccggcggcggcgcgttcctcgaattcgtcgaaggcaaggtgctgccggccgttgaagtcctggaaagccgggccaaggcctga

SEQ ID NO: 56889 - protein, 387 aa, Pseudomonas fluorescens PfO-1
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAKA

SEQ ID NO: 56890 - DNA, 1194 bp, Rhodospirillum rubrum
  CDS (1)..(1194)
atggccagcttcaagacgattgacgacctggatgtgaacggcaagcgcgtgctggtgcgcgccgacctcaacgtgccgatccgcgatggtgtggtcactgataccacccgcatcgaccgctcggccgaaaccatcctggccctggccagcaggggcgcctgcgtggtcgtctgctcgcacttcggccgccccaagggcaagcgcgttcccgagatgagcctgaggccgatcgtcgagccgctgtcgcgggccctgggcggcgttccggtggccttcgccgaggattgcgtcggtccggccgccgaattggtggtcaatggtctggcgccgggcgaagtcgccctgcttgaaaacctgcgcttccacgacgaagaagaaaagaacgatccggccttcgcccagaagctggccgatctgtgcgatctctacgtcaacgacgctttttcgtcggcccaccgcgcccacgcctcgaccgaatatatcgcccgtctggtgcccgctgccgccggccggctgatgcaggccgagttggaggccctgggcaaggcgctggataatcccgaacgcccggtcgcggccatcgtcggcggcgccaaggtctcgaccaagctagagctgctcggcaatctggtgtccaaggtcgatatgatcatcatcggcggcggcatggccaataccttcctcttcgcccagggcatcgagatcggcgccagcttgtgcgagaaggatatggccgataccgcccgcgccatccttgaaaaggccgccgcggcgaagtgcgagatcgtgctgccgatcgacgccgtggtcgcctcggccttcaaggaaggggccgaaaaccatgtggtggcgatcgatgccgtgccggccgacaagatgatccttgatgtcggcccgcaaaccgcccaggcggtgatcgccaaactcggcgagtgcaagaccctggtgtggaacggtcccttcggcgccttcgagatcaaacccttcgacgccgccaccaatacggtggcccaggccgccgcccaggcgaccgccgagggccggctgctgaccgtggccggcgggggcgatacggtctcggccctggccaatgccggggtggaagacaagttctcctatgtctcgacggccggcggcgccttcctggaatggctggagggcaaaacgctgccgggtgtcgccgccttgctgtag

SEQ ID NO: 56891 - protein, 397 aa, Rhodospirillum rubrum
MASFKTIDDLDVNGKRVLVRADLNVPIRDGVVTDTTRIDRSAETILALASRGACVVVCSHFGRPKGKRVPEMSLRPIVEPLSRALGGVPVAFAEDCVGPAAELVVNGLAPGEVALLENLRFHDEEEKNDPAFAQKLADLCDLYVNDAFSSAHRAHASTEYIARLVPAAAGRLMQAELEALGKALDNPERPVAAIVGGAKVSTKLELLGNLVSKVDMIIIGGGMANTFLFAQGIEIGASLCEKDMADTARAILEKAAAAKCEIVLPIDAVVASAFKEGAENHVVAIDAVPADKMILDVGPQTAQAVIAKLGECKTLVWNGPFGAFEIKPFDAATNTVAQAAAQATAEGRLLTVAGGGDTVSALANAGVEDKFSYVSTAGGAFLEWLEGKTLPGVAALL

SEQ ID NO: 56892 - DNA, 1194 bp, Burkholderia fungorum LB400
  CDS (1)..(1194)
atgaacaaggtattgcgtctctccgatctgatcgccgaaggcaagctatccggcaaacgcgtgttcatccgcgccgatctgaacgtgccgcaggacgatcaaggcaacatcaccgaagacacccgtatccgcgcttccgtgccggccatcaaggccgcgctcgacgcgggcgccgccgtgatggtcacgtcgcacctgggccgtcccacagagggtgatttcaagcctgaagactcgcttgcgccggtcgcgaaacgtctggccgaactgctcggccgcgaggtgccgctggtggcgaactgggtcgaaaacggcgtgaacgtcgcgccgggctcggtcgtgctgctggaaaactgccgcgtcaacaagggcgaaaagaaagattccgacgagctcgcgcagaaaatggcgaagctctgcgacatctacgtgaacgacgcattcggcaccgcgcaccgcgccgaagccaccacgcacggtattgccagatacgcgccggtggcgtgcgccggcccgctgctcgcggccgaactcgaagcgctcggcaaggcgctgggcgcgccgaagcgtccgctggtggcgatcgtcgccggctcgaaggtgtcgaccaagctgaccattctgaagtcgctcgccgacaaggtcgatcaactgatcgtgggcggcggcattgccaacacgttcatgctggccgcgggcctgaagatcggcaagtcgctcgccgaagccgatctggtgaacgaagccaaagccatcatcgacgcggcgaaagcccgcggcgcctcggtgccgatcccgaccgacgtggtcacggcgaaagagttttccccgaccgccaaggcagaagtcaaagcagtcgccgacgttcaggacgacgacctgatcctcgacatcgggccggaaacggccaaagtgctcgccgcgcaactggaaaaggccggcacgatcgtgtggaacggtccggtcggcgtgttcgaattcgaccagtttggcaacggcacgaagacgctggcggaggctatcgccaaatcgtcggcgttctcgattgccggcggcggcgatacgcttgctgcgatcgccaagtacggcatccacgacaaggtcagctatatctcgacgggcggcggcgctttcctcgaattcctcgaaggcaagaagctgccggcggtcgaagttctggaatcgcgggcttaa

SEQ ID NO: 56893 - protein, 397 aa, Burkholderia fungorum LB400
MNKVLRLSDLIAEGKLSGKRVFIRADLNVPQDDQGNITEDTRIRASVPAIKAALDAGAAVMVTSHLGRPTEGDFKPEDSLAPVAKRLAELLGREVPLVANWVENGVNVAPGSVVLLENCRVNKGEKKDSDELAQKMAKLCDIYVNDAFGTAHRAEATTHGIARYAPVACAGPLLAAELEALGKALGAPKRPLVAIVAGSKVSTKLTILKSLADKVDQLIVGGGIANTFMLAAGLKIGKSLAEADLVNEAKAIIDAAKARGASVPIPTDVVTAKEFSPTAKAEVKAVADVQDDDLILDIGPETAKVLAAQLEKAGTIVWNGPVGVFEFDQFGNGTKTLAEAIAKSSAFSIAGGGDTLAAIAKYGIHDKVSYISTGGGAFLEFLEGKKLPAVEVLESRA

SEQ ID NO: 56894 - DNA, 1254 bp, Magnetococcus sp. MC-1
  CDS (1)..(1254)
atgaccctctatgcgagccctgtttttctaatgaatgcgtctccaaaaagtgatgaggttctcatgaacaagcgtaccatccgtgatattgacatcaaaggtaagcgggttttcatgcgtgtggattttaatgtgcccctcaatgaggatggcacggtccgcagcgataagcgcattcagggtgcgctgcccaccattcgttatgccattgagcagggggctaaagtaattttggcttctcacttggggcgcccctcaggggataagtttgaacccgaattttcactaaagcctgcgggtgaagcgcttgccgcgctgttgggccaaccggtcaagctggccccagattgtgtaggggccgaggtcgaagcaatggtggccgccatgcaggatggtgatgtggtgttgctggagaatgtgcgttttcacaagggtgaaaccaaggcggatgttgagctttccaagggttttgccaagttggccgatgtggtggtaaacgatgcctttggcacggcacaccgggcccattcgtccaatgtgggcattaccgagtttgtgcgccctgcggtggccgggtttttgatggccgatgagatggactattttgataaggtattgggtgcgcccgagcgtccggtcatggccattttggggggggccaagatctcaggcaagattgatgtgatcgaggcgctgctggacaaaatggataagatcattattggcggtggcatgtccttcaccttcttcaaagccatgggttatgaaattggcaactcgttgtgtgaagatgagatgttgccggtggcagaaaaaaccttggctaaagccaaagagaagggggtatccctgatcctgccagtggattgcgtggcggcggacgcctttcgtgaggatgccaatacccagatctgctcggtagaagcactacccgctggctggatggggctggatatcgggcctgagagcgtcaagctgtttgccaaggcgttggagggggttaaaaccgtcatttggaacggccccatgggggtgtttgaaatggccccctttgccagtggcaccaaccatttggcccatttgttggcggagagtgattgtctttcggtgatcgggggtggtgatacggcggcggcggttaaacaagcgggcgtggccaagcaactctcttacatctccactggtggtggggcctcgctggagttgatggagggcaaacagctgcccggtatcacctcgctggatgataaatag

SEQ ID NO: 56895 - protein, 417 aa, Magnetococcus sp. MC-1
MTLYASPVFLMNASPKSDEVLMNKRTIRDIDIKGKRVFMRVDFNVPLNEDGTVRSDKRIQGALPTIRYAIEQGAKVILASHLGRPSGDKFEPEFSLKPAGEALAALLGQPVKLAPDCVGAEVEAMVAAMQDGDVVLLENVRFHKGETKADVELSKGFAKLADVVVNDAFGTAHRAHSSNVGITEFVRPAVAGFLMADEMDYFDKVLGAPERPVMAILGGAKISGKIDVIEALLDKMDKIIIGGGMSFTFFKAMGYEIGNSLCEDEMLPVAEKTLAKAKEKGVSLILPVDCVAADAFREDANTQICSVEALPAGWMGLDIGPESVKLFAKALEGVKTVIWNGPMGVFEMAPFASGTNHLAHLLAESDCLSVIGGGDTAAAVKQAGVAKQLSYISTGGGASLELMEGKQLPGITSLDDK

SEQ ID NO: 56896 - DNA, 1188 bp, Thermobifida fusca
  CDS (1)..(1188)
atgcggacgatcgaggatctcgacgtcgcgggcaagcgcgtcttcgtccgagccgatctcaacgtgccgctcgacggtgaccgcatcaccgacgacggtcgtatccgggccagcctgcccaccatcactgcactgcgcgagcggaacgcgcgcgtgatcatcggcgcccacttgggccgccccaaaggcaaggtcgaccctgcctactcgctgaagccggtcgccgcccgcctgggtgagctgctgggcaccgaggtgcgcttcgcctccgacaccgcaggcgaatccgcccaggccatcagccgcgagctggccgacggcgaggtcgccctcgtggagaacctgcgttttgagccgggcgagaccagcaaggacgacgccgaacgcggtgagttcgccgatcggctcgccgcactggctgagctgtacgtcggcgacggtttcggcgccgtgcaccgcaagcacgccagcgtctacgacctgccgaagcgtctgccgcacgccgccggcggactggtgctggccgaagtcaacgtgctgcgcaagctgaccgagtccccgcagcgcccctacgtggtcgtactgggcggctccaaggtctccgacaaactcggcgtcatcgacaacctgctcaacaccgccgaccgcatcctcatcggcggcggcatggcctacaccttcctcgccgcgcagggctacgaggtgggcgccagcctgctggagcgggaccagatcgacaccgtcaaggggtacctgcgccgggctgaggagcgcggtgtggaactcgtgctcccggtggacgtggtggccgcagagaagttcgctgcggacgccgcccacgacgtggtcgacgtccgggagatccccgcggaccggatggggctggacatcggaccggcctcggctgagctcttcgcgtcgaaactggcggacgccgcgaccgtgttctggaacggcccgatgggcgtgttcgaaatggagccgtacgcgaagggcacccgctccgtggcgcaggccctagccgactcctcggcgttcaccgtggtcggcgggggcgactcggccgcagccgtccgggcactcggcttcgacgagaaggcgttcagccacatctccaccggtggcggtgccagcctggagtacctcgaaggaaagaccctgcccggcatcgcggcattggaggaatag

SEQ ID NO: 56897 - protein, 395 aa, Thermobifida fusca
MRTIEDLDVAGKRVFVRADLNVPLDGDRITDDGRIRASLPTITALRERNARVIIGAHLGRPKGKVDPAYSLKPVAARLGELLGTEVRFASDTAGESAQAISRELADGEVALVENLRFEPGETSKDDAERGEFADRLAALAELYVGDGFGAVHRKHASVYDLPKRLPHAAGGLVLAEVNVLRKLTESPQRPYVVVLGGSKVSDKLGVIDNLLNTADRILIGGGMAYTFLAAQGYEVGASLLERDQIDTVKGYLRRAEERGVELVLPVDVVAAEKFAADAAHDVVDVREIPADRMGLDIGPASAELFASKLADAATVFWNGPMGVFEMEPYAKGTRSVAQALADSSAFTVVGGGDSAAAVRALGFDEKAFSHISTGGGASLEYLEGKTLPGIAALEE

SEQ ID NO: 56898 - DNA, 1242 bp, Methanosarcina barkeri str. fusaro
  CDS (1)..(1242)
atgtctcagaaaataactggaaaggattatttgacgatgagtgatgtcgtactggacaataaaagagtacttgtaagggtggactttaactcaccaatggatgataatggaaacatcctggacgataagaaaattaagagccatttgcctacgttgcagtccctggagcactcaaaagtggtcctgatgtctcatcagggtcgacctggagatgaagactataccaccctggaagcccatgcaaagctggcaacagagcttttgggtcgagaagtaacctacgaggatgatatattcagctcatgcgcaaggaatgctataaaatcccttgcccagggagagatcctgctccttgagaacacgcgtttcaatgccgaagagatcacgaaccgcccgcctgagaaacaggctaaaagccagatggtcaagaagttgtatccactatttgatctctttataaacgatgctttttcagtttctcacagatctcagtgttctgtggtagggtttacagaagtcttgcctagcgttgctggcatacttatggataaggaaattacaggcttggataaagccttgaaatgtcgtgagcacccagcaatcttcatactgggaggagcgaaagccaacgactccataaaggcgatttctaatattctcaaacgggctggagctgataagatccttaccacaggggtagtagctacaatatttatgatggcaatgggcgtcgatgtaagcgaggtcaacaggaaattcattgaagataagaaatatatggaccagatttcgattgcttccaagctactcaaggattactcaggcaagatcatcgtgcctcaggatgtagcgttaaacagtggtggagaacgtcaagaagtcgaagtggacaagataaaaaaaggaaatcttccaatagctgatattggccgagagaccatcgaaaattattccaaatatcttaaggaagcaaaactatgtgtttttcatggcccaaccggtatttttgaactagataatttcaggcttggtacggatgaacttcttaaggctgcggctcaagcaagctattctgtcgcaggaggagggcataccttagatgccattgatcaactcggtctgggctctaaattttctcatataagcatgggtggaggtgcaagtataacctatatctctggcgagcccttgccaggaatcacagctctgaaaaaaaatgcattcaggtaccatcaaggttaa

SEQ ID NO: 56899 - protein, 413 aa, Methanosarcina barkeri str. fusaro
MSQKITGKDYLTMSDVVLDNKRVLVRVDFNSPMDDNGNILDDKKIKSHLPTLQSLEHSKVVLMSHQGRPGDEDYTTLEAHAKLATELLGREVTYEDDIFSSCARNAIKSLAQGEILLLENTRFNAEEITNRPPEKQAKSQMVKKLYPLFDLFINDAFSVSHRSQCSVVGFTEVLPSVAGILMDKEITGLDKALKCREHPAIFILGGAKANDSIKAISNILKRAGADKILTTGVVATIFMMAMGVDVSEVNRKFIEDKKYMDQISIASKLLKDYSGKIIVPQDVALNSGGERQEVEVDKIKKGNLPIADIGRETIENYSKYLKEAKLCVFHGPTGIFELDNFRLGTDELLKAAAQASYSVAGGGHTLDAIDQLGLGSKFSHISMGGGASITYISGEPLPGITALKKNAFRYHQG

SEQ ID NO: 56900 - DNA, 1239 bp, Methanosarcina barkeri str. fusaro
  CDS (1)..(1239)
atgacttctagagactttcttacaatcgatgattttgacacgcacggaaagacaattcttgtaagggttgacctgaactcccctatggatccacagggtaatattctggatgatatgcggatccgaagccatattgccaccttgaaggatcttgaggacgcaaaagttgttttgcttgcacaccagagcaggcccggaaaaaaagactttactacaatgaagcctcatgccaacctgatgtccaaatacctgggaaagcaggttctttatgtagatgatatttttggaacttatgcaaagaccaggattgcttctatggaaaatggagatgtcatcctgctcgaaaatgtaaggttctattctgaagaaagcctcgaaagaactccagcagaacaggcaaaaacttatccggttaaaaaactggcaccttttgtagatatcttccttaatgatgcctttgccgtatctcacaggtctcaactttccgtagtaggatttacagaggttctccctaccggagccggaagggtcatggaaaaggaactcacgtctttggatcgggggatcaaaggaggggaacggccaacgattttcgttctcggaggggcaaaagtcgatgattcgctccatgtggcggaaaatgtgctttcaaatggaggagctgaccgggtactcctgaccggagtagtagcaaatgtggcacttgcggcatccggtatagatatcggaaaagtaaatctggacttcatcaaatcccagggctacgaagaccagatcgaaaaagcaaaaagtatacttacgaaattcaaagataaagttggtcttccaagggatgtggctttaaacgacaataagaagcgggtcgaattgcctgtttcagaacttaattctaattctcttcctataaacgatattgggcttgaaaccattgtggactttaccagtgaaatcgcaagtgcaaaaactgttatcttaaacggccctgcggggatttccgaagttgctgagtttgcccttggaacgcacgagattataaaagctgctattaaatccgagttttcaatcattggcggtgggcatatttcggcagaagttgagcatctcgggcttgcacaccgtttctctcacatcagtacaggtggcggggcactaattgattatctctcaggagtaaagctgcctggtgtagaggccctgaaatctgcagctaagagatatgaagaagctaagaaaatctaa

SEQ ID NO: 56901 - protein, 412 aa, Methanosarcina barkeri str. fusaro
MTSRDFLTIDDFDTHGKTILVRVDLNSPMDPQGNILDDMRIRSHIATLKDLEDAKVVLLAHQSRPGKKDFTTMKPHANLMSKYLGKQVLYVDDIFGTYAKTRIASMENGDVILLENVRFYSEESLERTPAEQAKTYPVKKLAPFVDIFLNDAFAVSHRSQLSVVGFTEVLPTGAGRVMEKELTSLDRGIKGGERPTIFVLGGAKVDDSLHVAENVLSNGGADRVLLTGVVANVALAASGIDIGKVNLDFIKSQGYEDQIEKAKSILTKFKDKVGLPRDVALNDNKKRVELPVSELNSNSLPINDIGLETIVDFTSEIASAKTVILNGPAGISEVAEFALGTHEIIKAAIKSEFSIIGGGHISAEVEHLGLAHRFSHISTGGGALIDYLSGVKLPGVEALKSAAKRYEEAKKI

SEQ ID NO: 56902 - DNA, 1197 bp, Geobacter metallireducens GS-15
  CDS (1)..(1197)
atggcaatccgctatatcgacgaaatcgaaagtctcaaggggaaaaaggtatttatcagggtcgacttcaacgttcctctggatgaacatcagaatataaccgaagacacccggatccgggccgtccttcccactatcaactttgcccttgatgcgggcgccaaggtaattcttgcatcccacttgggtcgcccaaagggtgagcgaaaaccgaagtattccatggctccggcggccaagcgcctctcgcgcctgctcaacaaggaagtgcaactggctcccgactgcatcggcgatgaagtcaagaagatgatcgacgccatgaaaccgggcgaagtccttctactcgaaaacgtccgtttctacgagggcgaagagaaaaatgacgccgatttcgccaaggccctggccaacgactgtgaaatatacatcaacgacgcctttgccgtctcccacagggcccacgcatccgtcgaagccatcacgaagtttttcccggtcgtcgctgccggtttcctcatgaacaatgagattaattatttcgagaaggcgatgcaaaagcccatcaggcccttggtcgccattctcggcggggccaaggtttccggaaaacttgaggtattggaaagcctggtcaacaaggtagacaagattatcattggcggcggcatggccttcacgttcctcaaagccctcggctataacgtcggcaaatcgctggtggaggaagaactgctggaaatcgccctcactacctacaccaaggcccgtgaaaaaggcgtgaaattctatctaccggtcgactgcgttgcggccgaccgcttcaaccccgaggctgaaaccaaagtgacgaccattcaggaaatccccgaggagtggatggcactcgacatcggaccggcaaccgtgaccctcttcacggaagcgctccagaacgccaaaaccattatctggaatggtcccatgggcgtattcgagatggatgccttctcccgcggaacctttgccatggtttcggccgtggccaactcctatgctctcaccatcgtcggaggaggagacaccgattcagccgtccatcgcgcgggggaatacgcgaagatcagctacatttccacaggcggcggcgcgttcctggaactcctcgaagggaagcatcttcccggcatcaaagtgctggaagaaaacggcaagtag

SEQ ID NO: 56903 - protein, 398 aa, Geobacter metallireducens GS-15
MAIRYIDEIESLKGKKVFIRVDFNVPLDEHQNITEDTRIRAVLPTINFALDAGAKVILASHLGRPKGERKPKYSMAPAAKRLSRLLNKEVQLAPDCIGDEVKKMIDAMKPGEVLLLENVRFYEGEEKNDADFAKALANDCEIYINDAFAVSHRAHASVEAITKFFPVVAAGFLMNNEINYFEKAMQKPIRPLVAILGGAKVSGKLEVLESLVNKVDKIIIGGGMAFTFLKALGYNVGKSLVEEELLEIALTTYTKAREKGVKFYLPVDCVAADRFNPEAETKVTTIQEIPEEWMALDIGPATVTLFTEALQNAKTIIWNGPMGVFEMDAFSRGTFAMVSAVANSYALTIVGGGDTDSAVHRAGEYAKISYISTGGGAFLELLEGKHLPGIKVLEENGK

SEQ ID NO: 56904 - DNA, 1188 bp, Novosphingobium aromaticivorans DSM 12444
  CDS (1)..(1188)
atgagcttcaagacccttgacgacatcggcgacctgaccggcaagaccgtgctggtgcgcgaggacctcaacgtgccgatgcaggacggcgcggtcaccgacgacacgcgtctgcgcgccaccatcgcgacgctgaacgagctgtccgacaagggcgcgaaggtgctcgtgctggcgcactttggccgccccaagggccagccgtcggaagaattttctttgaagaagctcgctgccccgctcgcgcacgtactgggccgtccggtcagctacatcgactgggaaagcgacaaggccgctgtggctgctctgacgcccggtgcgattgccgtgcttgagaacacccgcttcttcgacggcgaggaaaagaacgacccagccgtgatcgagcgtttcgccagcctcggcgacatttacgtcaatgatgccttttccgccgcccaccgcgcccacgcttcgaccgaaggcctggcacacgtgctgccggcctatgcaggccgcgccatggaggccgagctcaaggcattgcagaaggcgttgggggaacccgaacgtccggtggcagccgttgttggcggggccaaggtgtcgaccaagctcgacgtgctcaagcaccttgtcagcaaggtcgatcacctgatcatcggtggtggcatggccaacacgttccttgcggcgcgcggcgtgaacgtgggcaagtcgctgtgcgaacacgaccttaccggcaccgccgaggaaattctcgacaatgccgacaagtcgggctgcaccgttcacctgccgtacgacgtggtcgtttcgaaggagttcaccgcaaacccgccgagcctgcggacctgcaatgttcatgaggtcgctgcagacgagatgatcctcgacgtgggcccggccgcggtcgaggcgcttgctgatgtgctcaagacctgcaagacgctggtgtggaacggtccgatgggggcgttcgagaccgagccgttcgacgccgccaccgtggcgttggcgcgcacggctgcagctctgaccaaggaaggttcactcgtgtcggtggcgggcgggggcgataccgtggctgccctgaaccatgcgggcgtggttggtgatttctcttacatctcgactgcaggcggcgccttccttgagtggatggaaggaaaggaattgcccggcgtcgcggcgctggaaggatag

SEQ ID NO: 56905 - protein, 395 aa, Novosphingobium aromaticivorans DSM 12444
MSFKTLDDIGDLTGKTVLVREDLNVPMQDGAVTDDTRLRATIATLNELSDKGAKVLVLAHFGRPKGQPSEEFSLKKLAAPLAHVLGRPVSYIDWESDKAAVAALTPGAIAVLENTRFFDGEEKNDPAVIERFASLGDIYVNDAFSAAHRAHASTEGLAHVLPAYAGRAMEAELKALQKALGEPERPVAAVVGGAKVSTKLDVLKHLVSKVDHLIIGGGMANTFLAARGVNVGKSLCEHDLTGTAEEILDNADKSGCTVHLPYDVVVSKEFTANPPSLRTCNVHEVAADEMILDVGPAAVEALADVLKTCKTLVWNGPMGAFETEPFDAATVALARTAAALTKEGSLVSVAGGGDTVAALNHAGVVGDFSYISTAGGAFLEWMEGKELPGVAALEG

SEQ ID NO: 56906 - DNA, 1239 bp, Ferroplasma acidarmanus
  CDS (1)..(1239)
atggataggtccccgttttacactatggacgattttgatttcaatggcaagagagtgtatcttagaatagatataaattccccaattaaccctataaccggagaagtagtggatgatacaagattcattcattatttgaggacaattaacgaacttaaaaactcaaaggttgttattattgcccaccagggaaggccgggcgacagtgattttgtaagtttgcggcaacatgcagggcatcttggcaggctgttaggcagagatgttttattcgttgattcattgatagggtctgcagtggaaacagctataaggaacatgaaaaatggagatattatcatgctggagaactccagattctatagcgaagaaatacttataaaagatgatggggctgcccagaaaaacacatttattgtcaggaatttatcaaaattatttgattactttataatcgatgcttttcctgcgatacacagggaccagacaacacttaccggattcaaggatataaaacccaatatagctggcaggcttatggaaactgaaattaatagcatagacaggttcatgaattctaaatcacatccgaaactggctataatgggtggagccaaaataagggatgctataaaggtaacaggcccattcctggagaaagggatagtggacaatataatttttggtggtgtggcagcaaacatattcctgtgggcttccgggatagacatagggaaaaggaacatggaattcatcgaaaaacaggataaaaattataagaaattgctggaggaatgcaaatcgttgttatcccgattctccgatcgcatatacctccctgaagatttcatgcttaatcccttacagacagaaataaaaacaggtgagaaggttccagatgggcagttgctggcggatattggatttgagtccattaaaacttttagcagtattatagaaaaagcaaaaaatatatttctcaatggcccgatgggaatgtatgaaataaatgaatactcacttggaaccagggaaatatttaatgcagtttcccagagccctgcatcaaaaatagtcgggggagggcacacaataaatgcaattaatgaattcgggctttcagattccatgggatatatatcaaccgggggtggcgccctgataaattatttatccggtgagcctatacctgtaatagactcacttgtttataacaggaaaaaatttggaggtaattaa

SEQ ID NO: 56907 - protein, 412 aa, Ferroplasma acidarmanus
MDRSPFYTMDDFDFNGKRVYLRIDINSPINPITGEVVDDTRFIHYLRTINELKNSKVVIIAHQGRPGDSDFVSLRQHAGHLGRLLGRDVLFVDSLIGSAVETAIRNMKNGDIIMLENSRFYSEEILIKDDGAAQKNTFIVRNLSKLFDYFIIDAFPAIHRDQTTLTGFKDIKPNIAGRLMETEINSIDRFMNSKSHPKLAIMGGAKIRDAIKVTGPFLEKGIVDNIIFGGVAANIFLWASGIDIGKRNMEFIEKQDKNYKKLLEECKSLLSRFSDRIYLPEDFMLNPLQTEIKTGEKVPDGQLLADIGFESIKTFSSIIEKAKNIFLNGPMGMYEINEYSLGTREIFNAVSQSPASKIVGGGHTINAINEFGLSDSMGYISTGGGALINYLSGEPIPVIDSLVYNRKKFGGN

SEQ ID NO: 56908 - DNA, 1188 bp, Cytophaga hutchinsonii
  CDS (1)..(1188)
atgaaaacagtagacagttttaacttttcaggtaaaaaagccctgatacgcgttgattttaacgtccctcttaataagagttttgaaattacagatgatacaagattaaaagcagtattacctactgtttcgaaagtattaaaagatggtggttcagcaattttgatgtcacacttaggtagaccaaaaggtggaccggaagaaaaatattctttaaaacacatccttccttatctgaacaaaatgttcggacaggaagtattgtttgcggcggattgtatcggtgaagatgcaaaagcaaaagcagcagcattaaaaccaggtcaggtattattacttgagaacttacgtttctatccggaagaagaaaaaggcgatgttgaattcgcaaaaaaactttctgtattaggtgatgtatgggtgaatgatgcatttggtaccgcacacagagcacatgcttcaacagcggtaatcggacaattcttcaaagataaagtttgcgggtatgtaatgcaggctgaacttgacaatgcaaataaattattaaagcaaggtgaaaaaccaatcacagctgttatgggaggttctaaaatctctgataaaatcatggtgattgaaaacttattagatacggttgacaacctgataatcggtggcggtatgtcttataccttcacaaaagcattaggcggaaagattggcaaatcaatcaacgaaccagataaattagagcttgcgctttcgttaattgaaaaagctaaagcgaaaaatgttaaattatatttaccgttagataacgttgttgcagatgatttcagcaacgatgcaaacaagcagacagtaaaaacgggtgaaattccggatggctgggaagggctggatatcggacctgaaactgttaagttattcagcgaagtagttgcaaactctaaaactgttttatggaacggaccaatgggcgtgtttgaatttgcaaactttgctactggtacgattgctattgctaaagcagttaaagaagcaacacaaaaaggagctttctcattaatcggtggtggcgactcagctgctgcaatcaacaatttaggtttcggtaacgatgtatcttacgtttctacaggcggcggtgcattacttgaatacttcgaaggcaaaacacttccgggtgtggcggcgttggagaaatag

SEQ ID NO: 56909 - protein, 395 aa, Cytophaga hutchinsonii
MKTVDSFNFSGKKALIRVDFNVPLNKSFEITDDTRLKAVLPTVSKVLKDGGSAILMSHLGRPKGGPEEKYSLKHILPYLNKMFGQEVLFAADCIGEDAKAKAAALKPGQVLLLENLRFYPEEEKGDVEFAKKLSVLGDVWVNDAFGTAHRAHASTAVIGQFFKDKVCGYVMQAELDNANKLLKQGEKPITAVMGGSKISDKIMVIENLLDTVDNLIIGGGMSYTFTKALGGKIGKSINEPDKLELALSLIEKAKAKNVKLYLPLDNVVADDFSNDANKQTVKTGEIPDGWEGLDIGPETVKLFSEVVANSKTVLWNGPMGVFEFANFATGTIAIAKAVKEATQKGAFSLIGGGDSAAAINNLGFGNDVSYVSTGGGALLEYFEGKTLPGVAALEK

SEQ ID NO: 56910 - DNA, 1194 bp, Clostridium thermocellum ATCC 27405
  CDS (1)..(1194)
atggcaatgatgaacaagaaaaccattgaggatattgacgtaaaaggtaaaaaggttatagtcagggttgattttaatgtgcctttggacgaaaacagaaagattaccgatgacaagagaatagttggtgcgcttccaaccatcaagtatctggttgaacacggtgcaaaaactatattggtttcacacctgggaagaccaaaagaaggttttgaggaaaagtacagcatggctccgactgccgtaagattgggagaacttcttggaaaagaagtaataatggcgaaagatgttattggtcctgatgcaaaggcaaaagcagcggcattaaaagaaggagaagttttaatgctcgaaaatgtcagattccacaaggaagagactaaaaacgatcctgcttttgcaaaagaattggcaagcatggctgaaatttatgtaaatgatgcgttcggaactgcccacagagcccacgcttcaacggcaggtcttgccgactatctgccggcggtatgcggatacctcatccaaaaggaaattgaggttatgggcaaggctctgtcaaatcctgaaagaccgtttgtggcaatattgggcggtgccaaggtttcagacaaaataggcgttattgagaaccttattgacaaagttgacactcttataatcggcggaggtatggcatataccttctttaaagcaaagggatacagcataggaacatccctgtgtgaagatgataaagttgagcttgcaaagagccttatggataaagcagagaaaaagggagtaaaactcttgcttcctgtggacaatgttgtaggcaaagagttcagcaatgatacagaacgcaagactgttccgtctgaccagattccggacggatggatgggtatggacatcggtgaggaaacaatcaagttgtattctgaggcaatcaagaatgccaaaaccgtggtatggaacggtcctatgggcgtatttgagttctccaactttgccaacggtacaagggaagttgcaagagcggttgccgagtccggagcaatttcaataatcggaggcggagattctgccgcagctatagaacagcttggttttgccgataagattacccacatttcaaccggaggcggcgcgtctttggagtttcttgaaggaaaagtattgccgggaattgatgtattaatggataaataa

SEQ ID NO: 56911 - protein, 397 aa, Clostridium thermocellum ATCC 27405
MAMMNKKTIEDIDVKGKKVIVRVDFNVPLDENRKITDDKRIVGALPTIKYLVEHGAKTILVSHLGRPKEGFEEKYSMAPTAVRLGELLGKEVIMAKDVIGPDAKAKAAALKEGEVLMLENVRFHKEETKNDPAFAKELASMAEIYVNDAFGTAHRAHASTAGLADYLPAVCGYLIQKEIEVMGKALSNPERPFVAILGGAKVSDKIGVIENLIDKVDTLIIGGGMAYTFFKAKGYSIGTSLCEDDKVELAKSLMDKAEKKGVKLLLPVDNVVGKEFSNDTERKTVPSDQIPDGWMGMDIGEETIKLYSEAIKNAKTVVWNGPMGVFEFSNFANGTREVARAVAESGAISIIGGGDSAAAIEQLGFADKITHISTGGGASLEFLEGKVLPGIDVLMDK

SEQ ID NO: 56912 - DNA, 1197 bp, Microbulbifer degradans 2-40
  CDS (1)..(1197)
atgactcaagaggaaatatccatggctgttattcagatgaaggacctcgatcttaaaggcaaacgcgttcttattcgccaagatctaaacgtacccctacaggatggtgaaatcacctccgatgtacgtatccaagcatcattgcctaccatcaaagccgcagtagacgcgggtgctaaagtgatgttgatgtctcacttgggccgccctaccgaaggcgaatacgctgacgaattttctttaaagcctgttgctgcacgcttaaccaaattgttgggcaaagaagtgggcttggtaaaaaactggcaagaaggcgttgctgttgctgaaggcgaagttgtattgctagaaaacgtgcgctttaacgtgggcgagaaaaaagacgacgaaacattagctaaagcgtacgcagcattgtgcgacgtatttgtgatggatgcattcggtaccgcgcaccgcgcgcaagcatctacccacggcgtcgcgaaatttgcaccggttgcctgcgcaggcccgctattgtctggcgagttgagtgcattagaaaaagccctagccaaccctgcgcgcccaatggttgcggtggtaggtggctctaaagtttctacaaaattaaccgtattagatgcgctttctaaaattgttgatgtaatggttgtgggtggcggtatctccaacactttcgttgctgctgccggtaacgaagtaggcaactctttatacgaaaaagatttaattccagaagcgcaacgcttgtgtgcagaaactgaagttatttacgcgcacgatgtgcgagtaactaaagagggcttcagcgattggaatcacaactctgtaactgaagttaaagtacctgcagatattcaagccgacgaagaaattattgactacggcccagaaactgcgcaaaaagttgccgctattttgaaagatgctaaaaccattatttggaacggcccgtgtggcgttttcgagtttgatgcgtttgctaaaggtaccgaagtggttgcgcgcgcaattgcagaaagcgaaggcttctctattgccggcggcggtgacaccttagcggcaattgataaattcggtttggccgacggcgtttcttacatttctaccggtgggggtgctttcttggaatacgtagaagggaagccgttacccgctgtagtgatgttagaagagagagctaagggttaa

SEQ ID NO: 56913 - protein, 398 aa, Microbulbifer degradans 2-40
MTQEEISMAVIQMKDLDLKGKRVLIRQDLNVPLQDGEITSDVRIQASLPTIKAAVDAGAKVMLMSHLGRPTEGEYADEFSLKPVAARLTKLLGKEVGLVKNWQEGVAVAEGEVVLLENVRFNVGEKKDDETLAKAYAALCDVFVMDAFGTAHRAQASTHGVAKFAPVACAGPLLSGELSALEKALANPARPMVAVVGGSKVSTKLTVLDALSKIVDVMVVGGGISNTFVAAAGNEVGNSLYEKDLIPEAQRLCAETEVIYAHDVRVTKEGFSDWNHNSVTEVKVPADIQADEEIIDYGPETAQKVAAILKDAKTIIWNGPCGVFEFDAFAKGTEVVARAIAESEGFSIAGGGDTLAAIDKFGLADGVSYISTGGGAFLEYVEGKPLPAVVMLEERAKG

SEQ ID NO: 56914 - DNA, 1215 bp, Oenococcus oeni PSU-1
  CDS (1)..(1215)
atgacaaaattaactgtaaaagaccttgacttaaaaggcaaaaaagttttgatgcgggttgatttcaacgtaccgattaaggatggcgttattggcaatgacaaccgtgttgttgctgctttgccaacgattaaatatgttcttgaacagggtggaaaggctattctttttagccatctcggtcgtattaagaaggctgaggacaagccaggcttgagtttggccccggtggccaagcatctgagcgatttgcttaatcaagaagttgttttccctggaaaaaccgaggggaaagagctcgaagatgctatcgacaaattaaaagacggccaggtattaatggttgaaaatacacgctatgaggacgtcgacgccaatggcgagtacgttaaacgcgaatccggcaacgaccctgaattaggtaaatattgggctgatttgggggatgatttgtttgtcaacgatgcttttggaacagcacatcgttcccatgcgtcgaatgttggcattgcctcgaatgtttcgaaaactgctgctggatttctaatggaaaaagaaatcaagtatttggatgaggctgttaataatccaaagcgtccattcgtggctgtcttaggaggcgccaaagtttctgataaaatcgaagttatcaaaaatttgttgtcaaaagccgacaaagttattgttggtggtgggatgagttacactttttccaacgccaagggcgtgaagattggtaattctttgtttgaagccgataaagtctctttggccaaagaaattatgaaagaagcaggtgacaagctcgttttgcctgaggattcggttgcagctgaaagctttgcaaacgatgttccaacaaaggtttttgaaaacggtattcctgatggttggatgggtcttgatattggaccaaaaacgatcgagaaattcaaaaataccctaaaaggggccaagacagttgtttggaacggtccgatgggtgtctttgaaatgagtaatttcgctaacggaactttggaattaggaaagtttattggatccctaacttctgaaggagcggcaacaattgttggtggtggtgattcaactgccgcagtttctcaacttggaattgctgatcaatttactcacatttctacaggtggtggagctagtcttgaatatctggaaggtaaaactcttcctggcattgctgctatttctgataagtga

SEQ ID NO: 56915 - protein, 404 aa, Oenococcus oeni PSU-1
MTKLTVKDLDLKGKKVLMRVDFNVPIKDGVIGNDNRVVAALPTIKYVLEQGGKAILFSHLGRIKKAEDKPGLSLAPVAKHLSDLLNQEVVFPGKTEGKELEDAIDKLKDGQVLMVENTRYEDVDANGEYVKRESGNDPELGKYWADLGDDLFVNDAFGTAHRSHASNVGIASNVSKTAAGFLMEKEIKYLDEAVNNPKRPFVAVLGGAKVSDKIEVIKNLLSKADKVIVGGGMSYTFSNAKGVKIGNSLFEADKVSLAKEIMKEAGDKLVLPEDSVAAESFANDVPTKVFENGIPDGWMGLDIGPKTIEKFKNTLKGAKTVVWNGPMGVFEMSNFANGTLELGKFIGSLTSEGAATIVGGGDSTAAVSQLGIADQFTHISTGGGASLEYLEGKTLPGIAAISDK

SEQ ID NO: 56916 - DNA, 1203 bp, Pediococcus pentosaceus ATCC 25745
  CDS (1)..(1203)
ttggctaaattaactgtttcagatttagatgttaagaacaagaaagttttgatgcgcgttgactttaacgtgccagttaaaaatggtgtgattggtgatgacaaccgtgtcgttgctgctcttccaacaattaaatacattatcgaaaacggtggaaaggcaattcttttctctcacttaggtcgtatcaagactgaagaagacaaaaaagaattgactcttcgtccagttgctcaacgcctttcagatcttcttggcaaaccagttacatttgttcctgtaacacgcggtgcacaacttgaagatgctgttaatggcatgaacgacggcgatgtattattgttcgaaaacacacgttttgaagacttagatggcaagaaggaaagtaaaaacgatcctgaacttggcaaatactgggcatcacttggcgacatgttcgtaaacgatgctttcggtacagctcaccgtgcccacgcttcaaacgttggtgttgctgaagcaatgaaggctgacggcaagcaagttgctgctggtttccttatggaaaaagaaatcaagttcttgggtgaagctgttgacgaacctaagcatccatttgttgctattttaggtggcgcaaaggtttctgacaagattggtgtaattgatcacttacttaataaagctgacaaagttattattggtggtggtatgacatacacattctacgctgctaaaggcatgagcattggtaactcacttgttgaagctgacaagattgatgttgctaaagaaatccttgctaagggtggcgacaagattgttcttccttcagacagtatcgttgctgaaaaatttgataacgatgttcctaacaaagttgtcgaaggcgatattcctgatggttacatggctcttgatattggacctaagtcagttgcagaatttaaggatgtccttaaagatgctaagactgttgtatggaacggaccaatgggtgtattcgaaatgagcaactatgctaacggtacacttgaagttggtaagttcttaggtacattatcagacgctacaacaattgttggtggtggtgactcaactgctgctgttaagcaattaggcgttggcgaccaattgacacatatctcaactggtggtggagcttcacttgaataccttgaaggtaaagaacttcctggtatcgctgctatttcaaacaaataa

SEQ ID NO: 56917 - protein, 400 aa, Pediococcus pentosaceus ATCC 25745
MAKLTVSDLDVKNKKVLMRVDFNVPVKNGVIGDDNRVVAALPTIKYIIENGGKAILFSHLGRIKTEEDKKELTLRPVAQRLSDLLGKPVTFVPVTRGAQLEDAVNGMNDGDVLLFENTRFEDLDGKKESKNDPELGKYWASLGDMFVNDAFGTAHRAHASNVGVAEAMKADGKQVAAGFLMEKEIKFLGEAVDEPKHPFVAILGGAKVSDKIGVIDHLLNKADKVIIGGGMTYTFYAAKGMSIGNSLVEADKIDVAKEILAKGGDKIVLPSDSIVAEKFDNDVPNKVVEGDIPDGYMALDIGPKSVAEFKDVLKDAKTVVWNGPMGVFEMSNYANGTLEVGKFLGTLSDATTIVGGGDSTAAVKQLGVGDQLTHISTGGGASLEYLEGKELPGIAAISNK

SEQ ID NO: 56918 - DNA, 1197 bp, Trichodesmium erythraeum IMS101
  CDS (1)..(1197)
atgacaaaaaaaactgtagcaagtttatcaaaatctgacttatctggcaaaaaggtacttatgcgggctgattttaatgtacctgttgataatggtagtattacagacgatactagaattcgggcagctcttcccacaattcaagatttaactgagaaaggtgcaaaagttatcttgactagtcattttggacggccaaagggaaaggttaatgaaaagatgcgtctgactcttgtgggggagagactctctgaagtattgggtaaagaagttaaaaagtgtgacgactgcattggtgatgaagtaacttctactgtggcggaaatgaaagatggtgatgtagttttgctagaaaatgttcgcttctactctggagaggaggggaatgatccagagtttgccaaacaacttgcttctgtggcagatttatatgtgaatgatgcttttggaactgctcatcgtgctcatgcttcgactgagggcgtgactaaatatttgagtccttctgttgctggttatttaattgaacaggaactaaaattcctccaaggtgcaattgatagtcctcaaaaacctttagctgcaattattggtggttctaaggtttctagtaaaattggtgtaatagaagctttgttggataagtgtgataagttgctcttgggtggtggtatgattttcactttctacaaagctcgtggtttaagtgtgggtaagtctctggttgaggaagataagatagaattggcaaagtctttggaagctaaggcaaaagagaaaggtgtaacaatgttgttacctactgatgtggttgtagctgataagtttgacccagaggcgaatactcaaactgttagtattgaagctattccggatggttggatgggtttggatatcggacctgagtctgcaaaggtttttcaagatgctttagcagactgtaaaactgtaatttggaatggtccgatgggggtatttgagatggagaaatttgctaaaggtactgaagcgatcgctcagactcttgctgataagcaggatgctattactattattggtggtggtgactctgttgctgcggtggagcagttaggtttgggtgaaaaaatgagtcacatttctactggtggtggtgctagtttggaattgttggaaggtaagaagttacctggtattgttgctttagatgatcaataa

SEQ ID NO: 56919 - protein, 398 aa, Trichodesmium erythraeum IMS101
MTKKTVASLSKSDLSGKKVLMRADFNVPVDNGSITDDTRIRAALPTIQDLTEKGAKVILTSHFGRPKGKVNEKMRLTLVGERLSEVLGKEVKKCDDCIGDEVTSTVAEMKDGDVVLLENVRFYSGEEGNDPEFAKQLASVADLYVNDAFGTAHRAHASTEGVTKYLSPSVAGYLIEQELKFLQGAIDSPQKPLAAIIGGSKVSSKIGVIEALLDKCDKLLLGGGMIFTFYKARGLSVGKSLVEEDKIELAKSLEAKAKEKGVTMLLPTDVVVADKFDPEANTQTVSIEAIPDGWMGLDIGPESAKVFQDALADCKTVIWNGPMGVFEMEKFAKGTEAIAQTLADKQDAITIIGGGDSVAAVEQLGLGEKMSHISTGGGASLELLEGKKLPGIVALDDQ

SEQ ID NO: 56920 - DNA, 1182 bp, Moorella thermoacetica ATCC 39073
  CDS (1)..(1182)
atggccaagttaaccctcaaagatctggagcttaacaataaacgggtcctggtgcgggtcgatttcaacgtccccctggaggcaggccgggtgactgacaatacccgtatccgggcggccctgcctaccattgaatacctgctggaccacggcgcccgggtgattcttatgtcccacctgggccggcccaagggtaaggtcaaggaagagctgcgcctggacccggtggccagggaactggaaagcctcctgggccggcaggtacataaggtcaacgactgcgtcggtcccgaagttgaggccgcagccgccgccctcaagcccggcgaggttctcctcctggaaaacctgcgcttccatcccgaagaagaaaagaacgaccccggtttcgcccggcagctggccagcctggccgatgtctatgtgaacgacgcctttggcgccgcccatcgcgcccatgcttccaccgagggcgtagcccactacctgccggcggcggccggtttcctgctccaaaaggagatcgagaccctgggcaaggccctggctgatcccgagcggccctttgtggccattattggcggggccaaggtatccgacaagatcagcgttatccgtaacctccttaccaaagtagacaccctgattatcggcggtggcatggccaacaccttcctgaaggcccagggctatgccatgggtaaatccctggtcgaagaagatcaggtacccctggcccaggagttgatccagcttgccgcccagaagggggtaaaaatgctcctgccccgggacctggtagtggcccaggagtttaaggccgatgccccccaccaggtagttgctgtaaatgccgtgcctgacggctggatggccctggatatcggcccggaaacggcccgggcctacgccggcgccctggagggagcccgtaccgtcgtctggaacggccccatgggcgtctttgagatggaggcctttgcccacggcaccgaggctgtagcccgggcagtggccgccgtcgacggcatgaccatcgttggtggcggcgattccgtcgctgccgtggaaaagatgggcgtggccggaaagatcgggcatatctccaccggtggcggcgcctccctggagttcctggaaggcaaagcccttcccggcgttgtcgccctgacggaaaagtaa

SEQ ID NO: 56921 - protein, 393 aa, Moorella thermoacetica ATCC 39073
MAKLTLKDLELNNKRVLVRVDFNVPLEAGRVTDNTRIRAALPTIEYLLDHGARVILMSHLGRPKGKVKEELRLDPVARELESLLGRQVHKVNDCVGPEVEAAAAALKPGEVLLLENLRFHPEEEKNDPGFARQLASLADVYVNDAFGAAHRAHASTEGVAHYLPAAAGFLLQKEIETLGKALADPERPFVAIIGGAKVSDKISVIRNLLTKVDTLIIGGGMANTFLKAQGYAMGKSLVEEDQVPLAQELIQLAAQKGVKMLLPRDLVVAQEFKADAPHQVVAVNAVPDGWMALDIGPETARAYAGALEGARTVVWNGPMGVFEMEAFAHGTEAVARAVAAVDGMTIVGGGDSVAAVEKMGVAGKIGHISTGGGASLEFLEGKALPGVVALTEK

SEQ ID NO: 56922 - DNA, 1182 bp, Thiobacillus denitrificans ATCC 25259
  CDS (1)..(1182)
atggcattcatccgcgtcaccgatctcgatctggcgggcaagcgcgtcttcatccgcgccgacatgaacgtgcccgtcaaggacggcaaggtcacgtccgacgcgcgcatcaccgcctcgatgcgcaccatcgagcactgcatgagggccggcgccaaggtcatggtgacctcgcacctcggccgcccgaccgaaggcgagttcaaggaagaggattcgctgaagcccgtcgtcgacgtgatcgcgcagaagctcggcaaaaacgtgcgcctgatccgtgaatggaccgagggcggtttcgacgtcgcgaacggcgaactcgtcgtgctcgagaactgccgcgtcaacaagggcgagaagaagaacgtcgacgagaccgcgaagaaatacgccgcgctgtgcgacgtcttcgtgatggacgccttcggcaccgcgcaccgcgccgaagcctcgacccacggcatcgccaaattcgcgccgaccgctgccgccggcattctgctcaccgaagagctcgacgcgctggccaaggcgctcgccaacccggcgcggccgatggtcgcgatcgtcggcggctccaaggtctcgaccaagctgaccgtgctcgaggcgctgtccgagaaggtcgaccagttggtcgtcggcggcggcatcgccaacaccttcctcgccgcgatgggcaagaacgtcggcaagtcgctgtgtgaacacgacctgatcccgactgccaagacgctgatcgagaagatggccgcgcgcggcgcctcgatcccgatcgccgtcgacgtggtgtgcggcaagaagttcgacgccaacgagcccgccgtgctgaagagcgccgacgaggtggccgacgacgacatgatcttcgacatcggcccgaagagcgcgcaggagcttgccgacatcatcgccaaggccggcacgattgtgtggaacggcccggtcggcgtgttcgagttcgaccagttcggcgaaggcaccaagaccgtctcgatggcgatcgccaacgccccgggcttcagcctggccggcggcggcgacaccatcgccgcgatccagaaatacgacatctacgacaaagtgagctatatctcgaccgccggcggcgccttcctcgaatacctggaaggcaaggtgttgccggccgtggcgattctggaggaacgcgcgcaaggctaa

SEQ ID NO: 56923 - protein, 393 aa, Thiobacillus denitrificans ATCC 25259
MAFIRVTDLDLAGKRVFIRADMNVPVKDGKVTSDARITASMRTIEHCMRAGAKVMVTSHLGRPTEGEFKEEDSLKPVVDVIAQKLGKNVRLIREWTEGGFDVANGELVVLENCRVNKGEKKNVDETAKKYAALCDVFVMDAFGTAHRAEASTHGIAKFAPTAAAGILLTEELDALAKALANPARPMVAIVGGSKVSTKLTVLEALSEKVDQLVVGGGIANTFLAAMGKNVGKSLCEHDLIPTAKTLIEKMAARGASIPIAVDVVCGKKFDANEPAVLKSADEVADDDMIFDIGPKSAQELADIIAKAGTIVWNGPVGVFEFDQFGEGTKTVSMAIANAPGFSLAGGGDTIAAIQKYDIYDKVSYISTAGGAFLEYLEGKVLPAVAILEERAQG

SEQ ID NO: 56924 - DNA, 1191 bp, Silicibacter sp. TM1040
  CDS (1)..(1191)
atgggctggaagacactcgacgacatggatctgcaaggcaaaagcgttttgacccgcgtggatatcaacgtcccgatggaagacggcaaagtcaccgatgacacccgcatccgccgcctcgtgccgacgatttccgacctgctctccaagggtgcaaaacctgtgctgctggcgcattttggccgcccgaagggcaaggtggtgcccgagatgtcgttgcagccgctggtccccgcgctggaggccgcctttggcgcgccggtgatgtttgtggccgattgccgaggccccgctgcaaaaggcgccgttgacgcgctcgcgcccgggcagatcctgctccttgagaacacgcgcttttatcccggcgaagaacaaaacgatgccgatctcgccaaagagatggccgcgcttggtgatatctactgcaatgatgccttctctgccgcccaccgcgcccatgcctccaccgaggcgctggcgcgcctgctgcctgcctgcgcgggccgcctgatggaggcagaactgaaagcgctcgaaggctctctggccacgcctgaacgccccgtcactgcggttgtgggcggcgccaaagtttcgaccaaactggaccttctgggcaatctggtggccaaggtagacacgcttgtgatcggcggcggcatggccaatacctttcttgcggcccaaggcatcgacgtgggcaaatcgctttgcgaacatgacatgacaggcaccgccaaggacatcatggcccgcgccgaggcggcaggctgcaccatcctgctgccgtcggacgtggtggtcgcgcgcgaattcaaggccggcgccgacaatgaaaccgtacccgcggacgcctgccctgcggatgcgatgatcctggatgctggccccgcctcggttgcggccatttccacagtctttgccgagagcaagaccctgatctggaacggcccgcttggtgcctttgaaatcgcgccctttgatattgcgaccaatacagcggcgcaaaaggcggcagaactcaccaaggccggccagctgatttccgttgcgggcggaggcgacaccgtcgctgcgctcaatcaggccggagcggcagaggcctttagctacatctccaccgccgggggcgccttccttgagtggatggagggcaaggtcctgcccggcgtcgctgccctgcagacctga

SEQ ID NO: 56925 - protein, 396 aa, Silicibacter sp. TM1040
MGWKTLDDMDLQGKSVLTRVDINVPMEDGKVTDDTRIRRLVPTISDLLSKGAKPVLLAHFGRPKGKVVPEMSLQPLVPALEAAFGAPVMFVADCRGPAAKGAVDALAPGQILLLENTRFYPGEEQNDADLAKEMAALGDIYCNDAFSAAHRAHASTEALARLLPACAGRLMEAELKALEGSLATPERPVTAVVGGAKVSTKLDLLGNLVAKVDTLVIGGGMANTFLAAQGIDVGKSLCEHDMTGTAKDIMARAEAAGCTILLPSDVVVAREFKAGADNETVPADACPADAMILDAGPASVAAISTVFAESKTLIWNGPLGAFEIAPFDIATNTAAQKAAELTKAGQLISVAGGGDTVAALNQAGAAEAFSYISTAGGAFLEWMEGKVLPGVAALQT

SEQ ID NO: 56926 - DNA, 1242 bp, Methanococcoides burtonii DSM 6242
  CDS (1)..(1242)
atgaataccttgactgctaaagattttctcacgatagacgattttgatataggggatagaacaattcttgtgagggtggacctgaactctccaatgagtcctggcggtggcatacttgatgatatgaggatcaaaagccatataccgacccttatggacctggaggatgcgaaggtagtgctgttagctcaccagagccgaccaggaaagaacgatttcactactatgcaactacatgctgatgtgatgtccagttcactgggtcggaaagttacctatatcgatgatatttttggtacccatgcaagagatagcatcgcttcaatggaaaagggggatgttatccttctggagaatgtgcgtttctattctgaagaaagcttgagaagacctgttgatgaacatcaggggactcatatggtgcgaaaacttgctccgcttttcgatattttcctgaacgatgcatttgcggtgtcccatcgttcccatctttcgatcacagggttttctggagttcttccgtctggagcaggtcgtcttatggagagggaaataacttctcttgatgtgagccttaaaggatctgaatctccatgcatatttgttcttggcggtgcgaaggtcgatgattctctcaaggtggctgagcatgtcctttcaagtggcggtgctgacagggttctggttacaggagtggtcgcaaatgtcgtgcttgctgcatcaggtgttgatattggtggacctaatatgaagttcatcgaatcccagggatatcttgaccagatagataaggcgaaaaatatcctggagagattcgatggtaagctcggttttccaagggatgttgctcttaatgataatggagaacgtatcgaggcaaacatcgatgatgtggcttcgtcaaatcttccaattaatgatatcggtcttgagaccattgtagcgtattcaagcgagattgaaaatgcgaagacggttgttttaaatggtcctgcgggcgtttctgagatagagggctttgagataggcacctctgagatcatcaaggcagcaacaaatgccggttattcaattgctggcggtggccacattactgctgaagtgcgtaatatgggttatgagaagatgttctcacacataagcacaggtggcggggcatgtattgattatcttgccggggacctcttgcctggcattgaagctttaaaggttgctgcaaaaagatatagggaatttgaatga

SEQ ID NO: 56927 - protein, 413 aa, Methanococcoides burtonii DSM 6242
MNTLTAKDFLTIDDFDIGDRTILVRVDLNSPMSPGGGILDDMRIKSHIPTLMDLEDAKVVLLAHQSRPGKNDFTTMQLHADVMSSSLGRKVTYIDDIFGTHARDSIASMEKGDVILLENVRFYSEESLRRPVDEHQGTHMVRKLAPLFDIFLNDAFAVSHRSHLSITGFSGVLPSGAGRLMEREITSLDVSLKGSESPCIFVLGGAKVDDSLKVAEHVLSSGGADRVLVTGVVANVVLAASGVDIGGPNMKFIESQGYLDQIDKAKNILERFDGKLGFPRDVALNDNGERIEANIDDVASSNLPINDIGLETIVAYSSEIENAKTVVLNGPAGVSEIEGFEIGTSEIIKAATNAGYSIAGGGHITAEVRNMGYEKMFSHISTGGGACIDYLAGDLLPGIEALKVAAKRYREFE

SEQ ID NO: 56928 - DNA, 1203 bp, Chloroflexus aurantiacus
  CDS (1)..(1203)
atgaacaagaagaccatccgtgatgtggattgggccggaaaacgtgcgctggtacgagttgatttcaacgtgccactcgatgatcagggtcagattaccgatgatacccggattcgggcggcattaccgaccattcgctatctgctggaacacggtgccagtgtggtcttgatgtcgcacctggggcgtccgaagggtaaacccaatccgaagtacagtttacgtccggttgttgagcgtttgtttgaattgctgcccgaagcgaaagaggtcaagaagaccgaggcgatcaccgggccggcggctgaagcggctgtggcgatgctgaaaccagggcaggtcctggtactcgaaaacacccgcttcgatccccgtgaagagccaaacgatccagcgatggccgctgaactggcgaaattgggtgatgttttcgttaacgatgccttcggcaccgctcaccgggccaatgccagcactgagggtgtagcgcactacctgccggcagttgccggttttcttatggaaaaggaactgacgtacatcggtggcgccctgaataatccgcagcgtccattcgtaaccgtcatcggtggtgcgaaaatcagtgacaagatcggcgtgatcgaaaatctgctgggtaaggtcgatgcactgctcattggtggtggtatggccaacacctttctgcttgccaaagggctgaatgttggtgattcgctggtcgaaccggacagtgtaccggtggcccagcagttgatggcccgtgctgaagagcggggtgcccggctgcttttgccggttgacgtggtgattgccgatgcgtttagtgccgatgcccagcgccaggttgttgatgtaagtgacattcctgccggctggcgtgtgctcgatattggccccaagaccatcgaacgatacagtgccgagattcgggctgcccgcacggttatctggaatgggccaatgggtgtctttgaactagagccgtttgccgtcggtacacgcgctatcgcccaggcaatggccgaagcggctgccaatggcgcaatcacaattgttggtggtggcgatagtgtggccgcagtggaacaggccggcctggccgataagatgtcgcatgtgagtaccggcggtggtgcctcacttgagttacttgagggacgagtcttacccggtgtggctgcgttgcaagatgcagagtag

SEQ ID NO: 56929 - protein, 400 aa, Chloroflexus aurantiacus
MNKKTIRDVDWAGKRALVRVDFNVPLDDQGQITDDTRIRAALPTIRYLLEHGASVVLMSHLGRPKGKPNPKYSLRPVVERLFELLPEAKEVKKTEAITGPAAEAAVAMLKPGQVLVLENTRFDPREEPNDPAMAAELAKLGDVFVNDAFGTAHRANASTEGVAHYLPAVAGFLMEKELTYIGGALNNPQRPFVTVIGGAKISDKIGVIENLLGKVDALLIGGGMANTFLLAKGLNVGDSLVEPDSVPVAQQLMARAEERGARLLLPVDVVIADAFSADAQRQVVDVSDIPAGWRVLDIGPKTIERYSAEIRAARTVIWNGPMGVFELEPFAVGTRAIAQAMAEAAANGAITIVGGGDSVAAVEQAGLADKMSHVSTGGGASLELLEGRVLPGVAALQDAE

SEQ ID NO: 56930 - DNA, 1194 bp, Polaromonas sp. JS666
  CDS (1)..(1194)
atgaatttcatccgtttttccgacctgtgtgccagcggcaaggccgccggccagcgcgttttcatccgtgccgacctgaacgtgccgcaggatgacagcggcgccatcaccgaagacacgcgcatacgtgcctccattccctgcctgcaaatggcgctggacgcgggtgcggccgtgatggtgacctcccacctcgggcgtccggtggagggcgaattcaagccggccgactcgctggccccggtggccaaacgcctgggcgagctgatgaagcgcgagattccgctggtcacccagtgggtggacggcgtggacgtccagcccgggcagctggtgttgctggagaactgccgcctcaaccccggcgagaagaaaaacagcgaagcgctggcccgcaagatggccgccctgtgcgacatctttgtgcacgacgcgtttggcaccgcccaccgcgccgaggcctcgacctatggcattgcgcaatacgccaaggtagcgagcgccgggccgctgctggccgccgagatggacgcgatttcgacggcgctgtccaacccgcgcaggccgctggtcgcgatcgtcgcgggcagcaaggtctcgaccaagctgaccatcctcaagtccctggccagcaatgtggaccagctgatcgtgggcggcggcatcgccaacaccttcatgctggcggccggcctgaagattggcaaaagcctggcggaggccgacctgctgcccgaggcccgtgccgtgatcgaggccatgaaggcacgcggcgctgcggtgcccatccccaccgacgtggtcacggccaagaccttcgcggccgatgccacggccaccgtcaaggccgccaccgacgtggaagacgacgacctgatcctggacatcggccccgagaccacggcccggttggcggcgcagctcaaggcggctggcaccattgtctggaatggcccggtgggcgtgttcgagtttgatgctttttcgcgcggtaccgaaggcattgcccgggcgatcgccgacagcagcgccttttcgattgccggtggtggcgacacgctggctgccatcgccaaatacggcatcgagaaacaggtgggctacatctccacggggggcggcgcattcctggaggtgctggaaggcaagacgctgccagccttcgaaatcctgcagaagcgggccgccggctag

SEQ ID NO: 56931 - protein, 397 aa, Polaromonas sp. JS666
MNFIRFSDLCASGKAAGQRVFIRADLNVPQDDSGAITEDTRIRASIPCLQMALDAGAAVMVTSHLGRPVEGEFKPADSLAPVAKRLGELMKREIPLVTQWVDGVDVQPGQLVLLENCRLNPGEKKNSEALARKMAALCDIFVHDAFGTAHRAEASTYGIAQYAKVASAGPLLAAEMDAISTALSNPRRPLVAIVAGSKVSTKLTILKSLASNVDQLIVGGGIANTFMLAAGLKIGKSLAEADLLPEARAVIEAMKARGAAVPIPTDVVTAKTFAADATATVKAATDVEDDDLILDIGPETTARLAAQLKAAGTIVWNGPVGVFEFDAFSRGTEGIARAIADSSAFSIAGGGDTLAAIAKYGIEKQVGYISTGGGAFLEVLEGKTLPAFEILQKRAAG

SEQ ID NO: 56932 - DNA, 1530 bp, Trypanosoma brucei
  CDS (1)..(1530): transl_table=4
atgtccactgcaccgaatgcgaagaacaacataagcctgaagaagtctgtgggcgatgtttggccgttaaccggaaaacgagtgcttatgcgtgtcgatttcaacgttcctatgcaaaatggccatattactaacgattatcgaatccgtgcggcgattccaacgatacgacgggttattgatcagggtggtatttgtattctcctgagccatcttggacggcccagaggcgtttcaatggttgcgggtgtgcgagatataagacggcgatatcacgaggctcagtttcacgacaacaaaggtaaaacagcgttttttagtgttctaccgggagaggagaaagttaaaatattagcgaaatccagtgcacgggaagaggcaacgcacatatcacctgaggtgaaatctggaaaaacaatgctgtttgcgcgccttcctgaggacgagaagaaatctttgctcatgcagtacttaaacgaaaacaaagacagtgcgttaccgcagatgagtgttagtgcaggctacgaagagcaatacagatctcgtccagttgctgtaaggcttgccgaattactcggccaacatgtatattttgctcacgactgcttggatgccagagtagaggtttcgcggttaaagcgtggaaatgttatgttacttgaaaatgtacggttctacagcgaagaaaacggtgaaaatgctgaggaacgtgaagccatggccaagatccttgcgtcatatggtgatgtttacatcagtgatgcttttggtgcagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaatatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaagggcatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcagaaacgtggactcatgagtatcatcggtggtggcgagagtgcgggtgcggctgaactctgtggtgaagctgcacgtatttctcatgtttcaactggtggtggtgcgtctttggaactcctcgagggcaaaacgcttcccggtgttgcagtattggatgataaggagtaa

SEQ ID NO: 56933 - protein, 509 aa, Trypanosoma brucei
MSTAPNAKNNISLKKSVGDVWPLTGKRVLMRVDFNVPMQNGHITNDYRIRAAIPTIRRVIDQGGICILLSHLGRPRGVSMVAGVRDIRRRYHEAQFHDNKGKTAFFSVLPGEEKVKILAKSSAREEATHISPEVKSGKTMLFARLPEDEKKSLLMQYLNENKDSALPQMSVSAGYEEQYRSRPVAVRLAELLGQHVYFAHDCLDARVEVSRLKRGNVMLLENVRFYSEENGENAEEREAMAKILASYGDVYISDAFGAAHRDSATMTGIPKILGHGAAGYLMEKEISYFAKVLGNPPRPLVAIVGGAKVSEKIQLLDNMLQRIDYLLIGGAMAYTFLKAQGYSIGISKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTQKRGLMSIIGGGESAGAAELCGEAARISHVSTGGGASLELLEGKTLPGVAVLDDKE

SEQ ID NO: 56934 - DNA, 1263 bp, Trypanosoma brucei; identical to SEQ ID NO: 10528
  CDS (1)..(1263): transl_table=4

SEQ ID NO: 56935 - protein, 420 aa, Trypanosoma brucei; identical to SEQ ID NO: 10529

SEQ ID NO: 56936 - DNA, 1254 bp, Pongo pygmaeus
  CDS (1)..(1254)
atgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcagtagtccttatgagccacctaggccggcctgatggtgtccctatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgtttctgggaacaaggttaaagccgagccagccaaaatagaagctttccgagcttcactttccaagctaggggatgtctacgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccagggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttag

SEQ ID NO: 56937 - protein, 417 aa, Pongo pygmaeus
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDVSGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFAQGTKALMDEVVKATSRGCITIIGGGDTATCCAKWNTEDKVSHVSTGGGASLELLEGKVLPGVDALSNI

SEQ ID NO: 56938 - DNA, 1173 bp, Thermus thermophilus HB8
  CDS (1)..(1173): transl_table=11
atgcggacccttttggacctggaccccaagggcaagcgggtcctggtgcgggtggactacaacgtccccgtccaagacgggaaggtccaggacgagacccggatcctggaaagcctccccaccctccgccacctcctcgccgggggggcttccctcgtcctcctctcccacctgggccgccccaagggcccggaccccaagtactccctggccccggtgggggaggccttgagggcccacctcccagaggcccgcttcgcccccttccctccgggctcggaggaggcgaggcgggaggcggaggccctgaggcccggggaggtcctcctcctggagaacgtccgctttgagccgggagaggagaagaacgaccccgagctttccgcccgctacgccaggctcggggaggccttcgtcctggacgccttcgggagcgcccaccgggcccacgccagcgtggtgggggtggcgaggctcctccccgcctacgccggcttcctcatggagaaggaggtgagggccctttcccgcctcctcaaggacccggaaaggccctacgccgtggtgctgggcggggccaaggtctcggacaagatcggggtcattgagagcctccttccccgcatagaccgcctcctcattggcggggccatggccttcaccttcctcaaggccctagggggagaggtggggaggagcctggtggaggaggaccggctggacctggccaaggacctcttggggcgggccgaggccttgggggtcagggtctacctccccgaagacgtggtggcggcggagcgcatagaggcgggggtggagacccgggtcttcccggcccgggccatccccgtcccctacatgggcctggacatcggccccaagacccgggaggccttcgcccgggccctggaaggggcgaggacggtcttctggaacgggcccatgggggtctttgaggtgcctccctttgacgaggggaccttggccgtggggcaggccatcgccgccctcgagggcgccttcaccgtggtgggcgggggcgactcggtggcggcggtgaaccgcctgggccttaaagagcgcttcggccacgtctccaccgggggcggggcgagcctggagttcctggaaaagggcaccctgcccggcctcgaggtcctggaaggctaa

SEQ ID NO: 56939 - protein, 390 aa, Thermus thermophilus HB8; identical to SEQ ID NO: 10507

SEQ ID NO: 56940 - DNA, 1203 bp, Haloarcula marismortui ATCC 43049
  CDS (1)..(1203): transl_table=11
atgactttccagacgctcgatgacctcgacgacggacagcgcgttctcgtccgactcgacctcaactcaccggtggaggacggcacggtacaggacaatcgacggttcgaccgccacgcggagacggtcagcgaactcgtcgaccgtgggttcgaggtcgcggtgctggcccatcagggccgcccgggccgcgacgacttcgtctcgcttgcgcaacacgccgagatcctcgccgaccatatcgaccacgacgtggacttcgtcgacgagacctacgggccacaggcgattcacgacatcgctgacctcgacggcggcgacgtactcgtgcttgagaacacgcggatgtgcgacgatgaactgcccgaggaagaccccgaagtcaaatcacagacagagttcgtccagacgttgaaagacgagttcgacgcatacatcaacgacgcctactctgcggcccaccgctcacacgcctcactcgtcggcttcccgctggtgatggacgcctacgctggccgcgtgatggaaaccgagtacgaggccaacaccgccatcgccgagaaggagttcgacgggcaggtgacgatggtcgtcggcggaacgaaggcaacggacgttatcgacgtgatgacccacctcgatgagaaggtcgacgacttcctgcttggcggtatcgccggggagctgttcctgcgggccgctggctacccggtcggctacgacatcgacgacgcgaacctctacgacgagcagtgggaggaaaacagcgagaaaatcgagtccatgctcgaagaccaccgcgaccagatcacgctcgcggtcgatctggcctacgaagacgacggtgaccgcgccgagcaggccgtcgacgacatcgaggaaaaaagcgtctcctacctcgacgttgggagcgagaccgtcatggagtattcgccggtcatccgcgactccgaggccgtcttcgtgaagggcgcgctggggatgttcgaagacgagcggttctcggtcggcactgccggcgtcctcgaagccattgccgacaccgactgcttctccgtcgtgggcggcggcgacacttcgcgagctatcgagatgtacgggatggaagaagacgagttcggccacgtctctatcgcgggcggggcctacatccgggcactgaccggcgcggaactggtcggcgtcgaagtgctgcagcgttaa

SEQ ID NO: 56941 - protein, 400 aa, Haloarcula marismortui ATCC 43049
MTFQTLDDLDDGQRVLVRLDLNSPVEDGTVQDNRRFDRHAETVSELVDRGFEVAVLAHQGRPGRDDFVSLAQHAEILADHIDHDVDFVDETYGPQAIHDIADLDGGDVLVLENTRMCDDELPEEDPEVKSQTEFVQTLKDEFDAYINDAYSAAHRSHASLVGFPLVMDAYAGRVMETEYEANTAIAEKEFDGQVTMVVGGTKATDVIDVMTHLDEKVDDFLLGGIAGELFLRAAGYPVGYDIDDANLYDEQWEENSEKIESMLEDHRDQITLAVDLAYEDDGDRAEQAVDDIEEKSVSYLDVGSETVMEYSPVIRDSEAVFVKGALGMFEDERFSVGTAGVLEAIADTDCFSVVGGGDTSRAIEMYGMEEDEFGHVSIAGGAYIRALTGAELVGVEVLQR

SEQ ID NO: 56942 - DNA, 1185 bp, Bacillus clausii
  CDS (1)..(1185)
atgaacaaaaaaacgctttatgactacgattttgcaggcaaaacggtattttgccgagtcgatttcaatgttccgatgaaagatggaaagattactgatgaaacgcggattcaagcagctttgcctacgattaaatacttaagtgaacaaggggcgcgcgttttgctagcaagccatcttggccgcccgaaaggcgaagtggtagaaagcttgcgcttggcgcctgtcgcgacacgccttagcgagctgttaggaaaagaagtacaagccgtccaggaagcgcacggtccagtagcaaaacaagcagtggaaggtcttgaagacggtggcgtgttgctgcttgaaaatgtccgcttttacccaggggaagaaaagaacgatcctgaattagcgaaagcgtttgctagcctagccgacatttttgtcaatgatgcatttggggcggcacaccgtgcccacgcttcaacggaaggcattgcccactatttgccgtcagcagctggttttctaatggaaaaagaactggatgtactcggcaaagcgttaagcaaccctgaacgtccgtttacagcagtcattggtggcgcaaaagtaaaagacaagattggcgttattgacaacttgctagataaagtcgacaatttaattattggcggcggtctcgcatacacgtttgtcaaagcgcaaggctatgaagttggcaaatcgttgcttgaagaagataagctcgatttagccaagcagtttatggaaaaggctgaacaaaaaggcgttaagttttatatgcctgaagatgtcattgttgccgatgatttttctgacgacgccaacaaaaaagaagtggccattagcggcattccagctgattgggaagcgcttgacattgggccaaaaacacgaaaaacctatgaagctgtattaaaagcttcaaaattagtgatttggaacgggccaatgggtgtgtttgagctcgaatcgtttgcaggtggcacaaaagcagttgcaaatgcgttggcagaggcgtcagatacgtattcagtcattggtggcggcgattcagcggcagccgttgaacaatttggccttgccgacaaaatgagccatatttcaacaggcggaggcgccagccttgaatttatggaaggcaaggaacttccaggcgttgtcgcactatcagaaaaataa

SEQ ID NO: 56943 - protein, 394 aa, Bacillus clausii
MNKKTLYDYDFAGKTVFCRVDFNVPMKDGKITDETRIQAALPTIKYLSEQGARVLLASHLGRPKGEVVESLRLAPVATRLSELLGKEVQAVQEAHGPVAKQAVEGLEDGGVLLLENVRFYPGEEKNDPELAKAFASLADIFVNDAFGAAHRAHASTEGIAHYLPSAAGFLMEKELDVLGKALSNPERPFTAVIGGAKVKDKIGVIDNLLDKVDNLIIGGGLAYTFVKAQGYEVGKSLLEEDKLDLAKQFMEKAEQKGVKFYMPEDVIVADDFSDDANKKEVAISGIPADWEALDIGPKTRKTYEAVLKASKLVIWNGPMGVFELESFAGGTKAVANALAEASDTYSVIGGGDSAAAVEQFGLADKMSHISTGGGASLEFMEGKELPGVVALSEK

SEQ ID NO: 56944 - DNA, 1248 bp, Toxoptera citricida
  CDS (1)..(1248)
atggcactaaacaaactaagcatcaagagtttagaagtggcaaacaaacgagttttgatcagagttgattttaatgttccattaaaagatggaaaaataaccaataaccaacgtattgttgctgcattagatagcatcaattatgtccttgaaaatggtgccaaatctttagttctcatgtcccatcttggacgtccagatggattaccaaattcaaagtactctatgaaaccagttgcagaggaactccaaaaactccttaataagaatgttacatttttgtctgactgtgttggcccagaagtagaaaatgcttgtgcagatcctgctcctggttcaatatttcttctggagaatcttcgattccatattgaagaagaaggaaaaggtgtaaatgctgctggggaaaaagctaaggctgacaaagaagatgtgaaaaaattcagagagtcattacaaaaattgggagatgtgtatgttaacgatgcttttggtactgcacacagagcccacagttctatgatgggtgaagggtttgaaaagcgtgctgccggcattttgttgaacaaagagctcacttattttgctaaagctttggataatcctgaaaggcctttcttagctatcttaggaggagctaaagttgctgataagattcaacttattgaaaatcttttagataaagttgatgaaatgattattggaggaggtatggcttacactttcttgaaagagtcaaaggggatgaaaattggcgattccttatatgatgaagctggagccaaaattgttggcaaattattagataaagctaatgctcgcaatgttaaaattcatttgccagttgattttgtcactgctgataaatttgatgaaaatgctaataccagttctgcaactgttgaagaaggtattcctgagggttggatgggtttggattgcggaccagaatctaggaaattgttttctgaacctattgctcgtgctaaggtcattgtatggaatgggcctgctggagtttttgagtttgataaatttgcttttggaactaaagcattaatggatgatgttgtacaggccactaaaaatggaactgtcactataattggaggtggtgatactgcaacttgtgctgctaaatgggggactgaaagtcaaataagccatgtgagcactggaggtggtgcaagtcttgaactacttgaaggaaaagtcttaccaggagttgcagctttgactgatgcataa

SEQ ID NO: 56945 - protein, 415 aa, Toxoptera citricida
MALNKLSIKSLEVANKRVLIRVDFNVPLKDGKITNNQRIVAALDSINYVLENGAKSLVLMSHLGRPDGLPNSKYSMKPVAEELQKLLNKNVTFLSDCVGPEVENACADPAPGSIFLLENLRFHIEEEGKGVNAAGEKAKADKEDVKKFRESLQKLGDVYVNDAFGTAHRAHSSMMGEGFEKRAAGILLNKELTYFAKALDNPERPFLAILGGAKVADKIQLIENLLDKVDEMIIGGGMAYTFLKESKGMKIGDSLYDEAGAKIVGKLLDKANARNVKIHLPVDFVTADKFDENANTSSATVEEGIPEGWMGLDCGPESRKLFSEPIARAKVIVWNGPAGVFEFDKFAFGTKALMDDVVQATKNGTVTIIGGGDTATCAAKWGTESQISHVSTGGGASLELLEGKVLPGVAALTDA

SEQ ID NO: 56946 - DNA, 1215 bp, uncultured archaeon GZfos1D1
  CDS (1)..(1215)
atgaacgataaattaaaggagttcttgacgatagatgattttgatctatacggaaaaacagtgctcttccgggcggacataaactcggtgattatagacgggcaagtgcagatgaaggagcggatagtggagaatgcgaagacgatacagaagcttttggataaaaaagcaaaggtggttatcctcgcgcatcaaggtcgtgcagggcaagcggattttctacatctggagcagcatgcgcaattgctcaggaatttcatggatttgaaatacattgacgatataatgggcccgagtgcgagggcggcgataaagggtcttgatcatggagaagttttgttgctcgataacgtgcggatgctagcagaggagacacttaacaaaacaccggaggagcattcgcactccttttttgtgaagagtcttgcacctcttgccgatatctacataaatgatgccttctccgtggctcaccgatcgcacgcatcagtgcttggcttcccggcggttctggatgcgggaatagggcgattgatggagcgggagttgaaaactctggaaagagcggtatataaaataaaaagtccgtgtgtttatatccttggtggtgtaaaacccgaggaagtgtttgatataatagatgtcacattgaaacgtaaaagagtagatactatactcacaacaggagctcttggcactcttttcctatatgctcgaggtataattgagccaggggaagaacaaaaagtggatacgcattttatgtggaatgtggagcaagccaaaagattcctggagatgggtaaggacataataaagtatcccgaagatgttgccgtggcggtagatggcgagagaagagaaatacccgtggcacagttgaagcctaaccaaccagcatatgatataggagagaagacgagtgaggaatattcagaacaaataaaaaatgcgagaacggtgataatgaaagggccggcagggttatatgaaaataaggcatttgcaaagggcacgcgcgatatttttgaagcgatttcgcattccaaagcatattctcttctcggtggtggccatacatcagcagcaataagtgaagtgggaatagataggaagactatgtctaatgcccacgtcagccttgcgggtggtgcattcctgcgatattttgtcgataagcatctacccgggatagaagtgttaaagaaacattaa

SEQ ID NO: 56947 - protein, 404 aa, uncultured archaeon GZfos1D1
MNDKLKEFLTIDDFDLYGKTVLFRADINSVIIDGQVQMKERIVENAKTIQKLLDKKAKVVILAHQGRAGQADFLHLEQHAQLLRNFMDLKYIDDIMGPSARAAIKGLDHGEVLLLDNVRMLAEETLNKTPEEHSHSFFVKSLAPLADIYINDAFSVAHRSHASVLGFPAVLDAGIGRLMERELKTLERAVYKIKSPCVYILGGVKPEEVFDIIDVTLKRKRVDTILTTGALGTLFLYARGIIEPGEEQKVDTHFMWNVEQAKRFLEMGKDIIKYPEDVAVAVDGERREIPVAQLKPNQPAYDIGEKTSEEYSEQIKNARTVIMKGPAGLYENKAFAKGTRDIFEAISHSKAYSLLGGGHTSAAISEVGIDRKTMSNAHVSLAGGAFLRYFVDKHLPGIEVLKKH

SEQ ID NO: 56948 - DNA, 1245 bp, Euglena gracilis
  CDS (1)..(1245)
atgcctggaagcgctttgggcccaaagttgagcattgatgatttggacatcaaggataaaaatgtcctcgttcgagtggatttcaacgtcccaatgaaagatggcaaaatcttggacgatttccgtatgaggtcggctttgccgaccttggagaaggttatcaattccggtgggaaacttatcattatgagccacatgggtcgcccagcggagaccggctatgaagccaagtattccttgaagccaatcgcagatcatctgggcacccttttgggcaaacctgtgaccttcgctgctgattgcatggatgccgctgcagaggttgccaagttgacacctggcgacgtccttgttttggagaacttgcgtttctaccctcatgagggaagcaaggacaaggaccaacgccttgaaatggcgaaaaagttggcatcctatgctgatttgtacgtcagtgacgcatttggcactgcacatcgggatgctgcatccatgactggtgttcctgaggtgatgggacagggtgcctctggctatttgatgaagaaggagattgactacttttcaaaggctctgaaggagcctgaaaagccagttgttgctatcgttggtggtgcaaaggtgtctgacaagattcaacttctggagaacatgctgaagactgtcaatcaaatggtcattggtggcgccatggcatacacctttttgaaggctcaaggcaagagcactgggaaatccaagtgtgagacagaagcggagacgaagaaagggaagattgatattgtggagttggcagggaagcttctttcaaaggcaaaggagcagggggttgagatctaccttcctgtggaccaccgctgctctgctgaattcaaggatgttgagcctgtcatcacgtccgatgagaacattcctgatgatttgatggcacttgatattgggccaaagactgaagaactgtactgcagcgttgactttgccaaggcaaagacggccatctggaatgggccgatgggagtgtttgagcttgagcatttcaagccaggaacttgggcggtcgcaagaccactggcggaccactctgactcatgctgctccatcgtgggcggaggggactccgagcgccgcgagaagtcgggatatgcccccaagctgtcccacatctccactggtggcggggcctccctggagctcctggagggcaaggtgctgcctgggctggccatcttgaccgacaagccttga

SEQ ID NO: 56949 - protein, 414 aa, Euglena gracilis
MPGSALGPKLSIDDLDIKDKNVLVRVDFNVPMKDGKILDDFRMRSALPTLEKVINSGGKLIIMSHMGRPAETGYEAKYSLKPIADHLGTLLGKPVTFAADCMDAAAEVAKLTPGDVLVLENLRFYPHEGSKDKDQRLEMAKKLASYADLYVSDAFGTAHRDAASMTGVPEVMGQGASGYLMKKEIDYFSKALKEPEKPVVAIVGGAKVSDKIQLLENMLKTVNQMVIGGAMAYTFLKAQGKSTGKSKCETEAETKKGKIDIVELAGKLLSKAKEQGVEIYLPVDHRCSAEFKDVEPVITSDENIPDDLMALDIGPKTEELYCSVDFAKAKTAIWNGPMGVFELEHFKPGTWAVARPLADHSDSCCSIVGGGDSERREKSGYAPKLSHISTGGGASLELLEGKVLPGLAILTDKP

SEQ ID NO: 56950 - DNA, 1254 bp, Xenopus laevis
  CDS (1)..(1254)
atgtctctgtccaacaagctgaccctggataaggtggatgtgaaagggaagcgggtagtcatgagggttgacttcaatgtcccaatgaaaaataataagattacaaacaaccaaaggattaaggctgctgttcccagcatccagcactgcttggacaatggtgctaaatctgtggttcttatgagccacttgggcagaccagatggtgtccctatgcctgacaagtactctctggcaccagctgctgaggaactcaaagctctgatgaagagagagattgtcttcctgaaggactgtgtgggcccagaggtggaagctgcatgtgctgacccagcccctggaacagtgttgcttctggagaaccttcgcttccatgtggaggaagaagggaagggtaaagacgcttctgggaacaagatcaaagcagatgctgccaaagtagatacatttagagcatctctttctaaacttggcgatgtttacatcaatgatgcatttggaactgcacacagagctcacagctccatggttggcgtaaagctgccccagagggctgctggctttttaatgaagaaggagcttgattactttgctaaggctttggagaaccccgagagacctttccttgctatccttggaggtgctaaagtaaaagacaaaatccagctaatctctaacatgctggataaagtgaatgagatgattattggtggagggatggcctttacattcctaaaggttctcaacaatatgtccattggaacctctctatatgatgaagagggagcaaccattgttaaggacttgatggccaaggctgagaagaatggagtgaaaattacacttcctgtagactttaccaccgctgagaagtttgatgaaaatgccagtacaggacaagccagtgtctctgctggaattcctgatggatggatgggacttgactgtggcccagagagtgtgaagctatttgtggaagctgtgggcagagccaagcagattgtgtggaacggtcccgttggggtgtttgagtgggacaattttgccaaaggaaccaaagctgttatggataaagtggtagaggtcactggcaaaggctgcattacaatcattggtggaggagacactgctacctgctgtgcaaagtgggatacggaggacaaagttagtcacgtcagtacaggaggaggagccagtctagagctgttagaaggaaaggtcctacctggagttgatgctttgagcaatgtgtaa

SEQ ID NO: 56951 - protein, 417 aa, Xenopus laevis
MSLSNKLTLDKVDVKGKRVVMRVDFNVPMKNNKITNNQRIKAAVPSIQHCLDNGAKSVVLMSHLGRPDGVPMPDKYSLAPAAEELKALMKREIVFLKDCVGPEVEAACADPAPGTVLLLENLRFHVEEEGKGKDASGNKIKADAAKVDTFRASLSKLGDVYINDAFGTAHRAHSSMVGVKLPQRAAGFLMKKELDYFAKALENPERPFLAILGGAKVKDKIQLISNMLDKVNEMIIGGGMAFTFLKVLNNMSIGTSLYDEEGATIVKDLMAKAEKNGVKITLPVDFTTAEKFDENASTGQASVSAGIPDGWMGLDCGPESVKLFVEAVGRAKQIVWNGPVGVFEWDNFAKGTKAVMDKVVEVTGKGCITIIGGGDTATCCAKWDTEDKVSHVSTGGGASLELLEGKVLPGVDALSNV

SEQ ID NO: 56952 - DNA, 1254 bp, Brachydanio rerio
  CDS (1)..(1254)
atgtctctttcgaacaaacttcatttggacaaggtggacgtgaaaggaaagcgggtgatcatgagggtggacttcaatgtccctatgaagaacaatgtgatcacaaataaccagagaatcaaggctgcagtaccatctatccagcactgtttagataattgtgccaaagctgtggtcctgatgagccacttgggccggcctgatggagtccctatgccagacaaatactctctggagcctgtggctgcagaactcaagaacctgctgggaaaagacgttcagttcctgaaagactgtgtgggtccagatgtggagaaagcctgtgcagaccctcctgcaggatctgtcattctgctggagaatctgcgctttcatgtggctgaggagggcaagggcaaagatgcatcgggtaacaagaccaaagcaagtcaggcagagatcgatgctttccgagcctccctgtccaaactgggtgacgtatacgtcaacgatgctttcggaactgcacatagagctcacagctctatggttggagtgaatctccctcagaaggctgctggttttctgatgaagaaagagctagactactttgccatggcccttgagaaaccacagaggcctttcttggccatcctcggaggggccaaggtcaaagataagattcagctgatcaacaacatgttggacaaggtgaatgagatgatcattggtggaggaatggcctttaccttcctcaaggttctcaagaacatggagatcggcacttccctgtttgatgaagagggttccacaattgtgaaagatctcatggccaaagcagaaaagaatggtgtaaagatcacacttccagtcgactttatcactgcagacaaattcgatgagaaggcgacaacagggaccgcaacggtagcagaaggtattcctgctggctggatgggtctagactgtggtcctgagagctcaaagctctatgcagaggctgtggccagagccaagcagattgtgtggaacggacccgttggcgtgttcgagtgggacaactttgctcatggaaccaagaacatgatggacaaagttgtagaagcgaccaaaaatggctgcatcaccattatcggtgggggagacacagctacctgctgtgccaagtgggacactgaggacaaggtcagccatgtgagcacagggggcggagccagtctggagctgctggagggtaaagtgctgcccggtgtcgatgccctcagtaacgtataa

SEQ ID NO: 56953 - protein, 417 aa, Brachydanio rerio; identical to SEQ ID NO: 10817

SEQ ID NO: 56954 - DNA, 1254 bp, Sus scrofa
  CDS (1)..(1254)
atgtctctttctaagaagttaactttggacaaactggacgtgaaagggaaacgagtcatcatgagagtagacttcaatgttcccatgaagaggaaccaagttacaaacaaccaaagaatcaaggcttccctcccaagcatcagatactgcctagataacggagccaggtcagtagttctcatgagtcatttaggtagacctgatggtgttgcgatgcctgataaatactccttagagccggtggctgctgaactcaaatccttgctggggaaagacgttctgttcctaaaagactgtgtgggctcagaagcagagcaagcttgtgccaacccacctgcgggttcagtcatcctactggagaaccttcgctttcatgtggaagaggaagggaagggccaagatccttctgggaataagctgaaagctgagccagataaagtagaagccttccgcgcatcgctctccaagctgggggatgtgtatgtcaatgatgcttttggcacggctcaccgggctcacagttccatggtgggagtgaatctgccgcagaaggcatctggattcctgatgaaaaaggagctggattactttgccaaagccttggaaaacccagagagaccctttctggctatccttggtggagctaaagtggcagacaagatccaactcatcaaaaatatgctggacaaagtcaatgagatgattattggtggcggaatggcctttaccttccttaaggtactcaacaacatggagattggtgcctccctgttcgacaaagagggagccacgattgtcaaagagatcatggccaaagctgaaaagaatagggtgaacattacctttcctgttgactttgtcattgctgacaagtttgaggaaaatgctaaggttggccaggccacggtagcgtcaggtatacctgccggctgggtggctttggactgtggtcctgagaccaacaagaagaatgcacaagttgtggcccgagccaagctaattgtgtggaatggacctttaggggtctttgaatgggatgcctttgctaatggaacgaaagccctcatggatgaaattgtgaaagccacctccaagggctgtatcactattataggaggtggagacacggccacttgctgtgccaaatggaacactgaagataaagtcagtcatgtgagcactggaggaggtgccagtctagagcttctggaaggtaaagtccttcctggagtggaggctctcagcaatctgtag

SEQ ID NO: 56955 - protein, 417 aa, Sus scrofa
MSLSKKLTLDKLDVKGKRVIMRVDFNVPMKRNQVTNNQRIKASLPSIRYCLDNGARSVVLMSHLGRPDGVAMPDKYSLEPVAAELKSLLGKDVLFLKDCVGSEAEQACANPPAGSVILLENLRFHVEEEGKGQDPSGNKLKAEPDKVEAFRASLSKLGDVYVNDAFGTAHRAHSSMVGVNLPQKASGFLMKKELDYFAKALENPERPFLAILGGAKVADKIQLIKNMLDKVNEMIIGGGMAFTFLKVLNNMEIGASLFDKEGATIVKEIMAKAEKNRVNITFPVDFVIADKFEENAKVGQATVASGIPAGWVALDCGPETNKKNAQVVARAKLIVWNGPLGVFEWDAFANGTKALMDEIVKATSKGCITIIGGGDTATCCAKWNTEDKVSHVSTGGGASLELLEGKVLPGVEALSNL

SEQ ID NO: 56956 - DNA, 1221 bp, uncultured bacterium 106; identical to SEQ ID NO: 10560
  CDS (1)..(1221): transl_table=11

SEQ ID NO: 56957 - protein, 406 aa, uncultured bacterium 106; identical to SEQ ID NO: 10561

SEQ ID NO: 56958 - DNA, 1188 bp, Fritschea bemisiae; identical to SEQ ID NO: 10570
  CDS (1)..(1188): transl_table=11

SEQ ID NO: 56959 - protein, 395 aa, Fritschea bemisiae; identical to SEQ ID NO: 10571

SEQ ID NO: 56960 - DNA, 1461 bp, Chlorarachnion sp
  CDS (1)..(1461)
atgctcgtcaaggcactctctgtgtctgccgttgctctctccatggttctttgctaccaggcagtatccatggcaaatcagcaagttgctgtcgagcctctcgttggaggtgggttctccatggcaggtgtccgccctgtttcccgcatggctgttgctcctatgcactccgtttctcctatgaacgttggccgcttctccaagccttctgttaccaagttctctgcagtctcccgccctcagcagcttaaggttaacgttgaaaagaagatgtctgttggtgacttgaagaaggaagagctcgacggaaaggttgctctcgttcgttgcgacctcaacgttcctcttgacggaaagaccatcactgatgacacccgtatccgcgcttccatcccaaccatcaagcacctggttgagagcggcgctaaggttctccttacctcccaccttggacgtcctaaagacggacctgaggataagttctccctcgctcctgtcgctgctcgtctttccgagctcctcggacaggacgtgaccttcgtcaaggactgcattggagagcctgtcaaggaggctgttgccaccatgacacctggatccgtcgctctcctcgagaacgttcgtttctacaaggaagagaccaagaacgaaccagagttcgctaagaagctcgctgctaacgctgacctcttcgtgaacgatgctttcggaaccgctcaccgtgctcacggatccaccgagggagtaccgctcacctcaagccttccgtcgctggattccttcttcagaaggagctcgactaccttcaggcgctgtgcagaacctgctcgtcctttcgctgctatcgttggtggatccaaggtttcctccaagatcggtgttatcgagtccctcctcgagaaggttgacaagctcgtcatcggaggcggtatggttttcaccttcctcaaggctcgcggcctcgaagtaggaagctccctcgtcgaggaggacaagctcgagctcgctaaggaccttgagcgcatcgcaaaggagaagggcgttgaactcatcctccctaccgacgttgtcctcgctgatgcattcgccaaggatgctaacacccaggtcgctgatgctaccgcaatccctgagggatggatgggacttgaccaggggcctaaggctaccgaggagatcattgctgctctcaaggactgcaagactgttatctggaacggacctatgggtgtcttcgaattcgaggcgttctccaagggaaccttcggagttgctgacgctctcgctgatctcaccaagggaggcgcaaccaccatcatcggcggaggagactccgttgctgctgtagagcaggctggccttgctgaccagatgtcccacatctctaccggaggtggagcttccctcgagctcctcgaaggaaaggtccttcctggagttgctgcccttaacgcagcttaa

SEQ ID NO: 56961 - protein, 486 aa, Chlorarachnion sp; identical to SEQ ID NO: 10573

SEQ ID NO: 56962 - DNA, 1263 bp, Schistosoma japonicum
  CDS (1)..(1263)
atgggtttgtcgaagcttagtatctccgatgtagatttaaaggataaacttggcttactcctaatgctttgtagggttgattttaacgtccctatgaaagatggaaaagtcactaatacccaacggattgcagctgctataccaactattaaatatgccttggataagggagctaaaagcgtagtcctgatgtctcacttaggtagacctgatgggtataaagttgaaaaatattcgctgaaacccgtttgctctgaagtttccaagttgttaggcaaagaagttactttccttagtgactgtgttggtcctgatgtcattagtgcgtgttctaatcctgctcctggcagcgtcttcttacttgagaatttacgctttcatatagaagagaaaggaaaaggtgtctcaccatctgaagataaaacaaaggccactgctgatcaaatcaaagctttcagtgaaagtttaacaaaacttggggatgtttatgtcaatgatgccttcggaacagcacatcgtgctcatgcctctatggtcggctgccaattgccacaaaaagcttgtggatttctcatgaataaagagttgacatatttcgctaaagctctggaaaatcctgaacgtcctttcttagctattttgggcggcgctaaggttagcgataagatccagttgatcaataatatgctggacaaggttaacgaattgatcattgggggcggcatggcgtatactttccttaagcaaatacacaatatgcatataggagctagtttatttgacgcaccaggtgcagaaattgttcagaaggtaatggaaactgcaaaggctaaacacgtggcaattcacttacctgttgattttgtaactgctgataaatttgctgaagatgctaacaccggaacagcaactatagaatctggaattccagatggttggatggggctggatattggtccgaaaaccatagaggaattccgtaaagtgataagtcgtgccaaaacaatagtttggaatggtccgatgggtgtttttgaaatggataagtttgctgcagggacaaaagcagcaatggatgcggtagttgaagctactaaaaacggtgctacaactattattggtggcggtgatacagcgacttgttgtgccaagtggaacacagaagataaagtcagtcatgtcagtaccggtggtggtgctagccttgaacttttagaaggtaaacaactgccaggagtcgttgcacttacggatgctcactaa

SEQ ID NO: 56963 - protein, 420 aa, Schistosoma japonicum; identical to SEQ ID NO: 10575

SEQ ID NO: 56964 - DNA, 1254 bp, Xenopus laevis
  CDS (1)..(1254)
atgtctctgtccaacaagctgaccctggataaggttgatgtgaaagggaaaagggtagtcatgagggttgacttcaatgtcccaatgaaaaacaatcagattacaaacaaccaaaggattaaggctgctgttcccagcatccagcactgtttagaccatggtgctaaatctgtggttcttatgagccacttgggcagaccagatggggtccctatgcctgacaagtactctctggccccagtggctgaggaactcaaatctctgatgaagagagagattgtcttcttgaaagactgtgtgggtccagaagtggaagctgcatgttctgacccagccactggaacagttttacttctggagaaccttcgcttccatgtggaggaagaagggaagggtaaagatgctgctgggaacaagatcaaagcagatgctgccaatgtagattcatttagagcatcactttctaaactaggagatgtttacatcaatgatgcttttggaactgcacacagagctcacagctccatggttggtgtaaagctgccccagagggctgctggctttttaatgaagaaggagcttgattactttgctaaggctttggagaaccctgagagacctttccttgctatccttggaggtgctaaagtaaaggacaaaatccagctaattagtaacatgctggatcaagtgaatgagatgattattggtggtgggatggcctttacattcctgaaggttctcaacaatatgtccattggaacctccctatatgatgaagagggagcaaacattgttaaggacttgatggccaaggcagagaagaatggagtcaaaattacacttcctgtagactttactactgctaacaagtttgatgaaaatgccagtacagggcaagccagcgtctctactggaattcctgatggatggatgggacttgactgtggcccagagagtgtgaagctgttcgtggaagctgtgggcagagccaaacagattgtgtggaatggtccagttggggtgtttgaatgggacaattttgctaaaggaaccaaagccgtaatggacaaagtggtagaggtcactggcaaaggttgcattacaatcattggtggaggagacactgctacctgctgtgctaaatgggataccgaggacaaagttagccatgtcagtacaggaggaggagccagtctagagctgctagaaggaaaggtcctaccaggagttgatgccctgagcaatgtgtaa

SEQ ID NO: 56965 - protein, 417 aa, Xenopus laevis
MSLSNKLTLDKVDVKGKRVVMRVDFNVPMKNNQITNNQRIKAAVPSIQHCLDHGAKSVVLMSHLGRPDGVPMPDKYSLAPVAEELKSLMKREIVFLKDCVGPEVEAACSDPATGTVLLLENLRFHVEEEGKGKDAAGNKIKADAANVDSFRASLSKLGDVYINDAFGTAHRAHSSMVGVKLPQRAAGFLMKKELDYFAKALENPERPFLAILGGAKVKDKIQLISNMLDQVNEMIIGGGMAFTFLKVLNNMSIGTSLYDEEGANIVKDLMAKAEKNGVKITLPVDFTTANKFDENASTGQASVSTGIPDGWMGLDCGPESVKLFVEAVGRAKQIVWNGPVGVFEWDNFAKGTKAVMDKVVEVTGKGCITIIGGGDTATCCAKWDTEDKVSHVSTGGGASLELLEGKVLPGVDALSNV

SEQ ID NO: 56966 - DNA, 1257 bp, Chondrus crispus
  CDS (1)..(1257)
atgtctttctccaagctctgtatcgacgctctcgatctcgctggcaagcgcgtcttcatccgtgtcgacttcaacgtccccttcgacaaggagaccggcaagaccatcaccaacacccagcgtatcgacgccgccctccccaccatcaaatacgctctggaaaagggcgccaagtccgtcgtcctcgcttcgcatctcggacgcccgtccggccgtgttaaccccaagttctcgctcaagcccgtggcagacgtcgtctcggagaagatcggcaagacggtcaccttcctcgaagatgccgtcggctccgctactgaggaggcttgcaaggaccccgagaccggatccgtcttcttgctcgagaatttgcgcttccacatcgaggaggagggcaagggcgttgatgctgatggcaacaagatcaaggctgatgctgctaaggtgacggagtttcggaagagtctcagcactttggctgatgtttacgttaacgacgcctttggcactgctcaccgcgctcactcgtccatggtcggcgtggatctcccacaaaaggcctctggctttctcatgaagaaggagcttgagtattttggaaaggccctgcaggaaccccaacgcccgtttcttagcattttaggaggatccaaggtgtccgataagatccaactcattgagaacttacttgataaggtcgatgagatgatcattggaggaggtatggcattcacattcaagaaagccgtcgagggaatggccattggacagtcgcttttcgacgaagccggtgcaaagatcgcgcaggaaattgtggacaaagctaaggcgaagaatgtcaagcttcatttccccgtcgacttcacgattgctgacaagtttgccccagtggctaacacaagagttgcgacggactcagagggcattccggatgaatggatgggtctcgatgcaggtccgaagagccaagaggcaatgcgcgaggtcgtgttgcgggcgaagacagtcgtgtggaacggtcctgtcggcgtgtttgagtttgaagcgtttgcaaaaggaacaaaggccgtggtcgatgctgtcgtggaagctacttcatctggagctgtgacgatcattggtggaggtgacacggccactgcagtaaaagagatgggtgcagcggattctgtgtctcacgtttccacgggcggtggtgcgagcctcgaactgctcgaaggaaagactctacccggcgtggccgcattgacagacgcatga

SEQ ID NO: 56967 - protein, 418 aa, Chondrus crispus; identical to SEQ ID NO: 10581

SEQ ID NO: 56968 - DNA, 1371 bp, Chondrus crispus
  CDS (1)..(1371)
atggtcaccggcttcgtaccctgcgccgctcccctgcgcgccaccacccgccagacggccgccgtgtccgttgtctcccgctctgccagcaccttcgttgccccctcgcgccgcgtcacggcccctgccgcccccgtccccaccgtccgcatgaccactgccgccgccaccaccaagaagtccattaaggacctcagccccgcggacatcgccggcaaacgcgtccttgtccgctgcgatctcaacgtcccgctcgatggcaagaccatcaccgacgacacacgcatccgcgcatctgtccccaccatcaagttcctcatggaagccggcgcaaaggtcctcctctcctcccatctcggccgccccaaggatggtccggaggataagttctccctcagccccgtcgccgcccgccttacccaactgctgggcaaggacgttaccatggctccagattgcattggtgacggagtcacaaaaatcgtgtccggcatggctaacggtgatgtcactcttctcgagaacgttcgcttctacaaggaggagacgaagaacgaccctgactttgctaagaaacttgctgctaacgctgattttttcgtcaacgatgcttttggtaccgcccatcgcgcccatggctcgaccgccggtgttacggcgcatcttaagccctctgttgccggcttacttctggagaaggagcttgcatacctcgcaggcactgtgtcggaccccgcgcgcccgtttgctgcaattgttggtggttccaaggtatcttccaagattggcgttatcgactcgcttctccagaaggttgacaagctcatcattggaggcggtatggtcttcaccttcctcaaagcaaagggcctcaacgttggttcttcccttgttgaggatgataagctcgagcttgcgagggagcttgtcaaaacggccgaagccaagggtgtctccatcatccttcccactgacgtcgtcctcgctgacaagttcgccgctgatgccaacactcaggtgacctctgttgactctatccccgatggatggatgggtctggaccaaggagaagacagcacaaagctcattcagaatgagcttaaggagtgcaagaccgtaatctggaacgggccgatgggtgtgtttgagatggagaagttcgcgaagggtacgttcgccattgctgacacattagccgatctcactgaatccggctgcattaccatcatcggtggtggtgactctgtcgcagctgtcgagaaggctggtctggctgagaagatgtcccatatctctactggtggtggtgcctcgctcgagcttttggaaggaaaggtgcttcctggcgtggctgctttggatgacaattag

SEQ ID NO: 56969 - protein, 456 aa, Chondrus crispus; identical to SEQ ID NO: 10583

SEQ ID NO: 56970 - DNA, 1245 bp, Phytophthora infestans
  CDS (1)..(1245)
atggccaagctcagcatcaagaacgtggacgtcaagggcaagcgcgtgctcatccgcgtggatttcaacgttcctttcgcacaggacggctccatctccaacacgcagcgcatcgacgccgcgctgcccactgtgcagtacgtgctggaccagggtgctaaggctgtggtgctcatgtcccatttgggccgccccgagggcaagcccaaggccaaggactcgctggcccctgtggctgtggctgtggaacagaagctcggtcgtaaggtgacgttcctgaaggactgtgttggccccgaggttgaggctgcctgcgccaacccgactgagggcagcattattctgcttgagaaccttcgttttcacgtcgaagaggagggtaagggcaaggatgccgagggcaacaagaccaaggcgtcgtctgaggctgtggcagctttccgcgcctcgctgagcaagcttggcgacgtgtacgtcaacgacgcgttcggtacggcccaccgcgctcacagctccatggtgggcgtggatctccctattaaggccgctggctttctgctggacaaggagctagtgtacttcgccaaggctctggacgcccctcagcgccccttcgtgtcgattctgggtggtgccaaggttgctgacaagatccagctcatcatgaatatgctggacaaggtggacgagatggtcatcggtggcggcatggcctacacgttcaagaaggtgatcaacaacatggagatcggtggatcgctgtacgacgaggaaggcgccaagatcgtgcctcagatcgtggagaaggccaaggccaagggcgtgacgcttcacctgcctgtggacttcgtcatcgccgacaagttcgccgcggatgctgctacgaagatctcgacggaagaggagggcatccctgctggctggatgggtctggacgtcggccccaagtcgcaggaagcgttcagcgccgctgtggcgaaggccaagaccgtcgtctggaacggacccatgggcgtgttcgagttcgatgcttttgctgacggcacgaaagttgtcatggacgctgtggtcaaggccaccgagtcgggcgccactacgatcattggcggcggcgacacggccacgtgctgcgtcaagttcaacacggaggacaaggtctctcatgtgagcacgggcggcggtgccagtctggagcttctggagggcaagattctgcctggtgtggacgccctgtcctcggcgtga

SEQ ID NO: 56971 - protein, 414 aa, Phytophthora infestans; identical to SEQ ID NO: 10585

SEQ ID NO: 56972 - DNA, 1197 bp, Streptococcus agalactiae; identical to SEQ ID NO: 10590
  CDS (1)..(1197): transl_table=11

SEQ ID NO: 56973 - protein, 398 aa, Streptococcus agalactiae; identical to SEQ ID NO: 10591

SEQ ID NO: 56974 - DNA, 1347 bp, Drosophila melanogaster
  CDS (1)..(1347)
atgcttccaattcggcagagtttataccaaagagctcaaactcgatttacaaaattaagatttccaagattttttagcaaagacgattgcaatggaaagcaagtaaagaagttgagcttaaaaaatgtagatgtggctgggaaaagggtttttatgagagtggactttaatgtacccatgaaagatggcaaaataaccaacaaccaacgaattgtttccgcacttcccagtattaaatatgccttggacaagaaatgtaagtccttggttttggcatcccacttggggcgtccggatggcaaaaagaacaaaaagtttagcctggaacccgtggccaaggagctggagagtgtgctgggccagccggttcaattcctggacgactgcgtgggtgatagcaccctgaaagctttgaaggatccctccgacggcactgtgttcctgttggagaatcttcgtttctatgccgaggagacgggcagcagcaaggacgataacaagaagaaggtcaaagcagatcccgcgaaggtgaaggaattccgagccaagttggcgcagctgggcgagatctatgtgaacgatgcctttggaacagcacatcgtccgcatagttccatgatgggcgatggctacaaggtgcgagcggctggtttcctgctggacaaggaactggagtactttgccaaggttctccacgatccggccaagccctttttggccattctgggtggcgccaagatagccgataaaattccactgataacgaacctcctgaacaatgtaacggccatgatcatatccggtggcatggccttcacctttctcaaagtgctcaatggcatggagattggaaagtccctcttcgacgagaagggatccgagttggtcaacgacatagtctgcaaggcgaaggagaaggacgtgaatatactatttccgattgactttgtcatagccaataagatcgacaaggagccggataaagtggaacatgtggatgccacacagggcataccggaggacatgatgggtctggaccacggccaggcatccagtcagatgtttgctggcgctatttgtgcatccaaaaccatcgtctggaacggaccgccaggcttgttcgaaaacgagctattctccaaaggcaccgagtccatgctggaggcagtaatcggggccactaaccgaggagccaccacaatcgttggtggtggggatacggccaccgcttgcttgaagttcggaggcgccgacaaggtctcgcatgtgtccaccggtggaggagcttccctggagttgctggagggtaaggttctgcctggagtggctgccctttcggatgcctaa

SEQ ID NO: 56975 - protein, 448 aa, Drosophila melanogaster
MLPIRQSLYQRAQTRFTKLRFPRFFSKDDCNGKQVKKLSLKNVDVAGKRVFMRVDFNVPMKDGKITNNQRIVSALPSIKYALDKKCKSLVLASHLGRPDGKKNKKFSLEPVAKELESVLGQPVQFLDDCVGDSTLKALKDPSDGTVFLLENLRFYAEETGSSKDDNKKKVKADPAKVKEFRAKLAQLGEIYVNDAFGTAHRPHSSMMGDGYKVRAAGFLLDKELEYFAKVLHDPAKPFLAILGGAKIADKIPLITNLLNNVTAMIISGGMAFTFLKVLNGMEIGKSLFDEKGSELVNDIVCKAKEKDVNILFPIDFVIANKIDKEPDKVEHVDATQGIPEDMMGLDHGQASSQMFAGAICASKTIVWNGPPGLFENELFSKGTESMLEAVIGATNRGATTIVGGGDTATACLKFGGADKVSHVSTGGGASLELLEGKVLPGVAALSDA

SEQ ID NO: 56976 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgacgaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctcgacaaggtgaacgaaatgatcattggaggtggaatggcatttacgttccttaaggtattgaacaatatgcaaattggaggatcattgttcgacgaggagggttcaaagaccgttcagaagctggtggacaaagccaaggccaacaacgtgcaactgcatttaccagtggatttcgtaactggcgataaatttgccgaagatgctgccgttggagctgctaccgtcgagagcggaattcccgctggacacatgggtctcgacgttggaccgaagtctcgtgaggcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgtcgcgccaagtggggaacagaatctcaggtatcacacgtttctactggtggtggagcgtctttggaactgttggaaggcaaggttctacctggtgtcgacgccttgagcagcgcttaa

SEQ ID NO: 56977 - protein, 415 aa, Aedes aegypti; identical to SEQ ID NO: 10595

SEQ ID NO: 56978 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtgcagctaaggttgctgacaaaatccagctcattgaaaatctcctggacaaggtgaacgaagtgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 56979 - protein, 415 aa, Aedes aegypti; identical to SEQ ID NO: 10597

SEQ ID NO: 56980 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctggacaaggtgaacgaaatgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 56981 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDVYVNDAFGTAHRAHSSMMGEGYAQRAAGLLLNKELRYFSQALDNPPRPFLAILGGAKVADKIQLIENLLDKVNEMIIGGGMAFTFLKVLNNMEIGGSLFDEEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 56982 - DNA, 1248 bp, Aedes aegypti; identical to SEQ ID NO: 10598
  CDS (1)..(1248)

SEQ ID NO: 56983 - protein, 415 aa, Aedes aegypti; identical to SEQ ID NO: 10599

SEQ ID NO: 56984 - DNA, 1215 bp, Mycoplasma capricolum subsp; identical to SEQ ID NO: 10600
  CDS (1)..(1215): transl_table=4

SEQ ID NO: 56985 - protein, 404 aa, Mycoplasma capricolum subsp; identical to SEQ ID NO: 10601

SEQ ID NO: 56986 - DNA, 1248 bp, Aedes aegypti
  CDS (1)..(1248)
atggctctcaataaactcagcatcgagaatgtcgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctcgacaaggtgaacgaaatgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggcgataaatttgccgaagatgctgccgttggagctgctaccgtcgagagcggaattcccgctggacacatgggtctcgacgttggaccgaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 56987 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDLYVNDAFGTAHRAHSSMMGEGYAQRAAGLLLNKELRYFSQALDNPPRPFLAILGGAKVADKIQLIENLLDKVNEMIIGGGMAFTFLKVLNNMEIGGSLFDEEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 56988 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcaccgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctggcaaaatccagctcattgaaaatctcctggacaaggtgaacgaaatgatcattggaggtggaatggcatttacgttccttaaggtattgaacaatatggaaattggaggatcattgttcgacggggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 56989 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDVYVNDAFGTAHRAHSSMMGEGYAQRAAGLLLNKELRYFSQALDNPPRPFLAILGGAKVAGKIQLIENLLDKVNEMIIGGGMAFTFLKVLNNMEIGGSLFDGEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 56990 - DNA, 1440 bp, Leishmania major; identical to SEQ ID NO: 10604
  CDS (1)..(1440)

SEQ ID NO: 56991 - protein, 479 aa, Leishmania major; identical to SEQ ID NO: 10605

SEQ ID NO: 56992 - DNA, 1254 bp, Leishmania major
  CDS (1)..(1254)
atgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcgcggagctgctggggcagaaggtggagtttgcaccggactgcctggacgctgcggcgtacgcgtcgaagctgaagaacggcgacgtgctgttgctggagaacgtgcgtttctacgcggaggagggcagcaagaaggaggaggagcgcgacgcgatggcgaaggtactggcgtcgtacgcggacctgtatgtcagtgacgcctttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatcgagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcgcggtgtgcaggtgtttctgccagttgaccacgtgtgcaacaaggaatttaaggccgcggactcgccgctggtgacggagagcgtggacgtcccggacggctacatggcgctcgacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgctgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacagagaatga

SEQ ID NO: 56993 - protein, 417 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARIAELLGQKVEFAPDCLDAAAYASKLKNGDVLLLENVRFYAEEGSKKEEERDAMAKVLASYADLYVSDAFGTAHRDSATMTGIPKVLGAGYAGYLMEKEINYFSRVLNNPPRPLVAIVGGAKVSDKIELLDNMLGRINYLVIGGAMAYTFQKAQGRKIGISMCEEDKLDLAKSLLKKAQERGVQVFLPVDHVCNKEFKAADSPLVTESVDVPDGYMALDIGPRTIHMYEEVIGRCKSAIWNGPMGVFEMPCYSKGTFAVAKAMGTGTQKNGLLSIIGGGDSASAAELSGEAKNMSHVSTGGGASLELLEGKTLPGVAILTDRE

SEQ ID NO: 56994 - DNA, 1263 bp, Dictyostelium discoideum
  CDS (1)..(1263)
atgtcttcaaataaaattggtaataaattaagtcttgacaaggtagatgtaaaaggtaaaagagttttaattagagttgattataatgtaccattagataaaaataataatattacaagtactcaaagaattgatgcatcaattccaacattagaatattgtttaaagaatggtgctaaatcaattgtattgatgtcacatttaggtcgtccagatggtttggttaaaccagagtatagtttgaaaccagtggttaaagtattggaagatcaattaaaaagaccaattaaattcttatcagattgtgttggtgaacaagttgaaaaagaatgtgcaaatccagaggaaggtaccgttattttattggagaatctccgtttccacattgaagaggaaggttcaggtgttgatgcagagggtaaaaaggtcaaagccaacccagagaaagttaaagaattccgtgaatcactcaccaagctcggtgatgtctatgtgaacgatgcctttggtactgctcatagagcacatagttcaatggttggtattaatctcccacaaaaagccgctggtttcctcatgaaaaaagaattggaatactttgccaaggctttagagtcaccatcaaaaccattcttggcaattcttggcggtgcaaaggttagtgataaaattaaactcattgaaaaccttttgtataaagtcgatgaaatgatcattggtggtggtatggccttcactttcaagaaattcattgataacaaagagattggttcatcattgtttgagaaaacagccgaacaaatcaccaaagatatcattgccaaagccgctaaaaataatgtaaaattacatttcccagtcgattatgtcattgccgataaatttgataatgatgccaacatcaaaaccgtcactcaagatcaaggtatcccagaaggttggatgggtttagattgtggtccagagactatcaaagaaaacagagataccatctcaagagcaaaaaccatcgtttggaatggtcctatgggtgtatttgaaaagagcaatttcgaagccggtacaaaagctgccatggatgatgttgtcaatgccacaaccaatggtgctatcactatcattggtggtggtgataccgccacttgtgctgccaaatacaacactgaagataaagttagtcatgtctcaactggtggtggtgcttcattagaattattagaaggtaaagaattaccaggtgttactgctttatctgatttatga

SEQ ID NO: 56995 - protein, 420 aa, Dictyostelium discoideum; identical to SEQ ID NO: 10607

SEQ ID NO: 56996 - DNA, 1350 bp, Phaeodactylum tricornutum; identical to SEQ ID NO: 10612
  CDS (1)..(1350)

SEQ ID NO: 56997 - protein, 449 aa, Phaeodactylum tricornutum; identical to SEQ ID NO: 10613

SEQ ID NO: 56998 - DNA, 1326 bp, Phaeodactylum tricornutum; identical to SEQ ID NO: 10614
  CDS (1)..(1326)

SEQ ID NO: 56999 - protein, 441 aa, Phaeodactylum tricornutum; identical to SEQ ID NO: 10615

SEQ ID NO: 57000 - DNA, 1263 bp, Trypanosoma brucei; identical to SEQ ID NO: 10618
  CDS (1)..(1263)

SEQ ID NO: 57001 - protein, 420 aa, Trypanosoma brucei; identical to SEQ ID NO: 10619

SEQ ID NO: 57002 - DNA, 1323 bp, Trypanosoma brucei; identical to SEQ ID NO: 10620
  CDS (1)..(1323)

SEQ ID NO: 57003 - protein, 440 aa, Trypanosoma brucei; identical to SEQ ID NO: 10621

SEQ ID NO: 57004 - DNA, 1164 bp, Pseudomonas sp
  CDS (1)..(1164): transl_table=11
atgaccgtgttgaagatgaccgacctcgatctgcaaggtaagcgcgtgctgatccgcgaagacctcaacgtcccagtcaaggacggtgttgtcaccagcgatgcgcgcatccttgcttcgctgccgaccatcaagctggcgttggaaaaaggcgcggcagtcatggtctgctcgcacctgggccgtccgactgaaggcgagttttcagcagaaaacagcctcaagcctgttgctgattacttgagcaaggcgctgggccgtgaagtgccgctggtgagcgactacctcaatggcgtggacgttaaagccggcgacatcgtgctgttcgaaaacgtgcgcttcaacaaaggcgaaaagaaaaacgctgacgaattggccaagcaatacgcggccctgtgcgacgtgtttgtgatggatgcctttggcactgcacaccgcgccgaaggtccgacccacggcgtggccaagttcgccaaagtggcggctgcgggcccgttgctggcggcggaactggacgcactgggcaaagccctgggtgctccggccaagccaatggctgcgattgttgcaggctccaaggtgtcgaccaaacttgacgtactcaacagcctgagccagatctgcgacctgctgatcgttggcggtggcattgccagcacgttcctcgcggcggccggtcatccggtgggcaagtcgctgtacgagcctgatttgctggacaccgcgcgtgccatcgccgccaaggtcaacgtgccgttgcctaccgatgtggtcgtggccaaggaatttgctgaaagcgccgaagccaccgtcaagctgattgctgacgtggcagcagacgacatgattctggatatcggcccacaaacagccgagcacttcgcgcagctgttgaagacctcgaagactatcctgtggaacggacctgtcggcgtgttcgagttcgatcagttcggcaacggtaccaaagtgctggccaaggccatcgccgacagcgctgcattttctattgcaggcggcggcgacacattggcggccatcgacaagtacggtgtggccgatcaaatttcctacatctccaccggtggcggtgcattccttgagttcgttgaaggcaaagtgctgcctgctgtagaagtgctggaaagccgcgccaaagcctga

SEQ ID NO: 57005 - protein, 387 aa, Pseudomonas sp; identical to SEQ ID NO: 10623

SEQ ID NO: 57006 - DNA, 1239 bp, Methanosarcina acetivorans; identical to SEQ ID NO: 10626
  CDS (1)..(1239): transl_table=11

SEQ ID NO: 57007 - protein, 412 aa, Methanosarcina acetivorans; identical to SEQ ID NO: 10627

SEQ ID NO: 57008 - DNA, 1254 bp, Rhizopus niveus
  CDS (1)..(1254)
atgtctttatctaacaagctctctattcgcgacctcaacctcaaggacaaacgtgttcttattcgtgttgattttaatgttcccatgaaagacggtgccattaccaacaacaatcgtatcgttcaagctcttcctaccgtaaaatatgctcttgacaatggtgcctctgctgtcatcttaatgtctcacttgggtcgccctaacggtgaagctgtcgccaaatattctctcaaaccagtggctgctgaggttgaaaagcttttgggaaaacctgtcgaattcctcaacgactgcgtgggccctgatgtcgaaaaggcatgccaatccgccaaggacggtaaggttatccttttagaaaatcttcgtttccatatcgaagaagaaggttctgccaaggttgatggtcaaaaggttaaggctgatgctgaagcaatcaaaaaattccgtgcatctttgactactcttgctgatatatacatcaatgatgcctttggtactgctcaccgtgctcactcttccatggttggtgttgacctttctcaacgtgcagccggtttccttatgcaaaaggagcttgaatactttgcaaaggcactcgaaaatccctctcgcccttttcttgctatccttggtggtgccaaagtttctgataaaattcaattgattgaaaatatgcttgataaggtaaatgctttgattatctgtggtggtatggctttcactttcaaaaagacacttgataatgttaaaattggcaagtctctttttgatgaacctggttctaaattagtacaaaatcttgtaaaaaaagctgctgaaaagaatgtcaagattgtttttcctgttgactttatcactgctgataagtttgctcctgatgccagcacaggctatgccactgatgatgatggtatccctgatggatggcaaggccttgactgcggtgagcgatcaaacaaattattccgtgaggaaattttaaagtcaaagacaattgtctggaacggcccttctggtgtatttgaattcgatgccttctctagcggtaccaaggctgtccttgatgctgttattaatgctacaaaggaaggtgctactactattattattggtggaggtgacactgctactgctgctctcaaatggggtgctgaaggtcaagtctctcatatttctactggtggcggtgcctctcttgaacttcttgagggcaaggagcttcctggtgttactgctctttccagcaagaactaa

SEQ ID NO: 57009 - protein, 417 aa, Rhizopus niveus
MSLSNKLSIRDLNLKDKRVLIRVDFNVPMKDGAITNNNRIVQALPTVKYALDNGASAVILMSHLGRPNGEAVAKYSLKPVAAEVEKLLGKPVEFLNDCVGPDVEKACQSAKDGKVILLENLRFHIEEEGSAKVDGQKVKADAEAIKKFRASLTTLADIYINDAFGTAHRAHSSMVGVDLSQRAAGFLMQKELEYFAKALENPSRPFLAILGGAKVSDKIQLIENMLDKVNALIICGGMAFTFKKTLDNVKIGKSLFDEPGSKLVQNLVKKAAEKNVKIVFPVDFITADKFAPDASTGYATDDDGIPDGWQGLDCGERSNKLFREEILKSKTIVWNGPSGVFEFDAFSSGTKAVLDAVINATKEGATTIIIGGGDTATAALKWGAEGQVSHISTGGGASLELLEGKELPGVTALSSKN

SEQ ID NO: 57010 - DNA, 1263 bp, Trypanosoma congolense; identical to SEQ ID NO: 10628
  CDS (1)..(1263)

SEQ ID NO: 57011 - protein, 420 aa, Trypanosoma congolense; identical to SEQ ID NO: 10629

SEQ ID NO: 57012 - DNA, 1254 bp, Rhizopus niveus; identical to SEQ ID NO: 10632
  CDS (1)..(1254)

SEQ ID NO: 57013 - protein, 417 aa, Rhizopus niveus; identical to SEQ ID NO: 10633

SEQ ID NO: 57014 - DNA, 1518 bp, Crithidia fasciculata
  CDS (1)..(1518)
atgctcctctccacgcaatcgattcccataaaaaagagcgtcgacgacatctggccggtggcaggcaaacgcgttctcattcgggtggacttcaacgtgcccaccagctctggcggcatcgacgacgacttccgcattcgctctgctatccccactattcgccgcatcgttgaccagggtggcatctgcatcctcatcagccacctcggccgccccaccggtgtggactacgacaccgcccatgcagagcaggaaaagcgccagacaccggtgcagctgcccaattcgcgtggcaagaccgccttcttctctgggctgcgtggcgatgcgaaggcgacgatcttggcgtggtcgagtcagcgagagaaggctgcaacgctctccaacccgtacggcagtggcaagacggccgtctttgcgcgcctgccagaggaagagaagcggcgcctgctgctgcgcttcatgagtgagcacaaggaggagctcttcccccagctcggctccgcgggctacgagaaggagttcagcttggagccggtggcggtgaagctggcggagctgctggatcagcacgtgtactttggccacgactgcctcggcgcgcaagcggatattgcaaagctgcggtgtggggaggtgatgctgctggagaaccttcgcttctacacgaacgagaactcatctgacgagcgcaagcgcatgctgatggcgcgtattctcgcctcgtatgccgatgtgtacatcaacgacgccttcggcacggcgcaccgcgacagcgcgagtttgacgggcatcccccgcgtgctgcagcagggtgcggccggctacctgatggagaaggagatctcgtacttctccaaggtgctgaacaacccaccccggccgctcttggcgattatcggcggcgcgaagctcagcgacaagatgcaggtgctggagaacctgctggactgcgtcgacagcctcttcatcggtggtggcttggcgtacacgtttctccggtctcagggctactcgatcggcacgtcccacttcgaggaggcttttgtgcccttcgcccaagcgcttcctctcgctggcagcggacggcaggtgcgggtggtgctgccagaggaccacgtctgccacgcccacacgcggccggccgaagcgccgctcacgacgacgagtgccaatataccggacggctacgcagggctggacattggcccgctcaccatccaatccatcacgcacctcgtgcggcagtgcagcagcgtgatctggaacggaccacttggcatgttcgagatgccatactacgccttcggcacgttttccattgcgcgagtggtgagtcagtcttcggctgcgaagggcactaccagcatcgtcggcggtggcgacacggcgagcgcgatgatgaagtccggcgaggcggctcacatttcgcacatctccacaggcggcaacgcatcgctggagctgctggaggggaaggtgctagccgccgtggcggtgctggacaacaaggagtga

SEQ ID NO: 57015 - protein, 505 aa, Crithidia fasciculata; identical to SEQ ID NO: 10467

SEQ ID NO: 57016 - DNA, 1254 bp, Crithidia fasciculata
  CDS (1)..(1254)
atgtctctcgccccgaagaagacgatcgatgatgccgtggtgaagggcaagaaggtcctcatccgtgtggacttcaacgtgccggtgaagaacggcgagatcacgaacgacttccgcatccgctccgccctgccgacgatccagaaggtgctgaaggagggcggctcctgcatcctgatgagccacctcggccgcccgaagggtgcgaagatgagcgacccgaagccggccaagagcgtgcgcgggtacgaggaggctgcgacgctgcggccggtggctgcgcggctgtcggagctgctggggcagaaggtggagttcgcgccggactgcctggacgctgcgtcgtacgctgctaagctgaagggcggcgacgtgctgctgctggagaacgtgcgcttctacgcggaggagggcagcaagaaggaggaggagcgcgacgcgatggcgaaggtgcttgcggcgtacggcgacgtgtacgtgagcgacgccttcggcactgcgcaccgcgacagcgcggacatgacgggcatcccgaaggtgctgggtgcgggctacgccggctacctgatggagaaggagatcaactacttcgcgcaggtgctgaacaacccgccgcgtccgctggtggccatcgtgggcggtgcgaaggttagcgacaagatccagctgctggacaacatgctgggccgcatcaactacctggtgattggcggcgcgatggcgtacacgttccagaaggcgcagggccacgcgatcggcatctcgatgtgcgaggaggacaagctggaccttgccaagtcgctgctgaagaaggcgcaggagcgcaacgtggaggtgcttctgccggtggaccacgtgtgcaacaaggagttccaaggcgtggacgcgccgctggtgacgaaggacgtggagatcccggaggggtacatggcgctggacattggcccgaagacgatcaagatctacgaggacgtgattgccaagtgcaagagcacgatctggaacggcccgatgggtgtgttcgagatgccgtgctactcgaagggcacgttcgctgtggccaaggcgatgggcaacgggacgcagaagaacgggctgatgagcatcatcggcggcggcgacacggcgagcgctgcggagctgagcggggaggcgaagaacatgtcgcacgtgtcgactggcggcggcgcctcgctggagctgctggagggcaagtcgctgccgggtgtcaccgttctcaccaacaaggagtag

SEQ ID NO: 57017 - protein, 417 aa, Crithidia fasciculata
MSLAPKKTIDDAVVKGKKVLIRVDFNVPVKNGEITNDFRIRSALPTIQKVLKEGGSCILMSHLGRPKGAKMSDPKPAKSVRGYEEAATLRPVAARLSELLGQKVEFAPDCLDAASYAAKLKGGDVLLLENVRFYAEEGSKKEEERDAMAKVLAAYGDVYVSDAFGTAHRDSADMTGIPKVLGAGYAGYLMEKEINYFAQVLNNPPRPLVAIVGGAKVSDKIQLLDNMLGRINYLVIGGAMAYTFQKAQGHAIGISMCEEDKLDLAKSLLKKAQERNVEVLLPVDHVCNKEFQGVDAPLVTKDVEIPEGYMALDIGPKTIKIYEDVIAKCKSTIWNGPMGVFEMPCYSKGTFAVAKAMGNGTQKNGLMSIIGGGDTASAAELSGEAKNMSHVSTGGGASLELLEGKSLPGVTVLTNKE

SEQ ID NO: 57018 - DNA, 1266 bp, Trypanosoma brucei brucei
  CDS (1)..(1266)
atgtcactaaaagagaggaagagcattaacgaatgcgatcttaagggaaagaaggttcttatccgtgttgactttaatgttcctctggatgatggtaatattaccaacgactaccgaatccgatcagctctgccagccgtccaaaaagttctcacagaaggcggcagctgtgttctcatgagccacctcgggaggccgaaaggcgtttctatggctgaaggcaaagaactggggagcgctggcggtattcccgggttcgagcagaaggcaacactcaaaccggtagccaaggccctcagcgaattgttatcgagacccgtcacattcgcacctgactgtctgaacgctgcagatgtcgtctctaagatgtctccgggcgatgttgttctgcttgaaaatgtacggttctacaaagaagagggcagcaagaagagcactgaggaacgtgaagccatggccaagatcctttcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaatatccatgtgcgaggaaagtaaacttgaatttgctcgatccctgctgaagaaggcggaggaccgcaaggtgcagattattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaacgggtggtggtgcgtctttggaactcctcgagggcaaaacgcttcccggtgttacagtattggatgataaggagtaa

SEQ ID NO: 57019 - protein, 421 aa, Trypanosoma brucei brucei
MSLKERKSINECDLKGKKVLIRVDFNVPLDDGNITNDYRIRSALPAVQKVLTEGGSCVLMSHLGRPKGVSMAEGKELGSAGGIPGFEQKATLKPVAKALSELLSRPVTFAPDCLNAADVVSKMSPGDVVLLENVRFYKEEGSKKSTEEREAMAKILSSYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGISMCEESKLEFARSLLKKAEDRKVQIILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDDKE

SEQ ID NO: 57020 - DNA, 1242 bp, Alcaligenes eutrophus; identical to SEQ ID NO: 10454
  CDS (1)..(1242): transl_table=11

SEQ ID NO: 57021 - protein, 413 aa, Alcaligenes eutrophus; identical to SEQ ID NO: 10455

SEQ ID NO: 57022 - DNA, 1368 bp, Crithidia fasciculata
  CDS (1)..(1368)
atgtctctcgttccgaagaagagcatcgatgatgccgtggtgaagggcaagaaggtcctcatccgtgtggacttcaacgtgccggtgaagaacggcgagatcacgaacgacttccgcatccgctccgccctgccgacgatccagaaggtgctgaaggagggcggctcctgcatcctgatgagccacctcggccgcccgaagggtgcgaagatgagcgacccgaagccggccaagagcgtgcgcgggtacgaggaggctgcgacgctgcggccggtggctgcgcggctgtcggagctgctggggcagaaggtggagttcgcgccggactgcctggacgctgcgtcgtacgctgctaagctgaagggcggcgacgtgctgctgctggagaacgtgcgcttctacgcggaggagggcagcaagaaggaggaggagcgcgacgcgatggcgaaggtgcttgcggcgtacggcgacgtgtacgtgagcgacgccttcggcactgcgcaccgcgacagcgcggacatgacgggcatcccgaaggtgctgggtgcgggctacgccggctacctgatggagaaggagatcaactacttcgcgcaggtgctgaacaacccgccgcgtccgctggtggccatcgtgggcggtgcgaaggttagcgacaagatccagctgctggacaacatgctgggccgcatcaactacctggtgattggcggcgcgatggcgtacacgttccagaaggcgcagggccacgcgatcggcatctcgatgtgcgaggaggacaagctggaccttgccaagtcgctgctgaagaaggcgcaggagcgcaacgtggaggtgcttctgccggtggaccacgtgtgcaacaaggagttccaaggcgtggacgcgccgctggtgacgaaggacgtggagatcccggaggggtacatggcgctggacattggcccgaagacgatcaagatctacgaggacgtgattgccaagtgcaagagcacgatctggaacggcccgatgggtgtgttcgagatgccgtgctactcgaagggcacgttcgctgtggccaaggcgatgggcaacgggacgcagaagaacgggctgatgagcatcatcggcggcggcgacacggcgagcgctgcggagctgagcggggaggcgaagaacatgtcgcacgtgtcgactggcggcggtgcctcgctggagctgctggagggcaagtcgctgccgggcgtcaccgttctcaccaacaaggacgcgaaggcgcctgctgctgctgccgctgccggtggtgactgcccgtgcggttccggctgcgctgcggttcccgccgcagccacggcaacggtttcgatggtgctcgcctcgccatga

SEQ ID NO: 57023 - protein, 455 aa, Crithidia fasciculata; identical to SEQ ID NO: 10501

SEQ ID NO: 57024 - DNA, 1440 bp, Leishmania major
  CDS (1)..(1440)
atgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcagcgagctgctggggcagaaggtggagtttgcaccggactgcctggacgctgcgtcgtacgcgtcgaagctgaagaacgcggacgtgctgttgctggagaacgtgcgtttctacgcggaggagggcagcaagaaggaggaggagcgcgacgcgatggcgaaggtactagcgtcgtacggcgacgtgtatgtcagtgacgcgtttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatccagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcggaatgtgcaggtgtttctgccagttgaccacgtgtgcaacaaggaatttaaggccgcggactcgccgctggtgacggagagcgtggacgtcccggacggctacatggcgctggacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgatgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacaaggacgtgaaggagcggggagcttcgtgcaagttcgctttcggggtcgggagcccgagcagggaggcttgtccgctccgttgtgggcatatctttggcggtgcctccatcgtaagagagatagttaagatcgtcgtcgcgctgctgatcggcatttttattggtcgccgcatgagcaccaagctgatccggtaa

SEQ ID NO: 57025 - protein, 479 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARISELLGQKVEFAPDCLDAASYASKLKNADVLLLENVRFYAEEGSKKEEERDAMAKVLASYGDVYVSDAFGTAHRDSATMTGIPKVLGAGYAGYLMEKEINYFSRVLNNPPRPLVAIVGGAKVSDKIQLLDNMLGRINYLVIGGAMAYTFQKAQGRKIGISMCEEDKLDLAKSLLKKAQERNVQVFLPVDHVCNKEFKAADSPLVTESVDVPDGYMALDIGPRTIHMYEEVIGRCKSAIWNGPMGVFEMPCYSKGTFAVAKAMGTGTQKNGLMSIIGGGDSASAAELSGEAKNMSHVSTGGGASLELLEGKTLPGVAILTDKDVKERGASCKFAFGVGSPSREACPLRCGHIFGGASIVREIVKIVVALLIGIFIGRRMSTKLIR

SEQ ID NO: 57026 - DNA, 1440 bp, Leishmania mexicana; identical to SEQ ID NO: 10636
  CDS (1)..(1440)

SEQ ID NO: 57027 - protein, 479 aa, Leishmania mexicana; identical to SEQ ID NO: 10637

SEQ ID NO: 57028 - DNA, 1323 bp, Trypanosoma brucei brucei
  CDS (1)..(1323)
atgacccttaacgagaagaagagcattaatgaatgcgatcttaagggaaagaaggttcttatccgtgttgactttaatgttcccgtgaaaaacggtaagatcaccaacgactaccgaatccgatcagctctgccaacgctcaagaaggttctcacagaaggcggcagctgtgttctcatgagccacctcgggaggccgaaaggtattcccatggcgcaagctggcaaaatacggagcactggcggtgttcccgggttccaacagaaggcaacactcaaaccggtagccaaggccctcagcgaactgctattgaggcccgtcacattcgcacctgactgcctgaacgctgcagatgtcgtctctaagatgtctccgggcgatgttgttctgcttgaaaatgtacggttctacaaagaagagggcagcaagaaggcaaaagaccgtgaagccatggccaagatccttgcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaagggcatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttacagtattggacgaaaagtcggcggttgtgtcgtatgcctctgcaggtactggaactctttctaaccggtggagctctctttaa

SEQ ID NO: 57029 - protein, 440 aa, Trypanosoma brucei brucei
MTLNEKKSINECDLKGKKVLIRVDFNVPVKNGKITNDYRIRSALPTLKKVLTEGGSCVLMSHLGRPKGIPMAQAGKIRSTGGVPGFQQKATLKPVAKALSELLLRPVTFAPDCLNAADVVSKMSPGDVVLLENVRFYKEEGSKKAKDREAMAKILASYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKSAVVSYASAGTGTLSNRWSSL

SEQ ID NO: 57030 - DNA, 1527 bp, Trypanosoma brucei brucei; identical to SEQ ID NO: 10508
  CDS (1)..(1527)

SEQ ID NO: 57031 - protein, 508 aa, Trypanosoma brucei brucei; identical to SEQ ID NO: 10509

SEQ ID NO: 57032 - DNA, 1239 bp, Alcaligenes eutrophus
  CDS (1)..(1239): transl_table=11
atgatgagcctatcccatgcatcggtcccgcacacgaatcccacggcgccgcacacgctggccgcactgctcgccgctggcgggctggccggcaagcgtgtctttatccgcgccgacctcaacgtcccgcaggatgcagcgggcgatatcaccgacgatacccgcatccgtgcttccgtgcctgccatcgcggcctgcctgcaggcgggcgctgcggtgatggtcacctcgcacctgggccggccgcaggagggggcgcccgacccgcgccacagcctggcgccggtgggccgccgcctgtcggaactgctgggccgccaggtgccgctgttgtccggctggaccgagggcggcttccaggtgccgcccgggcaggtggtgctgctggaaaactgccgcatgaacacgggcgaaaagaagaacagcgacgagctggcgcagaagatggcggcgctgtgcgatgtctacgtcaacgacgccttcggcaccgcccaccgcgccgaggcgaccacgcatggcatcgccaggtacgcccccgttgcctgcgccggcccgcttctggccgccgagatcgacgcgttgggcaaggcgctgggccagccggcgcgtccgctggtggcgatcgtggccggctccaaggtctcgaccaagctgaccatcctgaagtcgctggccgacaaggtcgacaacctggtcgtcggcggcggcatcgccaataccttcatgctggccgccggcctgaagatcggcaagtcgctggccgagcctgacctgctggccgatgccagggccatcatcgacatcatggccgcccgcggcgcctcggtgccgatcccggtcgacgtggtgtgcgccaaggagttcagcgccaccgccgcggccgcggtcaaggacgtcagggacgtggccgacgacgacatgattctcgacatcggcccgaagaccgcggccatgctggccgaccagctcaaggccgccggcaccatcgtctggaatggcccggttggcgtgttcgaattcgaccagttcggcaatggcaccagggtgctggcacaggccatcgccgagtcgaaggcgttctcgatcgccggcggcggcgacacgctggccgccatcgccaagtacggcattgccgaccgcgtgggctacatctcgaccggcggcggcgcgttcctggaattcctggaaggcaagaagctgcccgcactggacgtgctggagcaacgggccgccagctga

SEQ ID NO: 57033 - protein, 412 aa, Alcaligenes eutrophus
MMSLSHASVPHTNPTAPHTLAALLAAGGLAGKRVFIRADLNVPQDAAGDITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPVACAGPLLAAEIDALGKALGQPARPLVAIVAGSKVSTKLTILKSLADKVDNLVVGGGIANTFMLAAGLKIGKSLAEPDLLADARAIIDIMAARGASVPIPVDVVCAKEFSATAAAAVKDVRDVADDDMILDIGPKTAAMLADQLKAAGTIVWNGPVGVFEFDQFGNGTRVLAQAIAESKAFSIAGGGDTLAAIAKYGIADRVGYISTGGGAFLEFLEGKKLPALDVLEQRAAS

SEQ ID NO: 57034 - DNA, 1233 bp, Aeropyrum pernix; identical to SEQ ID NO: 10410
  CDS (1)..(1233)

SEQ ID NO: 57035 - protein, 410 aa, Aeropyrum pernix; identical to SEQ ID NO: 10411

SEQ ID NO: 57036 - DNA, 1251 bp, Agaricus bisporus
  CDS (1)..(1251)
atgtctctctccaacaaactctccatcactgacctcgccctcaccggcaagcgtgtccttatccgcgtcgacttcaactcccccatccaagacggaaagataaccaaccccgcccgtatcaatgccgccctccccactatcaaatatgccctcgacaatggcgcctccaaggtcatcttaatgtcgcatctcggcaggcccgatggcaaggcgatctccaaatactcactcaaacctgtggcctcagagctggaaaagctcttgaagaaaccggtcttcttcttgcatgactgcgtcggccctgacatcgaaaaggcagtcctggaggcacccgagggtgctgtcgttctgctcgagaaccttcgcttccacattgaggaagaaggctctgccaagaacgaggaaggaaaaaaaatcaaagctgatccttccaaggtcacccagttccgcgagcagctcaccaggctcggcgatgtttatgtgaacgatgcctttggtacggctcatcgcgctcactccagcatggttggcatcaagcttcctcgaagggcttctgggtttttggtcaagaaagaactagactactttgcaaaggcactggaaaaccccgaacgacccttccttgctatccttggtggtgccaaagtgtctgacaagatccagctgattgaaaacatgctcgacaaggtcaactgtctcgtcatcggaggtggtatggcattcactttcaagaagacaatgcaaaatgttgcgattggcaactctctctttgacaaaccagggtctgaaaaagtggccgggatcgtcgaaaaggccaagaagaacaatgtcgaaattgtgttccccgtcgactatgttgtcggagacaagtttgatgcaaacgccaaccacaagatagtcacggatgacgaaggcgttccggatggttggatgggtctcgacgttggtccaaagtctaatgagctcttccgtgaagcggtcctgaaagccaagacgattctctggaacggtcctcccggagtgttcgaatttcctgcgtttgccaagggatcaaaggtgcttttggatgccacggtagaggcggtacaaaagggggctactgttatagttggtgggggtgatacagctacggtagttgcgaatcatgacgcagaagagaagctgagccacgtcagcactggtgggggtgcgagtctggagctgctggagggcaagacgctgcctggagtggcagaattgagcaacaaatga

SEQ ID NO: 57037 - protein, 416 aa, Agaricus bisporus; identical to SEQ ID NO: 10643

SEQ ID NO: 57038 - DNA, 1203 bp, Anabaena sp; identical to SEQ ID NO: 10402
  CDS (1)..(1203)

SEQ ID NO: 57039 - protein, 400 aa, Anabaena sp; identical to SEQ ID NO: 10403

SEQ ID NO: 57040 - DNA, 1239 bp, Aplysia californica
  CDS (1)..(1239)
atgaacaagctcagtattaacgacgtggatgtgagggacaagagagtcctgatcagagtcgatttcaacgtccccttgaaaaatggacagatctcaaacaaccagagaatcgctgcagccctgcctacgatcaagcttgccttggagaagggtgccaagtcagtggtgctcatgtctcatctcggtcggccagacgggcgcccaatccatgcggccagtatgaagccggtggtggcagagctggagaacctgttgggaaagaaaatcatgtttctggaagactgcgtgggttccaaggtagaggccgcctgtgccaacccggagcccggcagcgtgatcctgctggaaaatctccgcttccacgtggagaaggaggggaagggcaaggacgctcagggcaacaaggctaaggcagatgatgctgctgtggctgccttcagggcctccttgtccaaactgggagacgtctacgtgaacgacgcttttggcacagctcatagagctcacagctccatggtgggtgtggatctgccggtcaaggcctgcggtctgctcatgaagaaagagttggactactttgccaaagccctggagaaccccgctcgtccgttcctggctatcctgggaggagctaaagttgctgacaaaatccagctgattgagaaccttatggacaaagtcaatgagatgatcattggtggtggaatggctttcacattcttgaaagtactcaacaatatggacatcggaggttctctgtttgacgagggggccaagatcgttggccgtctggtggacaaggcgaaggagaagggagtgaagctccacctgccctccgacttcatcaccggcgacaagtttgccgacgtcgccaagtccgccacggcgtctgttgcgtctggcatcccagaaggttggatgggtctggatgttgggaccaaaaccaacgaagtattccagaaggtgattgaaggagcaaagacaattgtgtggaacgggccccccggagtgtttgagtttgagaacttcagcacgggctccaagcagatgatggactctgtggtcagggccaccgaggcaggaaccatcactatcattggtggatgtgacactgccacgtgtgccaagaattcaaacgccacggagaaggtgagccatgtgagcacaggaagcggaaccagcctggagctgttggaaggcaaaatccttcctggcgtggctgccctgtcccagccgtga

SEQ ID NO: 57041 - protein, 412 aa, Aplysia californica; identical to SEQ ID NO: 10645

SEQ ID NO: 57042 - DNA, 1194 bp, Aquifex aeolicus; identical to SEQ ID NO: 10420
  CDS (1)..(1194): transl_table=11

SEQ ID NO: 57043 - protein, 397 aa, Aquifex aeolicus; identical to SEQ ID NO: 10421

SEQ ID NO: 57044 - DNA, 1224 bp, Archaeoglobus fulgidus
  CDS (1)..(1224): transl_table=11
gtgatgatagacggccttccaacactagacgatattccgtacagaggaaagcacgttctgctgagggttgacatcaacgctcctattgtgaactcaacgattctcgacacgagcagattcgagagccacattccgacaattgaggctcttgaagactcaaagctcgttttgctcgcacaccagagccgacccggaaagaaggacttcacgagtctcgaaagccacgcatccacactttccaaactgctcgggaagagagtcgagtacatagacgaaattttcagcaaaggcgttctgagaagaataaaggagatggagaacggtgaggtaattttgctcgagaacgtgaggttctactccgaggagcagttgaacagaagcgctgaggagcatgccgagtgccacatggtcaggaaactcagcacagcctttgacctctttgtcaacgacgccttctccgcatcccatcgaagccacgcatctttggtcggcttcgttccggttctgccatccgtcgtgggaaggctcgtcgaaaatgaggttaccgccctcagcaaacccctcaagggggaggggagaaagatatttgtcctgggcggagctaaaatcaaggactcggtgaaagttctaaaaaacgtgctggaaaacaacattgcggaaaaagtcgttctcacgggtgtagttgccaactactttctcatgctgaaaggttacgatataggtgaagtgaacagaaaggttgtggaggacaacaaggaagacgtgagcgacgaggagatgataaacatactcaagaagtactccgacaaaattatccttcccattgacctcggtatagagaaagacggtgtcagggtagatatcccattggagaagtttgatgggaaatacagaataatggatattgggcttgaaaccgttaaccagctttcggaaatcatcccgaagtacgattatgtggttctgaacggtcctgcgggagtttttgaggatgagcgtttctctctcggaacttacgagattctgagggccgcgacaagggctggttactcggttgttggcggggggcacatcgcctcagcagcacgcctcttcggcctttcggacaagttcagccacatatcaactgcaggaggggcgtgcataaggttcctgagcggtgaaaagctggtagctcttgaggttatcaaggaatactgggcgaagaagtggggcaaatcttaa

SEQ ID NO: 57045 - protein, 407 aa, Archaeoglobus fulgidus; identical to SEQ ID NO: 10391

SEQ ID NO: 57046 - DNA, 1248 bp, Ashbya gossypii
  CDS (1)..(1248)
atgtcgctatcctctaagctaacagtcaaggacctgagccttgcgggcaaacgcgtgttcatccgcgtggacttcaacgtgccgctagacgggaagacgatcacgtcgaaccagcgcattgtggccgcgctacccacgatcaagtacgtgttggagcagggccccaaggcggtggtgttggcgtcgcacctagggcggcccaacggcgagcgcaacgagaagtactcgttggcgccggtggccgcggagctggagaagctgctgggccagaaggtgaactcctggacactgcgtgggcagcacgtgaccgctgcggtcaacggcgcggctgcggggtccgtgttcctgcttgagaacctgcggttccacatcgaggaggagggctcgcgcaaggtggacggcgagaaggtcaaggcgtctgcggaggacgtgcagaagttccgccagggcctcatgtcgctcgcggacgtctacgtcaacgacgccttcggcaccgcgcacagagcgcactcctcgatggtcggcttcgagctgcctgagagggccggcggcttcttgttgtcgcgcgagctggagtacttcagcaaggcgttggagaaccctacgagacccttcttggcgatcctgggcggtgccaaggttgccgacaagatccagttgatcgacaacttgttggacaaggtcgactcgattgtgatcggcggtggcatggccttcaccttcaagaaggtgcttgagaacatggagatcggtaactccatctacgacaaggcgggtgccgagatcgttcctaagctagcggagaaggccaagaagaacggcgtcaagatcgtgttgcctgtggacttcgtgatcggcgacgacttctcccaggacgccaacaccaagattgtctctgcctccgagggcattccatccggctgggagggtctagactgtggtcctgagtccagaaagctgttcagcgagaccatcgcgagcgcgaagaccatcgtgtggaacggcccaccaggtgtctttgagattccaaagttctccgagggtacccaggccatgcttgcggccgctgtcaaggcctccgaggctggcagcaccgtcatcatcggcggtggtgacaccgctaccgtggccaagaagtacggtgtggtcgagaagatctcccatgtgtccaccggtggtggtgcctccctagagctattggagggtaaggacctaccaggtgtcaccttcttgtccagcaagcagtag

SEQ ID NO: 57047 - protein, 415 aa, Ashbya gossypii
MSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 57048 - DNA, 1254 bp, Aspergillus oryzae; identical to SEQ ID NO: 10646
  CDS (1)..(1254)

SEQ ID NO: 57049 - protein, 417 aa, Aspergillus oryzae; identical to SEQ ID NO: 10647

SEQ ID NO: 57050 - DNA, 1185 bp, Bacillus cereus
  CDS (1)..(1185): transl_table=11
atgaacaaaaaatcaattcgtgacgtagatttaaaaggtaagcgtgtattttgccgcgttgacttcaacgtacctatgaaagaaggcaaaattacagatgaaactcgtatccgtgcagctcttcctacaattcaatatttagtagagcaaggtgcgaaagttattttagcaagccacttaggccgtccaaaaggtcaagtagtagaagaaatgcgtttaactccagtagcagcacgtttaggcgagcttcttggtaaagacgttaaaaaagcagacgaagcattcggaccagctgtacaagaaatggttgcagcaatgaacgaaggcgacgtattagttcttgaaaacgtacgtttctatgcgggcgaagaaaagaacgatgcagaacttgcgaaagaatttgcagctcttgctgacatcttcgtaaacgatgcattcggtgcagctcaccgtgctcacgcttctacagcaggtatcgcggactacctaccagcagtatctggtttactaatggaaaaagagttagatgttcttggaaaagcactttctaacccagatcgtccattcacagctatcatcggtggtgcgaaagtaaaagataaaatcggtgtaattcgtcatctattagacaaagtagataacttaatcatcggtggcggacttgcttacacattcgttaaagctttaggtcatgaaattggtctatctctatgtgaagacgacaagattgaactagctaaagaatttatgcaacttgcaaaagaaaaaggcgtaaacttctacatgccagttgatgttgtaatcactgaggaattctctgaaactgcaacaactaaaatcgttaatatcgattctatcccttctaactgggaaggcgtggacatcggtcctaaaacacgtgaaatttatgcagatgtaattaaaaactctaagcttgttgtatggaatggaccaatgggtgtattcgaaatgactccattcgcagaaggtacaaaagcagtaggacaagcattagcagatgcagaaggtacatactctgttatcggcggtggtgactctgcagcagctgttgaaaaattcggtatggctgataaaatgagccacatttctactggcggcggtgcgtcattagaattcatggaaggtaaagagcttccaggtgtagtttgtcttaacgacaaataa

SEQ ID NO: 57051 - protein, 394 aa, Bacillus cereus
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELDVLGKALSNPDRPFTAIIGGAKVKDKIGVIRHLLDKVDNLIIGGGLAYTFVKALGHEIGLSLCEDDKIELAKEFMQLAKEKGVNFYMPVDVVITEEFSETATTKIVNIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 57052 - DNA, 1185 bp, Bacillus halodurans; identical to SEQ ID NO: 10446
  CDS (1)..(1185)

SEQ ID NO: 57053 - protein, 394 aa, Bacillus halodurans; identical to SEQ ID NO: 10447

SEQ ID NO: 57054 - DNA, 1185 bp, Bacillus megaterium; identical to SEQ ID NO: 10464
  CDS (1)..(1185): transl_table=11

SEQ ID NO: 57055 - protein, 394 aa, Bacillus megaterium; identical to SEQ ID NO: 10465

SEQ ID NO: 57056 - DNA, 1185 bp, Bacillus stearothermophilus
  CDS (1)..(1185): transl_table=11
atgaacaagaagacgatccgcgacgttgatgtgaggggaaagcgcgtcttttgccgcgtcgatttcaacgttccgatggagcaaggcgctatcaccgatgacacgcgcattcgcgccgcactcccgacgatccgctatttgatcgagcacggggcgaaagtcattttggcgagccacctcggccgcccgaaaggaaaagtggtcgaagaattgcgtttggatgccgttgcgaagcggctcggcgagctgcttgaacggccggttgccaaaacgaatgaagcggtcggcgatgaggtgaaagcggcggtcgaccgtttgaacgaaggcgatgtgctcttgcttgagaacgtccgtttttaccctggcgaagagaaaaatgatcccgagctcgccaaagcgtttgcggagcttgcggatctatatgtcaacgatgcgttcggcgccgcccatcgcgctcatgcgtcgacggaaggcatcgcccattacttgccggcggtggccggatttttgatggaaaaagaacttgaagtgcttggcaaggcgctttcgaatccggaccgcccgtttacagcgatcatcggcggggcgaaagtgaaagacaaaatcggcgtcatcgacaatttgcttgaaaaagtcgacaacttgatcatcggcggcggactggcgtatacgttcgtcaaagcgctcggccatgacgtcggcaagtcgctgcttgaggaggacaaaatcgaactcgccaaatcgtttatggaaaaggcgaaagaaaaaggcgtccgtttttatatgccggtggacgtggtcgtcgccgaccggtttgcgaacgacgccaacacgaaagtcgtgccgattgacgcgattccagccgattggtcggcgcttgacatcggcccgaaaacgcgcgaattgtaccgcgatgtcattcgcgagtcgaagctcgttgtctggaacggcccgatgggcgtctttgaaatggacgcgttcgcccacgggacaaaagcgatcgccgaagcactggcggaagcgctcgacacctattcggtcatcggcggcggggattcggcggcggcggttgagaaattcggcttggccgacaaaatggatcatatctccaccggcggcggcgcttcgctcgagtttatggaaggaaaacagctgccgggtgtcgtcgcactcgaagacaaatga

SEQ ID NO: 57057 - protein, 394 aa, Bacillus stearothermophilus; identical to SEQ ID NO: 10459

SEQ ID NO: 57058 - DNA, 1185 bp, Bacillus subtilis; identical to SEQ ID NO: 10414
  CDS (1)..(1185): transl_table=11

SEQ ID NO: 57059 - protein, 394 aa, Bacillus subtilis; identical to SEQ ID NO: 10415

SEQ ID NO: 57060 - DNA, 1260 bp, Bacteroides thetaiotaomicron; identical to SEQ ID NO: 10648
  CDS (1)..(1260): transl_table=11

SEQ ID NO: 57061 - protein, 419 aa, Bacteroides thetaiotaomicron; identical to SEQ ID NO: 10649

SEQ ID NO: 57062 - DNA, 1194 bp, Bartonella henselae; identical to SEQ ID NO: 10650
  CDS (1)..(1194): transl_table=11

SEQ ID NO: 57063 - protein, 397 aa, Bartonella henselae; identical to SEQ ID NO: 10651

SEQ ID NO: 57064 - DNA, 1206 bp, Bdellovibrio bacteriovorus; identical to SEQ ID NO: 10652
  CDS (1)..(1206): transl_table=11

SEQ ID NO: 57065 - protein, 401 aa, Bdellovibrio bacteriovorus; identical to SEQ ID NO: 10653

SEQ ID NO: 57066 - DNA, 1182 bp, Borrelia burgdorferi; identical to SEQ ID NO: 10450
  CDS (1)..(1182): transl_table=11

SEQ ID NO: 57067 - protein, 393 aa, Borrelia burgdorferi; identical to SEQ ID NO: 10451

SEQ ID NO: 57068 - DNA, 1197 bp, Bradyrhizobium japonicum; identical to SEQ ID NO: 10658
  CDS (1)..(1197)

SEQ ID NO: 57069 - protein, 398 aa, Bradyrhizobium japonicum; identical to SEQ ID NO: 10659

SEQ ID NO: 57070 - DNA, 1188 bp, Brucella suis; identical to SEQ ID NO: 10662
  CDS (1)..(1188)

SEQ ID NO: 57071 - protein, 395 aa, Brucella suis; identical to SEQ ID NO: 10663

SEQ ID NO: 57072 - DNA, 1254 bp, Caenorhabditis elegans; identical to SEQ ID NO: 10494
  CDS (1)..(1254)

SEQ ID NO: 57073 - protein, 417 aa, Caenorhabditis elegans; identical to SEQ ID NO: 10495

SEQ ID NO: 57074 - DNA, 1203 bp, Campylobacter jejuni; identical to SEQ ID NO: 10412
  CDS (1)..(1203): transl_table=11

SEQ ID NO: 57075 - protein, 400 aa, Campylobacter jejuni; identical to SEQ ID NO: 10413

SEQ ID NO: 57076 - DNA, 1254 bp, Candida albicans
  CDS (1)..(1254): transl_table=12
atgtcattatctaacaaattatcagtcaaagacttagacgttgctggaaagagagtctttatcagagttgacttcaacgtcccattggacggtaagactatcaccaacaaccaaagaattgttgctgctttgccaaccatcaaatacgttgaagaacataaaccaaaatacattgtcttggcttcccacttgggtagaccaaacggtgaaagaaacgacaaatactcattagctccagttgctactgaattggaaaaattgttgggtcaaaaagtcaccttcttgaacgattgtgttggtccagaagtcaccaaggctgttgaaaacgccaaagatggtgaaatctttttgttggaaaacttgagataccacattgaagaagaaggttcttccaaagacaaggatggtaagaaagtcaaggctgatccagaagccgttaagaaattcagacaagaattgacttcattggctgatgtctacattaacgatgcctttggtactgctcacagagcccactcctctatggttggtctcgaagttccacagagagctgctggtttcttaatgtccaaagaattggaatactttgctaaggctttggaaaacccagaaagaccattcttggccattttgggtggtgctaaagtttctgacaagattcaattgattgacaacttgttggacaaggttgatatgttgattgttggtggtggtatggccttcactttcaagaaaatcttgaacaaaatgccaattggtgattctcttttcgatgaagccggtgctaaaaacgttgaacacttggttgaaaaagctaagaaaaacaatgttgaattgatcttgccagttgattttgtcactgctgataaattcgacaaagatgccaaaacttcttctgctactgatgctgaaggtattccagacaactggatgggtttggactgtggtccaaaatctgtcgaattgttccaacaagctgttgccaaagctaagaccattgtttggaacggtccaccaggtgttttcgaatttgaaaaattcgccaacggtactaaatccttattggatgctgctgtcaaatctgctgaaaatggtaacattgttatcattggtggtggtgatactgctactgttgctaagaaatacggtgtcgttgaaaaattatcgcacgtttctactggtggtggtgcttcattggaattattagaaggtaaagacttgccaggtgtagttgctctttccaacaaaaactaa

SEQ ID NO: 57077 - protein, 417 aa, Candida albicans; identical to SEQ ID NO: 10669

SEQ ID NO: 57078 - DNA, 1251 bp, Candida glabrata; identical to SEQ ID NO: 10540
  CDS (1)..(1251)

SEQ ID NO: 57079 - protein, 416 aa, Candida glabrata; identical to SEQ ID NO: 10541

SEQ ID NO: 57080 - DNA, 1254 bp, Candida maltosa; identical to SEQ ID NO: 10460
  CDS (1)..(1254)

SEQ ID NO: 57081 - protein, 417 aa, Candida maltosa; identical to SEQ ID NO: 10461

SEQ ID NO: 57082 - DNA, 1191 bp, Caulobacter crescentus; identical to SEQ ID NO: 10448
  CDS (1)..(1191): transl_table=11

SEQ ID NO: 57083 - protein, 396 aa, Caulobacter crescentus; identical to SEQ ID NO: 10449

SEQ ID NO: 57084 - DNA, 1212 bp, Chlamydophila caviae; identical to SEQ ID NO: 10672
  CDS (1)..(1212): transl_table=11

SEQ ID NO: 57085 - protein, 403 aa, Chlamydophila caviae; identical to SEQ ID NO: 10673

SEQ ID NO: 57086 - DNA, 1212 bp, Chlamydia muridarum; identical to SEQ ID NO: 10674
  CDS (1)..(1212): transl_table=11

SEQ ID NO: 57087 - protein, 403 aa, Chlamydia muridarum; identical to SEQ ID NO: 10675

SEQ ID NO: 57088 - DNA, 1209 bp, Chlamydia pneumoniae; identical to SEQ ID NO: 10428
  CDS (1)..(1209): transl_table=11

SEQ ID NO: 57089 - protein, 402 aa, Chlamydia pneumoniae; identical to SEQ ID NO: 10429

SEQ ID NO: 57090 - DNA, 1194 bp, Chlorobium tepidum; identical to SEQ ID NO: 10676
  CDS (1)..(1194): transl_table=11

SEQ ID NO: 57091 - protein, 397 aa, Chlorobium tepidum; identical to SEQ ID NO: 10677

SEQ ID NO: 57092 - DNA, 1212 bp, Chlamydia trachomatis; identical to SEQ ID NO: 10392
  CDS (1)..(1212)

SEQ ID NO: 57093 - protein, 403 aa, Chlamydia trachomatis; identical to SEQ ID NO: 10393

SEQ ID NO: 57094 - DNA, 1176 bp, Chromobacterium violaceum; identical to SEQ ID NO: 10678
  CDS (1)..(1176): transl_table=11

SEQ ID NO: 57095 - protein, 391 aa, Chromobacterium violaceum; identical to SEQ ID NO: 10679

SEQ ID NO: 57096 - DNA, 1194 bp, Clostridium perfringens; identical to SEQ ID NO: 10680
  CDS (1)..(1194)

SEQ ID NO: 57097 - protein, 397 aa, Clostridium perfringens; identical to SEQ ID NO: 10681

SEQ ID NO: 57098 - DNA, 1206 bp, Clostridium tetani
  CDS (1)..(1206): transl_table=11
gtggtttatgtggcatttaataaaaaaaccattgaagacattgatgttaaaggaagaaaagttttagtaagatgtgattttaatgtacctttaaaagatggaaaaataacagatgaaaatagattaatgggagcactaccaactattaaatatattatggaaaagggcggtaaagttattttatgttctcaccttggtaaaccaaaaggagagcctaaacaggaattatctctagcaccagtagctaaaagattatctgagcttttaaataaggaagttttatttccagcagataatgaagtagttggagaaaatgctaaaaaagcagtagaaaatatgaaagatggagatgtaatcctattacaaaatacaagatatagaaaagaagaaactaagaatgaagaaaccttttcaaaagaattagcatctcttgcagatatatttgtaaatgatgcttttggaacagcacatagagcacattgctctacagttggagtaacagaatttgttgcaacatcagtatgtggatacttaatccaaaaagaattaaagtttttaggtaatgctgttgaaaatccacaaagaccttttatatcaattcttggaggagctaaagtatctgataaaataaatgtaataaataatttattagaaaaagttgatactctaattataggtggaggaatgagctatactttccaaaaggctcaagggtacacaataggaagctctcttttagaagaagacaaaatagattatgcaaaagaaatgatagaaaaggcaaaagaaaagggagtaaaattacttctacctgtagataatgtagcagctgaaaaatttgcagaagatgcagaagctattataacagaagatcaaaatattaaagaaggatatatgggacttgatataggacctaaaacttcaaaactttattcacaagaggttcaaagcgctaagactgtagtttggaatggacctatgggtgtatttgaatttgaaaaatttgcaaaaggtactatagaagtagcgaaggccatggctgaatcacaagctacaaccataataggtggaggagatagtgctgcggctgtaaatcaacttggatttggggataaaatgacccatatatctacaggtggaggagcttcattagaatttttagaaggaaaagagcttccaggaatagcagcacttaacgataaatag

SEQ ID NO: 57099 - protein, 401 aa, Clostridium tetani; identical to SEQ ID NO: 10683

SEQ ID NO: 57100 - DNA, 1218 bp, Corynebacterium diphtheriae; identical to SEQ ID NO: 10684
  CDS (1)..(1218): transl_table=11

SEQ ID NO: 57101 - protein, 405 aa, Corynebacterium diphtheriae; identical to SEQ ID NO: 10685

SEQ ID NO: 57102 - DNA, 1218 bp, Corynebacterium glutamicum
  CDS (1)..(1218): transl_table=11
atggctgttaagaccctcaaggacttgctcgacgaaggcgtagacggacgccacgtcatcgttcgatctgacttcaatgttcccctcaacgatgaccgcgagatcaccgataagggccgaatcattgcctccctaccaacccttaaagcactgagcgaaggtggcgcaaaggtcatcgtcatggctcaccttggccgcccaaagggcgaggtcaacgagaagtactccctcgcacctgtcgctgaggcactctccgatgagcttggccagtacgttgcacttgccgcagacgttgttggcgaagacgcacacgagcgcgcaaacggcctgaccgagggcgacatcctgctcctggagaacgtgcgcttcgacccacgcgaaacctccaaggacgaggcagagcgcaccgctttcgctcaggagctcgcagctcttgcagcagacaacggcgcattcgtttctgacggcttcggtgttgtccaccgcgcacagacctccgtctacgacattgcaaagttgctgccacactacgctggcggactggtagagaccgagatttccgttctggaaaagatcgcagaatcaccagaggcaccatacgtagtggttctcggtggatccaaggtctctgacaagatcggtgttattgaggcgctggctgccaaggctgacaagatcatcgtcggtggcggcatgtgctacaccttcctcgcagctcagggacacaacgttcagcagtccctcctgcaggaagaaatgaaggctacctgcaccgacctgctcgcacgcttcggtgacaagatcgttctcccagttgacctggttgcagcatccgaatttaacaaggacgcagagaagcagatcgttgacctggactccatcccagaaggctggatgtctcttgacatcggaccagagtccgtcaagaacttcggtgaggttctcagcaccgctaagaccatcttctggaacggcccaatgggcgtgttcgagttcgcagcattctctgaaggcacccgcggcatcgcccaggccatcatcgatgcaactgcaggcaacgacgcattctccgttgttggcggtggcgactccgcagcatccgttcgcgtgctcggcctgaacgaagacggcttctcccacatctccaccggtggtggcgcatccctcgagtaccttgaaggcaaggaactcccaggcgttgcaattctcgctcagtaa

SEQ ID NO: 57103 - protein, 405 aa, Corynebacterium glutamicum
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 57104 - DNA, 1176 bp, Coxiella burnetii; identical to SEQ ID NO: 10688
  CDS (1)..(1176): transl_table=11

SEQ ID NO: 57105 - protein, 391 aa, Coxiella burnetii; identical to SEQ ID NO: 10689

SEQ ID NO: 57106 - DNA, 1251 bp, Debaryomyces hansenii; identical to SEQ ID NO: 10530
  CDS (1)..(1251)

SEQ ID NO: 57107 - protein, 416 aa, Debaryomyces hansenii; identical to SEQ ID NO: 10531

SEQ ID NO: 57108 - DNA, 1236 bp, Deinococcus radiodurans
  CDS (1)..(1236): transl_table=11
ttgacgggtttgtgcccgctccatcaaccatcacctcttgaccatccacattccggaggaacacccatgcaaaacctcagtcaattggatgtcaagggcaagcgcgtcctggtgcgcgtggactacaacgtgccggttggggacggcgtggtacaggacgacacccgcatcacggcgagcgtgccgaccatcaagaagctgcttgacggcggcgccagcgtcgtgctgatgagccacttcggacggcccaagaatggccccgaggacaagtacagcctgaagccggtggctgaggccgtcagccgcgcactcgggcaggacgtgaagttcattcccagcctgccaggcagcgacgaaaccctccaggccgtgcaggcgctcaggcccggtgaagtcgcgctgctggaaaacgtgcgcttcgaggcgggcgaggaaaagaacgatgcggcgctgaacgacaagctggccaagctgggtgacgccttcgtcctcgacgcgtttggctcggcgcaccgggcgcactcgtcggtcagcggcgtggccggcaagctaccgcacgcggcgggcgggctgctccagagcgaagtggacgcgctcggcaagttgctgcacgcgccggagcatccctacgtggtcatcatcggcggggcgaaagtcagcgacaagatcaaggtgatcgagaacctgctgcccaaagtggaccgcatgctgatcggcggcggaatgatgttcaccttcatcaaggcgcgcggcgggcagatcggcaacagtctggtggaagacgaccagcttgacctggcgaaggggttgctggagaagtacggtgacaagctgctgcttccgaccgacgcggtggccgccgacaaattcgccgccgatgctcagagcaaagtcgtccctgccgaccagattcctgacggctggatgggcctcgatatcgggcctgacacgcagcgggcgtatgccgacgccttgcagggcgccaaaactgtcttctggaacggtccgatgggcgtgttcgagttcgaccagttcgcggcaggcaccaacgcggtggcggcggcggtggggagcctgaaagaccaggcctacaccgtggtcggcggcggcgactcggtgagcgccatcaacaagagcggcaaggccgaccagatcgaccacatctccaccggcggcggtgcgagcctggaactgctggaaggcaaggagctgcccggcgtcgtggcgatggcgtga

SEQ ID NO: 57109 - protein, 411 aa, Deinococcus radiodurans; identical to SEQ ID NO: 10423

SEQ ID NO: 57110 - DNA, 1182 bp, Desulfovibrio vulgaris; identical to SEQ ID NO: 10690
  CDS (1)..(1182): transl_table=11

SEQ ID NO: 57111 - protein, 393 aa, Desulfovibrio vulgaris; identical to SEQ ID NO: 10691

SEQ ID NO: 57112 - DNA, 1248 bp, Drosophila melanogaster
  CDS (1)..(1248)
atggccttcaataagctgagcatcgaaaacctggacttggcgggcaagcgggtgttgatgcgcgtcgacttcaatgtgcccatcaaggagggcaagatcaccagcaaccagagaattgtcgctgccttggatagtatcaagttggccctttccaagaaagccaagtcggtggtgctgatgtcccacttgggtcgtcccgatggcaacaagaacatcaagtacaccctggcacccgtggccgctgagctgaagaccctgcttggccaggatgtgatcttcctaagtgactgcgtcggcagcgaagtggaggccgcttgcaaggatcccgcaccgggatccgtcattctgctggagaacgtccgcttctacgtggaggaggagggcaagggcttggatgccagcggcggcaaggtcaaggccgatcctgccaaggtcaaggagttccgtgccagcctggccaagctgggcgatgtctatgtcaacgacgccttcggcactgcccatcgcgcccacagttccatgatgggcgatggcttcgagcagcgcgcagctggtctgttgctgaacaaggagctgaagtacttctcgcaggccctggacaagccaccaaatcccttcctggcaattctcggtggcgccaaggtggccgacaagatccagctgattgagaaccttctggacaaggtcaacgagatgatcatcggtggcggcatggccttcaccttcctgaaggtcctcaacaacatgaagatcggcggttccctgttcgacgaggagggctccaagatcgtcgagaaactggtggagaaggccaagaagaataacgtgcagttgcatctgccagtggactttgtctgcggcgacaagttcgccgagaacgctgccgtcagcgaggccaccgtggaggccggaattcccgatggacacatgggtctggatgtgggtcccaagacccgtgagctcttcgcggcacccatcgcacgcgccaagctcatcgtgtggaacggaccccccggtgtctttgagttccccaacttcgccaacggcaccaagtccatcatggacggcgtggtggccgccaccaagaacggcaccgtctccatcatcggcggcggcgacactgcctcttgctgcgccaagtggaacacggaggcactcgtctcgcacgtctccaccggaggcggcgcttcgctggagctcctggagggcaagacactgccaggcgtggctgcattgaccagcgcctaa

SEQ ID NO: 57113 - protein, 415 aa, Drosophila melanogaster
MAFNKLSIENLDLAGKRVLMRVDFNVPIKEGKITSNQRIVAALDSIKLALSKKAKSVVLMSHLGRPDGNKNIKYTLAPVAAELKTLLGQDVIFLSDCVGSEVEAACKDPAPGSVILLENVRFYVEEEGKGLDASGGKVKADPAKVKEFRASLAKLGDVYVNDAFGTAHRAHSSMMGDGFEQRAAGLLLNKELKYFSQALDKPPNPFLAILGGAKVADKIQLIENLLDKVNEMIIGGGMAFTFLKVLNNMKIGGSLFDEEGSKIVEKLVEKAKKNNVQLHLPVDFVCGDKFAENAAVSEATVEAGIPDGHMGLDVGPKTRELFAAPIARAKLIVWNGPPGVFEFPNFANGTKSIMDGVVAATKNGTVSIIGGGDTASCCAKWNTEALVSHVSTGGGASLELLEGKTLPGVAALTSA

SEQ ID NO: 57114 - DNA, 1266 bp, Emericella nidulans; identical to SEQ ID NO: 10382
  CDS (1)..(1266)

SEQ ID NO: 57115 - protein, 421 aa, Emericella nidulans; identical to SEQ ID NO: 10383

SEQ ID NO: 57116 - DNA, 1194 bp, Enterococcus faecalis; identical to SEQ ID NO: 10692
  CDS (1)..(1194): transl_table=11

SEQ ID NO: 57117 - protein, 397 aa, Enterococcus faecalis; identical to SEQ ID NO: 10693

SEQ ID NO: 57118 - DNA, 1257 bp, Euplotes crassus
  CDS (1)..(1257): transl_table=10
atgctatctaagaaattgactgttgataagatcccccacatgattaagaacaagagagtcttagtcagagtagactttaatgttccaattaaggatggaaaggttgccgatcctacaagaattgtatctactcttgatacaatcaacttcttaaaggaaaatggtgctaaatccattgtgttgatgagtcatttgggtagaccaaaaggagttagacaagaacaattctcattagctcctgttgtcccagcgcttgaagacattattggccagaaagttaactttttaaacgactgtattggtactgaagttgaaggagaagtggcaaatactaaagatggaaatatcctgcttttggagaatctcagattctacttggaagaggaaggaaaaggagtcataaatggagagaaagtcaaagctgatccaaccaaggttgagtctttcagatcccaactcactagacttggagatctttatgtaaatgatgcttttggaacttgccacagagctcattcctcaatggttggtgtcaatgtggacaccagagctgccggatttttgttaaagaaggaacttgattacttctcaaaagttttagaagatcctaaaagacctctcaccgttattcttggaggagctaaagttgcagataaaattcaactgatcaacaatttgctagacttggcagatgaaatgatcattggtggaggaatggctttcacattcaacaaagtcctgaacaataccccaatcggagcatccctctatgatgaagaaggagctaagactgttcatggcattatggaaaaggcaaaagaaaagggagtaaagattcatattccaagtgattttgtttgtgctgagagctttgcagaagatgctaaatttgcctacaaactgaagatgaaggagtcccaagatggatggttaggtctggacattggagataaaactattcgcagctttgatgaggttattagaagatctaacacccttttctggaatggaccttcaggagtttttgaatggaaaaactttgctaaaggatctcatgcaatgcttcaagctgttactgaatcaaccaagaatggaacagtttctgtatgtggaggaggagataccctcaatcttttgaagcaagtagatggagccaaagagaatatttctcatgttagtactggaggaggtgcctccttagaacttgttgaaggaaaagaacttccaggaatcaaggctttgtctgatatcaactag

SEQ ID NO: 57119 - protein, 418 aa, Euplotes crassus; identical to SEQ ID NO: 10695

SEQ ID NO: 57120 - DNA, 1197 bp, Fusobacterium nucleatum; identical to SEQ ID NO: 10696
  CDS (1)..(1197): transl_table=11

SEQ ID NO: 57121 - protein, 398 aa, Fusobacterium nucleatum; identical to SEQ ID NO: 10697

SEQ ID NO: 57122 - DNA, 1251 bp, Glomus mosseae
  CDS (1)..(1251)
atgtcactttcaaacaaattatcaatacgagacttaaacgtcaaagacaaacgagtcttaatacgagtcgacttcaacgtccccctcgatggcacaaccataaccaacaaccaacgcatcgtcgcagcccttccaacaatcaagtatgcactagaacagaaagccaaaaccgtcgtgttaatgtcacatcttggccgtcctgacggaaagaaggtcgacaagtattcacttgcgccagtggcgaaggaggtcgagagactgcttgggaagaaggtgacgtttttggaggattgcgttggggagggtgtggagaattatgtgaagaatgcctgtgatggggaggttattctcttggagaatttgaggtttcacgctgaggaggaggggagctccaaggggcctgatggcaagaaagttaaggcggatctggaaaaagttaaggagtttagaaggtctttgacggctcttggtgatgtttacatcaatgatgcttttggaaccgcacatcgagcacacagttccatggttggcgtcgaattacctcaaaaagcagccggtttcctcgtcaagaaagaattagagtactttgccaaagcgctcgaatcccccgaacgacctttcctagctattctcggcggtgcaaaggtgtccgataagatccagctcattgataacttgatcgccaaggtagatagtttgatcatttgtggtggtatggcgttcacgttcaagaagacgcttgagaacgtcaagattgggaactcgctatttgacgcggacggcgcgaagaccgttggagaggtcatggagaaggcgaagaagcatgacgttgaggtcgtcttgcctgttgactacattaccgcggataagtttgccaaggacgcgcaagttgggtatgctactgatcaagagggaattcctgatgggtggatgggattggactgcggcgagaagtctgttgagttgtataagcagactattgctaaggcgaagactatcctttggaatgggcctgctggggttttcgagtttgataactttgctaaggggacgaaggctactttggactgcgcagttgaggcagcacaatctggaaagattgtcatcatcggtggtggtgataccgcaactgttgctgcgaaatatggcgttgaggacaagctgagccatgtctcgactggcggtggagcttctttggagttgctcgaaggcaaggatcttcctggtgtctctgctctctcgagtaagtaa

SEQ ID NO: 57123 - protein, 416 aa, Glomus mosseae; identical to SEQ ID NO: 10699

SEQ ID NO: 57124 - DNA, 1224 bp, Gloeobacter violaceus; identical to SEQ ID NO: 10700
  CDS (1)..(1224)

SEQ ID NO: 57125 - protein, 407 aa, Gloeobacter violaceus; identical to SEQ ID NO: 10701

SEQ ID NO: 57126 - DNA, 1176 bp, Haemophilus ducreyi; identical to SEQ ID NO: 10702
  CDS (1)..(1176): transl_table=11

SEQ ID NO: 57127 - protein, 391 aa, Haemophilus ducreyi; identical to SEQ ID NO: 10703

SEQ ID NO: 57128 - DNA, 1197 bp, Halobacterium sp; identical to SEQ ID NO: 10424
  CDS (1)..(1197): transl_table=11

SEQ ID NO: 57129 - protein, 398 aa, Halobacterium sp; identical to SEQ ID NO: 10425

SEQ ID NO: 57130 - DNA, 1206 bp, Haloarcula vallismortis; identical to SEQ ID NO: 10478
  CDS (1)..(1206): transl_table=11

SEQ ID NO: 57131 - protein, 401 aa, Haloarcula vallismortis; identical to SEQ ID NO: 10479

SEQ ID NO: 57132 - DNA, 1209 bp, Helicobacter hepaticus; identical to SEQ ID NO: 10704
  CDS (1)..(1209): transl_table=11

SEQ ID NO: 57133 - protein, 402 aa, Helicobacter hepaticus; identical to SEQ ID NO: 10705

SEQ ID NO: 57134 - DNA, 1209 bp, Helicobacter pylori J99
  CDS (1)..(1209): transl_table=11
atgttagctaaaatgtcgtttatgcaaaacgttaaaaacattcaagaggtggatgtcaatcataaaagggtgcttattagagtggattttaacgtgcctttagatgaaaatttgaatatcactgatgacacacgcattagagagagcttgcccaccatccaattttgtattgacaataaggctaaagatattattttagtgagccatttgggccgccctaaaggggttgaagaaaaattgagcttgaagccctttttaaaacgccttgaaagactcttaaatcatgaagtggttttttctcaaaatatcgcgcaactcaagcaagccttaaacgaaaacgcgcccacaaggatttttcttttagaaaacatccgctttttaaaaggcgaagaagaaaatgatgaaaatctggctaaagatttagcgagcttgtgcgatgtgtttgtgaatgacgcttttggcacgagccacagaaaacatgccagcacttatggcaccgccaaattcgctcccataaaagtgagcgggtttttgcttaaaaaagaaattgattcgttttatcaagcgtttaaccaccctttacgccctttattgttgattgtggggggggctaaggtcagctccaaactcactttattaaaaaacattttagatctcattgacaagctcatcattgccggggcgatgagcaacaccttcttaaaagccttaggctatgatgtgcaggattcttctgtggaagacgccctaatcaatgacgccctagaattattgcaaagcgcgaaagaaaaaaaagtcaaagtctatttgcctatagacgccgtaaccactgatgacattcttaaccccaaacacatcaaaatttcacccgtccaagacattgagcctaaacacaaaatcgctgatatagggcctgcgagcctgaaattattttctgaggtcatagagagcgcgcccaccattttatggaatggccccttaggcgtgcatgaaaagcaagaattcgctagaggcacaacctttttagcccacaagatcgctaacacttacgctttctcgctcattggggggggcgacaccattgatgcgatcaatcgcgcgggcgaaaaggataacatgagctttatctctaccggtgggggggcgagcttggaactattagagggcaaaattttaccttgttttgaggttttggacaaacgccattaa

SEQ ID NO: 57135 - protein, 402 aa, Helicobacter pylori J99
MLAKMSFMQNVKNIQEVDVNHKRVLIRVDFNVPLDENLNITDDTRIRESLPTIQFCIDNKAKDIILVSHLGRPKGVEEKLSLKPFLKRLERLLNHEVVFSQNIAQLKQALNENAPTRIFLLENIRFLKGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIANTYAFSLIGGGDTIDAINRAGEKDNMSFISTGGGASLELLEGKILPCFEVLDKRH

SEQ ID NO: 57136 - DNA, 1251 bp, Kluyveromyces lactis
  CDS (1)..(1251)
atgtctttgagttcaaaattgactgtcaaggatttggatgtcactggtaaaagagtgttcatcagagttgatttcaacgtcccattggacggtaagaagatcacttccaaccaaagaattgtagcagctctgcctactattcaatacgttttggaaaagaagccaaaggccattgtcttggcctctcatttgggtagaccaaacggtgaagttaacgacaaatactcattggctccagttgccgatgaattgtctagactattgcaaaagccagttactttcttgcatgactgtgttggtgaagaagtcaccaatgccgttaacaacgctaaggacggtgaagttttcctattggaaaacttgagattccacatcgaagaagaaggttccagaaaggtggatggtaacaaggttaaggctgacaaggctgctgttaccaaattcagagaacaattgagttctttggccgatgtttacgttaacgatgccttcggtaccgctcacagagctcactcttccattgtcggtttcgacttgccaaacagagctgccggtttcttgttgtccaaggaattgcaatactttgctaaggctttggaaaacccaaccagaccattcttggctatcttgggtggtgctaaggttgcagacaagattcaattgatcgacaatttgttggacaaggtcgattctttgatcattggtggtggtatggctttcaccttcaagaaggtcttggaaaacactgaaatcggtgactccatctacgatgctgctggtgccgaattggttccaaagttggtcgaaaaggctaagaagaacaacgtcaagatcgtcttgccaactgacttcgtcattggtgacaagttctctgctgatgctaacacaaaggttgtcaccgacaaggaaggtattccaagcggctggcaagggttggacaacggtccagaatctagaaaggctttcgctgccactgttgctgaagctaagactatcgtctggaacggtccaccaggtgtcttcgaatttgctcctttcgctaagggtaccgaagctctattggacgccgttgtcgcctcctctcaagctggtaacaccgtcatcatcggtggtggtgacaccgctaccgtcgccaagaagtacggtgtcgtcgacaagatctctcacgtctccactggtggtggtgcttctttggaattgttggaaggtaaagaattgcctggtgtcactttcttgtccaacaagcaataa

SEQ ID NO: 57137 - protein, 416 aa, Kluyveromyces lactis
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNTVIIGGGDTATVAKKYGVVDKISHVSTGGGASLELLEGKELPGVTFLSNKQ

SEQ ID NO: 57138 - DNA, 1212 bp, Lactobacillus delbrueckii
  CDS (1)..(1212): transl_table=11
atggctaaattgattgtttctgacgtagacgttaaggacaagaaggttttggttcgcgttgacttcaacgtgccgattaaggacggcgttatcggcgacgacaaccgtatcgtggctgctttgccaactatcaagtacatcatcgaaaacggcggcaaggctatcttgctttcccaccttggccggatcaagagcgatgaagacaagaagagcttgagcttggctccagttgccaaacgtttgggcgaattgcttgaaaagcctgtaactttcgtaccttcaaacgaaggcaaggaagttgaagacgccatcaacaacatgaaggacggcgacgtagttgttttggaaaacacccgtttccaagacatcgacaacgacttcggcaagcgtgaatcaaagaacgaccctaagctgggcgaatactgggcatcattgggtgacgttttcgtaaacgacgccttcggtactgctcacagaagccacgcttcaaacgttggtatcgctacggccatgaaggctgccggcaagccagcagctgctggtttcctgcttgaaaaggaaatcaagttcctgggcaacgctgttgctaacccagttcacccattcgtaactattcttggcggggctaaggtttctgacaagatcggcgttatcaccaacttgattccaaaggctgaccacatcatcatcggtggtggtatggcttacaccttccttaaggctcaaggccacaatatcggcaagtccctggttgaagacgacaaggttgaatttgccaaggaattgctggaaaaggctggcgacaagctggttctgccaatcgacaacgtagccgcaactgaattcaacaacgatgctgcttcagaagttgttggccaagacatcccagacaacgaaatgggcttggacatcggtcctaagactattgaactcttcaagaagactcttgaaggtgccaagactgttgtttggaacgggccaatgggcgtcttcgaaatgccaaacttcgccaagggtactttggaagttggccgtgctttggctgacttgccagacgctactactattgtcggcggtggtgactcaactgctgctgctaagcaattggggatcgctcctaagttgactcacatctcaactggtggtggtgcatctcttgaataccttgaaggtaaggaattgccaggtatcgcttgcgtttcagacaagtag

SEQ ID NO: 57139 - protein, 403 aa, Lactobacillus delbrueckii
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPAAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDNVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 57140 - DNA, 1197 bp, Lactococcus lactis; identical to SEQ ID NO: 10436
  CDS (1)..(1197): transl_table=11

SEQ ID NO: 57141 - protein, 398 aa, Lactococcus lactis; identical to SEQ ID NO: 10437

SEQ ID NO: 57142 - DNA, 1203 bp, Lactobacillus plantarum
  CDS (1)..(1203): transl_table=11
ttggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtccctgttactgaaggcgaacaacttgaaactgccatcaacaacatgaacgacggtgacgtcttagttgttgaaaacactcgttttgaagacgttgttaacggcgaacaagttaagcgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataa

SEQ ID NO: 57143 - protein, 400 aa, Lactobacillus plantarum; identical to SEQ ID NO: 10711

SEQ ID NO: 57144 - DNA, 1191 bp, Leptospira interrogans; identical to SEQ ID NO: 10712
  CDS (1)..(1191): transl_table=11

SEQ ID NO: 57145 - protein, 396 aa, Leptospira interrogans; identical to SEQ ID NO: 10713

SEQ ID NO: 57146 - DNA, 1191 bp, Leptospira interrogans
  CDS (1)..(1191): transl_table=11
atggaattacctagacttgaaaatgtagatctctcaggaaagagagttttcctgagagtagattttaacgttccagtagaaaatggaaaagttacagacaaaactagaattgaaaagactcttcctacaatcgaacttctgattaaaaaaggcgcaaggataattattgcgagtcacttaggaagacccaaaggacaagtaaatcctgaattttctttggcgccagtagttgaaactttccaaagtcttgtaaaatctaaagtttatttttctaagacagtaatcggagaagacgcgattaaactttctaaagaacttaaaaacggcgaaattttagtaattgaaaacgttcgttttcataaagaagaagaggaaaatgatcctggtttttccaaaaaactctctgcgttagccgacatctatgtgaacgacgcttttggcgcggctcacagagcgcattcctccaccgaaggaatcgcacgtctacttcctgcatatgcaggtcttctaatgcacaaagagatcttagaactttctgcgcttctgcataaaccggctcgtccatttgtggcgatcataggaggttccaaagtttccactaagatcaaggtcctaaccaatctattcgacaaggtaaatcatcttctcattggtggtggaatggcttatacgtttttaaagtccagagcgatccctattggaaattcactcgtggaaaaagaattcgaagttcaagcctttcagttaatcgaaaaagcaggcgtcgccggtatcgatttacaacttccggtagatcacatcattggagatcagtttaacgaaaaggcaaagaccaagtccgtagataagatgggaattttagacggttggatgggaatggatataggttctaaaacggtttctaactacgaaaagattattaaaaacgctggtacgattttttggaacgggcccatgggtgtttttgaaatggataaatttgcgagtgggactatggcaatcgccaaagcagtcgctaaatccaaggcaaaaacagttgtaggtggaggagattccatcgctgcaatcaacaaagctggagttgcagataaaattactcatatctcaactggcggtggagcttccctcgaatttatggaaggtagaaaacttccaggagtagaagcccttaagaaaaaaacttccgagtaa

SEQ ID NO: 57147 - protein, 396 aa, Leptospira interrogans
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLSALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKAGVADKITHISTGGGASLEFMEGRKLPGVEALKKKTSE

SEQ ID NO: 57148 - DNA, 1230 bp, Methanobacterium bryantii
  CDS (1)..(1230): transl_table=11
atgtcccttccattttataccatagatgactttaatttagaagataagactgttcttgtgagagttgatataaattcgcctgtagatccaagtacaggttctattttagatgacacaaaaataaaattacacgccgaaaccatagatgaaatttcaaagaagggtgcaaaaacagttgtgctggctcatcaaagtaggcctggaaaaaaggactttactacgctccaacagcatgcaaaagcactttcaaacattttaaatcgtcctgtggattatattgatgatattttcggcactgctgcaagggaagaaataaagagactgaaaaaaggagatattctcctccttgaaaatgtcagattttatcctgaagaaatcttaaaaagagatccccaccagcaggctgaaacacacatggttcgtaaattatatcccattatcgacatctttataaacgatgcatttgcagctgcccatagatcacaaccttcactggttggttttgcagtgaagctgccgtcaggtgcaggtagaataatggaaaaagaacttaagtcactttatggggctgttgataatgctgaaaagccttgcgtttatgtactaggcggagtgaaagtagacgactccataatggtcctggaaaacgttttaagaaatggcagtgccgattatgtacttacaacaggtcttgttgccaacattttcctgtgggcttcaggaataaatctaggaaaatataatgaagactttattataaataaaggatacattgactttgtggaaaaaggcaaacagctgcttgaagaatttgatgggcagattaagatgcctgatgatgttgcggtttgtgtagataatgcaagagtagaatactgtactaaaaatattccaaacaaaccaatatatgatattggaaccaataccatcacagagtatgctaaatttataagagatgccaaaactatatttgcaaatggacctgcaggtgtttttgagcaagaaggttttagcattggtacggaagacattctaaatacaatagcatcatctaatggatactccataattggaggaggccatttagctgctgcagctaatcaaatgggtttatcatcaggaataacccatataagtagtggtggtggagcatctataaatttacttgctggtgaaaaacttcctgttgttgaaatactcactgaagtaaaaatgaaaggtagaaaatag

SEQ ID NO: 57149 - protein, 409 aa, Methanobacterium bryantii
MSLPFYTIDDFNLEDKTVLVRVDINSPVDPSTGSILDDTKIKLHAETIDEISKKGAKTVVLAHQSRPGKKDFTTLQQHAKALSNILNRPVDYIDDIFGTAAREEIKRLKKGDILLLENVRFYPEEILKRDPHQQAETHMVRKLYPIIDIFINDAFAAAHRSQPSLVGFAVKLPSGAGRIMEKELKSLYGAVDNAEKPCVYVLGGVKVDDSIMVLENVLRNGSADYVLTTGLVANIFLWASGINLGKYNEDFIINKGYIDFVEKGKQLLEEFDGQIKMPDDVAVCVDNARVEYCTKNIPNKPIYDIGTNTITEYAKFIRDAKTIFANGPAGVFEQEGFSIGTEDILNTIASSNGYSIIGGGHLAAAANQMGLSSGITHISSGGGASINLLAGEKLPVVEILTEVKMKGRK

SEQ ID NO: 57150 - DNA, 1233 bp, Methanothermus fervidus
  CDS (1)..(1233): transl_table=11
ttgttcaaattctatacgatggatgattttgattattctgggagcagagtgcttgtaagagtagacattaattctccagtagatcctcatactggacgtatacttgatgatacgagaatgagactacattcaaaaacactcaaagaactagtagatgaaaatgcaaaggtagctattttagcacatcaaagtaggccaggaaaaagagatttcacaacaatggaagagcatagtaaagtattatccaatatattagatatgcctgttacatatgttgaggatatatttggttgtgctgcacgagaatcaataagaaatatggaaaatggagatatcatccttttagaaaatgtacgtttttattcagaagaagttttaaaaagagatcccaaagttcaggcagaaacacaccttgtaagaaaattatcaagtgttgttgattattatataaatgatgcttttgcagctgctcatagatcacaaccatcattagttggatttccgcttaaactaccttctgctgcaggaagattaatggaaagagaagttaaaacattgtataaaataattaaaaacgttgaaaagccatgtgtttatattcttggaggtgttaaaattgatgattcaataatgataatgaaaaatattttaaaaaatggttctgctgattatattctaacatctggtttggtggcaaatgtatttttagaggcttctgggatagatattaaagaaaagaacagaaaaatattgtatagaaaaaattataaaaaatttataaaaatggcaaaaaaacttaaagataaatatggggagaagatacttacccctgttgatgttgccataaataaaaatggaaagagaattgatgtacctattgatgatattcctaactttccaatatatgatataggcatggaaactataaaaatatatgcagaaaaaataagagaggcaaaaacaatttttgctaatggaccagcgggtgttttcgaagaacaacaatttagtataggaactgaagatttgttaaatgcaatagcatcatccaacgcattttcagttatagcaggaggtcatttagcagcggctgcagaaaaaatgggtatttcaaataaaataaatcatattagtagtggaggcggggcttgtatagcatttctttctggcgaagagctccctgcaattaaagttcttgaagaagctagaaaaaggagcgataaatatatatag

SEQ ID NO: 57151 - protein, 410 aa, Methanothermus fervidus
MFKFYTMDDFDYSGSRVLVRVDINSPVDPHTGRILDDTRMRLHSKTLKELVDENAKVAILAHQSRPGKRDFTTMEEHSKVLSNILDMPVTYVEDIFGCAARESIRNMENGDIILLENVRFYSEEVLKRDPKVQAETHLVRKLSSVVDYYINDAFAAAHRSQPSLVGFPLKLPSAAGRLMEREVKTLYKIIKNVEKPCVYILGGVKIDDSIMIMKNILKNGSADYILTSGLVANVFLEASGIDIKEKNRKILYRKNYKKFIKMAKKLKDKYGEKILTPVDVAINKNGKRIDVPIDDIPNFPIYDIGMETIKIYAEKIREAKTIFANGPAGVFEEQQFSIGTEDLLNAIASSNAFSVIAGGHLAAAAEKMGISNKINHISSGGGACIAFLSGEELPAIKVLEEARKRSDKYI

SEQ ID NO: 57152 - DNA, 1254 bp, Methanococcus jannaschii; identical to SEQ ID NO: 10386
  CDS (1)..(1254): transl_table=11

SEQ ID NO: 57153 - protein, 417 aa, Methanococcus jannaschii; identical to SEQ ID NO: 10387

SEQ ID NO: 57154 - DNA, 1221 bp, Methanopyrus kandleri; identical to SEQ ID NO: 10714
  CDS (1)..(1221): transl_table=11

SEQ ID NO: 57155 - protein, 406 aa, Methanopyrus kandleri; identical to SEQ ID NO: 10715

SEQ ID NO: 57156 - DNA, 1251 bp, Methanosarcina mazei
  CDS (1)..(1251): transl_table=11
gtgctgagggtaatgacttccagaaactttcttacgatcgatgattttgacatacgcggaaagacgattcttttaagggtcgacatgaactctcctatggacactcagggtcacattctggacgatatgaggatcaggagtcatattgccactcttaaagaccttgagagtgcaaaagtcgttgtgcttgcgcaccagagccggcctgggaaaaaagacttcaccactatgaaacctcatgctcacctgctgtccaggtatctgggcaggcaagttacttatgtggacgacatcttcgggacttttgcgaagactcagatcgcttctatggaagacggggacgtcatcatgctcgaaaacgtcaggttctattctgaagagagcctcgagaggactacagccgagcaggccaatacttttatggttaaaaaactggcaccctttgttgatattttccttaatgacgcgtttgcggtatctcacaggtctcatctctctgttgtaggctttaccgaagtcctcccttccggagcaggcagggtaatggaaaaagaacttatttccctggaaaaaggagttaaaagtggagagaggccaagcgttttcgtgctggggggggcaaaagtggacgactcacttagagtaaccgaaaatgtcctcacaaacgggggagctgacagagtcctccttacaggggtagttgcaaacgttgcccttgccgcttccggagtaaatataggaaaagccaatctggatttcattaaatcccagggctacgaagaccagatagaaagggcgagaggtttgcttgcgaagttcgaagataaaatcggacttccgaaagacgttgctttaaatgataacaaaaagcgtgttgaagctcctatttccgaacttaattccgattctctgcccattaacgatataggtcttgaaaccattgtggactacaccaatgaaatccagaatgccaaaacagttgtcctgaacggccctgccggggtttcagagattgaggactttgccctcggaacccatgaaattataaaagctgctattaaatccgatttctctatcattggcggcgggcatatctctgtggaagttgcacacctcgggcttgaacaccgcttttcacacataagcactggaggaggagcctgtattgatttccttgcaggggaaaagctgccaggcgtcgaagctctcaaggctgcttacaataagtatcaggaagctaaaaagctttaa

SEQ ID NO: 57157 - protein, 416 aa, Methanosarcina mazei; identical to SEQ ID NO: 10717

SEQ ID NO: 57158 - DNA, 1236 bp, Methanobacterium thermoautotrophicum
  CDS (1)..(1236): transl_table=11
ttgatggtgatcccggtgtcctttaaatttaaaaccatggatgacattgaagtcacaggaaagacagtccttgtccgcgtggacataaattcgcctgtggaccccaatgatgggacaatactcgatgatacaaggatgaggctccatgcagagaccataagggaactctcagataggggtgccaggacagttgtgatggcccaccagagcagacccgggaagaatgacttcacaacactggagcagcatgccagggcgctctccgggatactcaggaggcccgttaagtacgttgaggatatattcggatccgctgcaagggagaacatctcaggactgggtgatggtgagataatcctccttgagaacgtccgcttctactccgaggaggtgctcaagcgagaccctgaggaacaggcggagacacaccttgttaggaagctggcgcccctcctggactacttcatcaacgacgccttcgcggcagcccacaggtcccagccctcccttgttggcttcgccctgagggtaccgtcagctgcgggtcgtgtgatggagagggaacttcgaacacttcagggtgcccttgagaatgttgaaaggccctgtgtctatgttctcggcggggtgaaggttgatgactccatcatggtcatgaagaacgtccttgaaaacggtagcgcagaccttgtactgacaacgggccttgttgccaacatattcctggcgggatgcggggttaagatcggtaaggtgaacatggacttcatcaagagcaggggatactgtgacttcatcaaggtggcgaagaaactgaagaagcgcttccctgaaaggatagttgtacccgttgatgttgcagtatgcagggacggcaagagggttgatgttcctgtgaaaaagatacccaaccatccgatacaggatatcggaatggaaaccataaagctctacgccaggaggatacgtgaggcaaggaccctctttgccaatggaccggcaggcgtatttgagaaccctgatttcagcataggaaccgaggacatactgaatgcaatatcctcttcagaaggtttctcaataatcggcgggggtcaccttgctgctgcagcagtgaagatgggctttgaggacagcataaaccatatcagcagtggaggcggtgccagcataagcctccttgcaggtgaggagcttcccgcagtcagggtgcttgaggaatccaggcacccataa

SEQ ID NO: 57159 - protein, 411 aa, Methanobacterium thermoautotrophicum; identical to SEQ ID NO: 10409

SEQ ID NO: 57160 - DNA, 1242 bp, Mycoplasma gallisepticum; identical to SEQ ID NO: 10720
  CDS (1)..(1242): transl_table=4

SEQ ID NO: 57161 - protein, 413 aa, Mycoplasma gallisepticum; identical to SEQ ID NO: 10721

SEQ ID NO: 57162 - DNA, 1251 bp, Mycoplasma genitalium
  CDS (1)..(1251): transl_table=4
gtgctaagctctaatatgcttaatttcaaaacactccaagcaattgattttcaaaacaaaaccgttgttttaagaagtgattttaatgtcccaatgatcaatggggttattagtgatagtgaaagaattttagctggtttggatactattaagttcttagttaaaaagaactgcaagatagtgctactatcacacctttcaaggattaagagtttagaagataaactaaacaacaaaaaatctttaaagccggttgctgaattactccaacaactcttaccaactgtaaaggttcaattttcttgtaaaaacactggtgctgaagttaaacaaaaagtgcaagcattagcattcggtgaaatccttctccttgaaaacactcgctattgtgatgtaaacgataaaggagaaattgttaaattagaaagtaaaaatgatcctgaactagcgaaattctgggctagtttaggggaaatttttgttaatgatgcatttggtactgcccatagaaaacatgcttctaatgcaggaattgcaaagtatgttgcaaaatcctgtattgggtttttaatggaaaaagaactaaagaacctctcttacctaattcaaagcccacaaaaaccctttgttgttgttttgggtggtgcgaaagtatcagataaactaaaggtagttgaaaacttactaaaacttgctgataatatcttaattggcggagggatggtaaatacctttcttaaagcaaaaggcaaagctactgctaattccctagttgaaaaagagttaattgatgttgctaagcaaatcttggataaagatactcataataagattgtgctggcaattgatcaggtaatgggttctgaatttaaagatcaaactggcattactttagatgttagtgacaaaattcaagaacaatatcaatcctatatgtctctagatgttggatctaaaacaattgctttatttgaaagttatttaaaaacagccaaaactatcttttgaaacggtccccttggagtttttgaatttactaactttgctaaaggaacttcaaaaatcggtgagattattgctaaaaataaaactgcttttagcgttattggtggtggggattcagctgcagcagttaagcaaatgcaactatctgatcagtttagttttatctccactggtggtggtgcttctttagcactaattggtggggaagagttagtaggtattagcgatattcaaaaaaattcttaa

SEQ ID NO: 57163 - protein, 416 aa, Mycoplasma genitalium
MLSSNMLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 57164 - DNA, 1215 bp, Mycoplasma hyopneumoniae; identical to SEQ ID NO: 10722
  CDS (1)..(1215): transl_table=4

SEQ ID NO: 57165 - protein, 404 aa, Mycoplasma hyopneumoniae; identical to SEQ ID NO: 10723

SEQ ID NO: 57166 - DNA, 1251 bp, Mycobacterium leprae
  CDS (1)..(1251): transl_table=11
gtgcgcattcctaatcttaaagatcttcttgaggaaggtgtttctggtcgctgcgtgttggtgcgctgcgatctgaacgtcccgctgggggatgatggcgccatcaccgacctcggtcgggtcaccgcgtcggtgcctacgttgaaagcgctgcttgaggccggagccaagattgtggttgccgcccatctgggccgccccaagaacgggccagacccaaagctgtcactggagccggtcgccgcggcgctcggtgagcagctgggccaaaacgtccagttggtctgcagcaccgatcgttcccctgtcgggggtgatgcgctcgcctgtgttgagaggctgaccgacggcgacctcctactgctgcagaacatccgcttcgatccgcgcgagaccagcaaagtcgacgacgaacgactcgctctggccaagcaattggttgaattggtcgggtcagcaggagcttttgtttcggatggattcggtgtggtgcatcgcaggcaggcttcggtgtatgacgtcgctacgctattgccgcactacgccggcatactggttgctgacgagataaggatactcgagcaattgactagttcggccaaacgcccctacgcagtggtgctcggcgggtcgaaggtatccgacaagctcggcgtcatcgagtcgctggcgacaaaagccgatagcatcgtactcggaggtggaatgtgctttacatttcttgctgcacaaggattttcagtaggtaaatcgttattggaaaccgagatgatcgagacctgtcgtagtctgttggacacctacgctgacgtgcttcggcttcctatggacattgtggtgacagagaagttcgtcgctgattcgccgccgcagaccgtcgccgccgacgctatcccagatggattgatgggactggatatcgggccggaatcggtcaagcggttcgctacgttgttatccaacgcctcgaccattttctggaacggaccgatgggcgtgttcgaattccctgcgtacgccgcgggcaccagaggtgttgctgaagcaatcgtggctgttactggcaagggagctttcagcgtggtcggcggcggtgactctgcggctgcgatgcgggcgctcagcctacccgaaggcagtgtctcgcacctttccaccggtggcggcgcgtcgttggaataccttgagggcaagacgctacccgggatcgaggtactaggtcgtgagcagccaaggggaggagactcgtga

SEQ ID NO: 57167 - protein, 416 aa, Mycobacterium leprae; identical to SEQ ID NO: 10483

SEQ ID NO: 57168 - DNA, 1215 bp, Mycoplasma mycoides; identical to SEQ ID NO: 10724
  CDS (1)..(1215): transl_table=4

SEQ ID NO: 57169 - protein, 404 aa, Mycoplasma mycoides; identical to SEQ ID NO: 10725

SEQ ID NO: 57170 - DNA, 1230 bp, Mycoplasma pneumoniae; identical to SEQ ID NO: 10484
  CDS (1)..(1230): transl_table=4

SEQ ID NO: 57171 - protein, 409 aa, Mycoplasma pneumoniae
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQFWASLGDIFVNDAFGTAHRRHASNAGIAKYIKNSCIGLLMERELINLYRLINNPPKPFVVVLGGAKVSDKLQVVNNLFKIADHILIGGGMVNTFLKALGNEVGTSLVEEDLVQTAKQILDSDKDKKIVLGVDQMLHASFKDEPGVECVVAPQWPAELQGFMSLDVGSKTVALFSSYLAKAKTIFWNGPMGVFEFSNYAQGTLAIGKAIAQNQQAFSVIGGGDSAAAAKQLQIADQFSFISTGGGASLALIGGEELVGISDIQKK

SEQ ID NO: 57172 - DNA, 2316 bp, Mycoplasma pulmonis; identical to SEQ ID NO: 10440
  CDS (1)..(2316): transl_table=4

SEQ ID NO: 57173 - protein, 771 aa, Mycoplasma pulmonis; identical to SEQ ID NO: 10441

SEQ ID NO: 57174 - DNA, 1179 bp, Neisseria meningitidis
  CDS (1)..(1179): transl_table=11
atggcatttttaaaactgaccgaacaaaacgtgcagggcaaaaccgtcctcatccgcgccgatatgaacgtgccgttcaaagacggcaaaatcagcgacgacacccgtatccgcgcctcgattgcgtccgttaaatactgcgtggacaacggcgcgtccgtcattgtgatgacccacttgggccgcccgaccgaaggcgaattccatcccgaagacgacgttgcgcccgttgccgcacacttgggcagcctgttgggcaaagacgtgaaagtattgaacgactggcgcgaaaacaaaccggctttgaacgcgggcgatgtcgtgatgctgcaaaacgtgcgtatcaacaaaggcgagaagaaaaacgatttggaactgggcaaagcctacgcttctttgtgcgacgtgttcgtcaatgacgcgttcggcaccgcgcaccgcgcccaagcctcgaccgaagccgtcgctcaagccgcgcccgttgcctgcgccggcgtattgatggcgggcgaactcgacgctttgggcaaagccctgaaacagcctgcacgcccgatggttgccatcgttgccggcagcaaagtgtccaccaagttgaccattctcgaatcgctggcggacaaagtcgaccaactcatcgtcggcggcggcatcgccaacaccttcctgttggcagaaggcaaagccatcggcaaatctttggcggaacacgatttggtggaagaatccaaaaaaattatggcgaaaatggcggctaaaggcggctccgtaccgctgccgaccgatgtcgtcgttgccaaagcctttgccgccgatgccgaagcggtcgtgaaagacattgccgacgttgccgaagacgatatgattttggacatcggcccgaaatccgccgccgcgcttgccgatttgcttaaagccgccgacacggtcgtttggaacgggccggtcggcgtgttcgagtttgaccaattcgcaggcggtacgaaagcccttgccgaagccattgcccaaagcaaagcgttctcgattgcgggcggcggcgacacgctggcagcgattgccaaattcggcgttaccgaacaaatcggctacatctccaccggaggcggcgcgttccttgagttcttggaaggcaaagagctgcctgccgtagctgctttggaaaaacgcggcgcgtaa

SEQ ID NO: 57175 - protein, 392 aa, Neisseria meningitidis
MAFLKLTEQNVQGKTVLIRADMNVPFKDGKISDDTRIRASIASVKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDDMILDIGPKSAAALADLLKAADTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 57176 - DNA, 1257 bp, Neurospora crassa
  CDS (1)..(1257)
atgtctctctccaacaagctctccatcgaggacgtcgacctcaagggcaagcgcgtcctcatccgtgtcgacttcaacgtcccccttgacgccgagaagaaggtcaccaacccccagcgcatcgccggtgccattcccaccatcaagtatgcgctcgaccatggcgccaaggccgttgtcctcatgtctcaccttggccgtcccgacggcaagcccaaccccaagtactccctgaagcccgttgttcctgagctcgagaagctcctcggcaagaaggtcaccttcgcccccgactgcgttggtcccgaggttgaggagatcgtcaacaaggccgacaacggtgaagttattctccttgagaacctccgcttccacattgaggaggagggcaagggcaccgatgccgagggcaacaaggtcaaggccgacaaggccaaggttgaggagttccgcaagaacctcaccaagctcggtgatgtgtacatcaacgatgctttcggcactgcccaccgcgcccactcctccatggtcggcattgacctccccgtcaaggccgccggtttcctcatgaagaaggagctccagtactttgccaaggttctcgagtcgccccagcgccccttcctctccatcctcggcggtgccaaggtttccgacaagatccagctgatcgacaacctgctcgacaaggtcaacaccctcatcgtctgcggtggtatggccttcaccttcaagaagaccctccagaacatgcccatcggcaactcgctcttcgatgaggccggcgccaagattgtccctgaccttgtcaagaaggccgagaagaacaacgtcaagctcgtgctccccgtcgacttcaccattgccgacaagttcgacaaggacgccaacactggctacgccacagacaaggacggcattcccgacggctggatgggtctcgactgcggcgaggagtcggtcaagctcttcacccaggccatcaacgagtcccagaccatcctctggaacggccccgccggtgtcttcgagttcgacaagttcgccaagggcaccaaggccaccctcgacgcttgcgtcaaggctgccgaggaaggccgcaccgtcatcattggcggtggtgacaccgctaccgtcgctgccaagtacggcgttgaggacaagctcagccacgtctccactggcggtggtgcttctcttgagctccttgagggcaaggctctccctggtgttgttgctcttagcgagcgtcagtaa

SEQ ID NO: 57177 - protein, 418 aa, Neurospora crassa
MSLSNKLSIEDVDLKGKRVLIRVDFNVPLDAEKKVTNPQRIAGAIPTIKYALDHGAKAVVLMSHLGRPDGKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 57178 - DNA, 1179 bp, Nitrosomonas europaea
  CDS (1)..(1179): transl_table=11
gtgtccgttattaaacttgtcgatcttgatctgaagaacaaacgcgtctttatccgcgctgatttgaatgttcctgtaaaagacgggaaagtgacatcagatgcgcgcattactgcctcgatggcaacgatcaaccactgcctgaaacaaggcgcaaaagtcatggtgacctctcatcttggacggccggaagaaggggtatggacagaagaaaattctctccagccggttgccgatgatattgcccggagactgggaaagcctgtccggttgatcaaagactgggtagagggtggatttgaagttgcatctggagagttggtagtcctggaaaattgtcggatcaataaaggtgaaaaaaagaacctcgaagaaaccgccaagaaatatgccagtttgtgtgatgtattcgtcatggatgcttttggtacagcacaccgtgcagaagcttcgacacatggtatcgccaaatatgcaccgattgcctgtgcaggtattttgcttaccgaagaactcgatgcgctgacaaaagccctgcatcagccagcacatccgctggtggcaatcgtaggcggatcaaaagtttccaccaaactgaccgtgctggaatcgcttgctgaaaaagttgatcagctcgtagtcggcgggggaattgccaacacttttctcaaggccgcagggaacaacattggaaaatccctgtgcgaggatgaactggtacccgttgcaaaatccctgatggataaaatgaacaagcgtaatgcaacgattcccatcgcagtagatgtcgtcgtcggaaagaaattcgctgaagatgaagctgctgttctaaaagcagccaacgctgtttctgatgacgacatgatctttgatatcgggcctgagagtgctcaagaattggtcgacatcatcatgaaagccggtacggtagtctggaatggcccggtcggtgtattcgaattcgatcaatttggagaaggaacacgcgccatagccaaggcaattgctgaaacggatgccttcaccctggcggggggcggtgacacaatcgctgccatccaaaagtacgacatctacgataaagtttcctatatatccactgccggaggagcattcctggagtttctggaagggaagaaattacctgctgtcgagattctggaattacgtgcgaagtga

SEQ ID NO: 57179 - protein, 392 aa, Nitrosomonas europaea; identical to SEQ ID NO: 10729

SEQ ID NO: 57180 - DNA, 1182 bp, Oceanobacillus iheyensis; identical to SEQ ID NO: 10730
  CDS (1)..(1182)

SEQ ID NO: 57181 - protein, 393 aa, Oceanobacillus iheyensis; identical to SEQ ID NO: 10731

SEQ ID NO: 57182 - DNA, 1197 bp, Onion yellows phytoplasma; identical to SEQ ID NO: 10732
  CDS (1)..(1197): transl_table=11

SEQ ID NO: 57183 - protein, 398 aa, Onion yellows phytoplasma; identical to SEQ ID NO: 10733

SEQ ID NO: 57184 - DNA, 1248 bp, Opisthorchis sinensis
  CDS (1)..(1248)
atggggcttcgcaaattgagcatagccaatgttgacctcaaagataagcgggtgcttatgcgagttgattttaatgttccaatgaaagatggcaaggtgacaaacacccaaagaattgttggggcatcaccaaccatcaagtatgcacttgataagggggccaaaagtatcgtcctaatgtcccatcttggaggtcgggtcggtaacaaagtcgccagatattccctcaacccggtgggagaagaagtgtccaaactccttgggaaaccagtgaaattcttacctgattgtgtcggcccagaaacaacagaaggcatgtgccaatcctctgcaggatccgtgttcctgttagaaaatctacgtttccatgttgaggaggaagggaaaggcgtttcccccactggagaaaagatcaaagccactccagagcaagtcaaggccttcagtgaaaacttgaccaagttgggtgacgtttacctaaacgacgcatttggtacagctcacagagctcacgcttccatggttggctgcagacttacgcaaagggcatgtgggtttctcatggacaaggaattgacctacttctccaagctgttggatcagcctcagcatcctttcttggcgatcattggtggagctaaagtcagtgacaaaattcaactgatcaagaacatgttggacaaagtggacgaactgattataacaggaggcatggctttcactttcctcaagaaactccacaatatgaagattggaaagagtctttacgatgaacccggggctgcaattgtcgacgaatggatgcagttggccaaatccaagaacgttaagattcatctacctgttgatttcataaccggggacaagtttgcggaggatgccaatactggcactgccacagtcgagcctggcatccgggacacgcatatgggcttggatggtggtccgaaaaccatggaagagttctgcaaggtaattagtcgagcaaaaaccattgtttggaacggtccaatgggtgtgttcgaaatggagaagtttgctggcggtacgaaggcagcaatggatgcagtggtggctgctacaaccaagggagttacgaacaataatggtggtggtgacacagctacctgctgtccaaaatggaaaacagaggcacaggtcagtcacgtgagtactggagtaggggctagcttggagctgcttgaaggcaagcaactaccaggtattctcgccctgagtgacgcataa

SEQ ID NO: 57185 - protein, 415 aa, Opisthorchis sinensis; identical to SEQ ID NO: 10735

SEQ ID NO: 57186 - DNA, 1260 bp, Oxytricha nova; identical to SEQ ID NO: 10736
  CDS (1)..(1260): transl_table=6

SEQ ID NO: 57187 - protein, 419 aa, Oxytricha nova; identical to SEQ ID NO: 10737

SEQ ID NO: 57188 - DNA, 1164 bp, Pasteurella multocida; identical to SEQ ID NO: 10738
  CDS (1)..(1164): transl_table=11

SEQ ID NO: 57189 - protein, 387 aa, Pasteurella multocida; identical to SEQ ID NO: 10739

SEQ ID NO: 57190 - DNA, 1248 bp, Penicillium chrysogenum; identical to SEQ ID NO: 10502
  CDS (1)..(1248)

SEQ ID NO: 57191 - protein, 415 aa, Penicillium chrysogenum; identical to SEQ ID NO: 10503

SEQ ID NO: 57192 - DNA, 1254 bp, Penicillium citrinum; identical to SEQ ID NO: 10474
  CDS (1)..(1254)

SEQ ID NO: 57193 - protein, 417 aa, Penicillium citrinum; identical to SEQ ID NO: 10475

SEQ ID NO: 57194 - DNA, 1164 bp, Photorhabdus luminescens; identical to SEQ ID NO: 10740
  CDS (1)..(1164): transl_table=11

SEQ ID NO: 57195 - protein, 387 aa, Photorhabdus luminescens; identical to SEQ ID NO: 10741

SEQ ID NO: 57196 - DNA, 1179 bp, Photobacterium profundum
  CDS (1)..(1179): transl_table=11
ttgagaggacgaacaatgtctgtaatcaagatgactgatctggaacttgctggtaagcgcgtatttattcgtgcagatctaaacgtaccagttaaagacggtaaagtaacttctgatgcacgtatccttgcatctctaccaactattaagcgttgcttagaagctggcgctaaagtaatggttacttctcaccttggtcgtccaacggaaggcgagtacaacgaagagttctctctggctccagtagttaactacttaaatgacgcactagattgtgacgttaaactagcgaaagattacctagatggaattgaattaaacgctggtgagctagttgttcttgaaaacgttcgctttaacaaaggcgaaaagaagaacgatgaagcactttctaagaagtatgcagcattatgtgacatcttcgtgatggacgcatttggtacggctcaccgtgcacaagcatcgactcacggtgttggcatgaacgcagctatcgcgtgtgctggtcctctactcgctaacgagcttgaagcacttggtaaagcaatggacaaccctgctcgtccacttgttgcaatcgttggtggttctaaagtatcaactaagctgactgttcttgagtcgctatctaaaattgctgaccaactagttgttggtggtggtatcgcgaacacattcatcgcagctgaaggccacaatgttggtaaatcactgtacgaagcagatttagttgaaacagctaagaaactaatgaaagactgtgcgattcctgttgcaactgacgttgcatgtgcaaaagcattcgatgagaacgcagaagcggtaatcaagcacgtgtctgaagttcaagacgacgacatgatcttcgacctaggtccagattcaactgccgttcttgctgaaatcattagcaatgcaaagacgattctttggaatggccctgttggcgtatttgaattcaaaaactttgaagcgggtactgctggtattgctaaagcaattgcagattctgaaggtttctctgttgcaggcggcggtgacacattagcagctatcgataaattcggtatcaaggctgacgtttcttacatttctactggcggcggcgcgttccttgagttcgttgaaggtaaagtattacctgcagttgctatgctagaagagcgtgcaaaagcataa

SEQ ID NO: 57197 - protein, 392 aa, Photobacterium profundum; identical to SEQ ID NO: 10745

SEQ ID NO: 57198 - DNA, 1251 bp, Pichia pastoris; identical to SEQ ID NO: 10576
  CDS (1)..(1251)

SEQ ID NO: 57199 - protein, 416 aa, Pichia pastoris; identical to SEQ ID NO: 10577

SEQ ID NO: 57200 - DNA, 1251 bp, Plasmodium falciparum
  CDS (1)..(1251)
atgttaggcaacaaattaagcattagtgacctaaaggatattaagaacaagaaggttttagtaagagttgattttaatgtacctattgaaaatggaataattaaagatacgaacagaattactgctacattacccacaattaaccatttaaagaaagaaggagcttcaaaaattatattaatatcccattgtggtagaccagatggtttaagaaatgagaaatataccttaaagccagtagctgaaactttaaaaggattattaggagaagaagtattatttttaaatgattgtgtaggtaaagaagttgaagataaaataaatgctgctaaagaaaattcagtaattctcttagaaaatttaagatttcatattgaagaagaaggtaaaggtgttgatgctaatggaaacaaagtaaaagcaaataaagaagatgttgagaagttccaaaatgatttaacaaaattagctgatgtttttattaatgatgctttcggtactgctcatcgtgctcatagtagtatggtaggtgttaaattaaatgttaaagcttcaggattcttaatgaaaaaagaattagaatattttagtaaagccttagaaaacccacaaagaccactactagccattttaggtggtgctaaagtatcagataaaattcagttaatcaaaaatttattagataaagttgatcgtatgattattggaggtggtatggcttatacttttaaaaaagtcttaaacaatatgaaaattggtacctctctttttgatgaagcaggtagtaaaattgttggagaaattatggaaaaggcaaaagctaaaaatgttcaaatatttttacctgtagattttaaaattgcagataattttgataataatgctaataccaaattcgttactgatgaagaaggtatcccagataattggatgggtcttgatgctggtccaaaaagtattgaaaattataaagatgttattttaacatcaaaaactgttatttggaacggaccacaaggtgttttcgaaatgccaaactttgcaaaaggtagtatcgaatgtctcaatttagttgttgaagttaccaaaaaaggagctatcaccattgttggaggtggagatacagcttcattagttgaacaacaaaataagaaaaacgaaattagtcatgtatctacaggtggaggagcctcacttgaacttttagaaggaaaagaattaccaggtgtattagcactttcaaacaaataa

SEQ ID NO: 57201 - protein, 416 aa, Plasmodium falciparum; identical to SEQ ID NO: 10463

SEQ ID NO: 57202 - DNA, 1257 bp, Porphyromonas gingivalis; identical to SEQ ID NO: 10746
  CDS (1)..(1257): transl_table=11

SEQ ID NO: 57203 - protein, 418 aa, Porphyromonas gingivalis; identical to SEQ ID NO: 10747

SEQ ID NO: 57204 - DNA, 1206 bp, Prochlorococcus marinus; identical to SEQ ID NO: 10750
  CDS (1)..(1206): transl_table=11

SEQ ID NO: 57205 - protein, 401 aa, Prochlorococcus marinus; identical to SEQ ID NO: 10751

SEQ ID NO: 57206 - DNA, 1164 bp, Pseudomonas aeruginosa
  CDS (1)..(1164): transl_table=11
atgaccgtgttgaagatgactgacctcgacctcaaaggtaagcgcgtgctgatccgcgaggacctcaacgtgcccgtgaaggacggccaggtgcagagcgatgcacggatcaaggccgccctgccgaccctcaagctggccctggagaagggcgcggcggtgatggtctgctcgcacctgggccgtccgaccgagggcgagttctccgccgagaacagcctgaagccggtggccgagtacctgtccaaggccctgggccgcgaagtgccgctgctggccgactacctcgacggcgtcgaggtcaaggcgggcgacctggtgctgttcgagaacgtgcgcttcaacaagggcgagaagaagaacgccgacgagctggcgcagaagtacgccgcgctgtgcgacgtgttcgtgatggatgccttcggtaccgcccaccgcgccgaggggtcgacccacggcgtggccaggttcgccaaggtcgccgccgccggcccgctgctggccgccgaactggacgcgctgggcaaggcgctgggcaacccggcgcggccgatggcggcgatcgtcgccggctccaaggtttccaccaagctcgacgtgctgaacagcctggccggcatctgcgaccaactgatcgtcggcggcggcatcgccaacaccttcctcgccgcggccggacacaaggtcggcaagtcactgtacgaggccgacctggtcgagaccgccaaggccatcgccgccaaggtcaaggtgccgctgccggtggacgtggtggtggccaaggaattcgccgagagcgccgtggcgaccgtcaaggccatcgccgaggtcgccgacgacgacatgatcctcgacatcggcccgcagaccgccgcgcagttcgccgagctgctgaagacctcgaagaccatcctgtggaacggtccggtcggggtgttcgagttcgaccagttcggcgagggcacccgtaccctggccaatgccatcgccgatagcgcggcgttctccatcgccggcggcggcgataccctggcggcgatcgacaagtacggcatcgccgagcggatctcctatatttccaccggtggcggcgcgttcctcgagttcgtcgagggcaaggtcctgccggccgtggaaatcctggagcagcgcgccaagggctga

SEQ ID NO: 57207 - protein, 387 aa, Pseudomonas aeruginosa
MTVLKMTDLDLKGKRVLIREDLNVPVKDGQVQSDARIKAALPTLKLALEKGAAVMVCSHLGRPTEGEFSAENSLKPVAEYLSKALGREVPLLADYLDGVEVKAGDLVLFENVRFNKGEKKNADELAQKYAALCDVFVMDAFGTAHRAEGSTHGVARFAKVAAAGPLLAAELDALGKALGNPARPMAAIVAGSKVSTKLDVLNSLAGICDQLIVGGGIANTFLAAAGHKVGKSLYEADLVETAKAIAAKVKVPLPVDVVVAKEFAESAVATVKAIAEVADDDMILDIGPQTAAQFAELLKTSKTILWNGPVGVFEFDQFGEGTRTLANAIADSAAFSIAGGGDTLAAIDKYGIAERISYISTGGGAFLEFVEGKVLPAVEILEQRAKG

SEQ ID NO: 57208 - DNA, 1164 bp, Pseudomonas putida; identical to SEQ ID NO: 10754
  CDS (1)..(1164): transl_table=11

SEQ ID NO: 57209 - protein, 387 aa, Pseudomonas putida; identical to SEQ ID NO: 10755

SEQ ID NO: 57210 - DNA, 1227 bp, Pyrobaculum aerophilum; identical to SEQ ID NO: 10758
  CDS (1)..(1227): transl_table=11

SEQ ID NO: 57211 - protein, 408 aa, Pyrobaculum aerophilum; identical to SEQ ID NO: 10759

SEQ ID NO: 57212 - DNA, 1233 bp, Pyrococcus furiosus
  CDS (1)..(1233): transl_table=11
atgttcaggttgagagattttgaatactacaacagaaccgtgtttcttcgagttgacttaaactcaccaatgagtaatggaaaaataataagtgacgcgagatttcgagcagtccttccaacgataaagtacctaatagagagtggagcaaaagtagttgttggcactcatcaaggaaaaccctacagcgaagagtattcgactactgaagagcatgcgagaattctctctgagctcctaaatatgcatgttgaatacgttgaagacatttttggaaagtatgcaagggagagaataaaggctatgaaacctggggaagttatagtcctcgaaaacctcaggttctctgcagaagaagtaaaaaacgcaactattgaggaatgcgaaaagacgttttttgttaggaagctctcccaggtaatagacctcgttgttaacgatgcctttgctgccgctcatagaagtcagccatctctcgttggttttgcaagaataaagcctatgataatgggattccttatggaaaaagaagttgatgctttaacaaaagcttatgaaagtgaagaaaagccgagagtttatgttcttggtggtgcaaaagttgatgactcattaaaagttgccgaaaacgttcttaggaaagaaaaggctgatctcatactgacagggggattggttggccaattattcactctagctaagggctttgacctgggaagagaaaacattaaattcttagaaaagaagggaattttaaaatacgtagactgggcagaaaagattcttgacgaattttatccctacgttagaactcccgtagactttgccattgacttcaagggagaaagagtagagatagatttgctcagcgacgagaaaaggctctttgacgaatatccaatccttgacatcggttctagaacagttgaaaagtatagggagatactcttaaaggccaggataatagtagccaacggtcctatgggagtgttcgaaagggaagaatttgccgtgggaacaattggggtattcaaggccatcggagagagtccagcctttagcgtcattggtggtggtcattcaatagcaagcatatacaagtacaacataactgggataagccatatctctaccggtgggggagctatgctaacattttttgctggagaaaagttgccagttcttgaagcgctaaagattagttacgaaaagttctctaacttactttcttaa

SEQ ID NO: 57213 - protein, 410 aa, Pyrococcus furiosus; identical to SEQ ID NO: 10481

SEQ ID NO: 57214 - DNA, 1233 bp, Pyrococcus horikoshii
  CDS (1)..(1233)
atgttcaggttggaggattttaactttcacaataaaacggtattcttaagggtagacttaaactcacccatgaaggatggaaagataataagcgatgccaggtttaaagccgttttaccaactataagatacctcatcgagagtggagcaaaagttgtcattggaacgcatcaagggaaaccctacagtgaagattacactaccacagaggagcatgcgagggttctttcagagttattggatcaacacgttgaatatatcgaagacatatttggtaggtatgccagggaaaagataaaagagcttaaatcaggtgaagttgcaattttagagaatcttagattttccgccgaagaagttaagaacaaacccattgaggagtgtgaaaagactttcctcgttaaaaaactatcgaaagttattgattatgtcgttaacgatgcctttgcaactgcacacagaagtcaaccttctttagtaggtttcgcaaggataaagccaatgataatggggttcttgatggaaaaggagatagaggctttaatgagggcttattacagcaaagacagccctaaaatttatgtacttggaggcgccaaggttgaggattcgcttaaagtagttgaaaacgttctaagaagagagagagctgatctagtgctaaccggaggcttggtggccaatgtatttacgcttgctaagggatttgacttgggaaggaaaaacgtagagttcatgaagaaaaaaggcttgctagattatgtaaagcatgcagaggagatattagatgaattttatccctatataagaactcccgtagacttcgcagtagattacaaaggggaaagagtcgaaatagatctgctaagtgaaaataggggattacttcatcaatatcaaattatggatatcggtaagagaaccgcggagaagtacagggaaatattaatgaaagcaaggattatagttgctaacggaccaatgggagtctttgagagggaagaattcgcgatagggacagtagaggtgttcaaggccatagccgatagcccagcgtttagcgttttgggaggagggcattcgatagctagcatacagaaatacggtataactggaataactcatatctccacaggcggtggagcaatgctctctttcttcgctggagaggagttgcctgtcctgagagctcttcagattagttacgaaaaattcaaggaggtggtgaagtga

SEQ ID NO: 57215 - protein, 410 aa, Pyrococcus horikoshii
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVVK

SEQ ID NO: 57216 - DNA, 1260 bp, Ralstonia solanacearum
  CDS (1)..(1260): transl_table=11
gtggcatcgggtaaaatcgccgctttccgtgatttctccgctgctgccatgcccaacgtcctgcgtctgaccgatctcatctccgaaggcaagcttgccggcaagcgtgtcttcatccgcgccgatctcaacgtgccgcaagacgatgccggcaacatcaccgaagacacgcgcatccgcgcttcggtgccggccatccgcgccgcgctcgacgccggtgccgccgtgatggtcacctcgcatctgggccgtccgaccgaaggcgagttcaagccggaagattcgctggccccggtggccgtgcgcctgtccgagttgctcggctgtgaggtgaagctggtgcagaactgggtcgacggcgtggatgtcgcgcccggccaggtggtgctgctggaaaactgccgcgtcaacaagggcgagaagaagaacagcgacgaactggcccagaagatggccaagctgtgcgacgtctacgtcaacgacgccttcggcaccgcccaccgcgccgaggccaccacgcacggcatcgccaagtttgcccccatcgcctgcgccggcccgctgctgggcgccgagctggacgcgctgggcaaggcgctgggccaaccggcccgtccgctggtcgccatcgtggccggctccaaggtgtcgaccaagctgaccatcctgaaatcgctggccgacaaggtggacaacctgatcgtcggcggcggcatcgccaacacgttcatgctggccgcgggcctgaagatcggcaagtcgctggccgaggcggatctggtgggcgatgccaaggcgatcatcgacctgatggctgcccgtggcgcctcggtgcccattcctgtcgatgtggtctgcgccaaggaattcagcgccaccgctgccgccaccgtcaaggacgtgaaggacgtggcggatgacgacatgattctcgacatcggcccgaagaccgccgcgcaactggccgaccagctcaaggcctccggcaccatcgtgtggaacggcccggtcggcgtgttcgagttcgaccagttcggcaacggcaccaaggtgctggccgaggcgatcgcggcctcgtcgggcttctcgatcgccggtggcggcgatacgctggcggcgatcgccaagtacggcatcgccgaccgcgtgggctacatctccaccggcggcggcgcattcctggaattcctggaaggcaagacgctgccggccgtggagatcctggagcagcgtgcccagcgccaggaagcgctggcctga

SEQ ID NO: 57217 - protein, 419 aa, Ralstonia solanacearum; identical to SEQ ID NO: 10761

SEQ ID NO: 57218 - DNA, 1197 bp, Rhizobium loti; identical to SEQ ID NO: 10762
  CDS (1)..(1197)

SEQ ID NO: 57219 - protein, 398 aa, Rhizobium loti; identical to SEQ ID NO: 10763

SEQ ID NO: 57220 - DNA, 1200 bp, Rhizobium meliloti; identical to SEQ ID NO: 10764
  CDS (1)..(1200): transl_table=11

SEQ ID NO: 57221 - protein, 399 aa, Rhizobium meliloti; identical to SEQ ID NO: 10765

SEQ ID NO: 57222 - DNA, 1194 bp, Rhodopirellula baltica; identical to SEQ ID NO: 10766
  CDS (1)..(1194): transl_table=11

SEQ ID NO: 57223 - protein, 397 aa, Rhodopirellula baltica; identical to SEQ ID NO: 10767

SEQ ID NO: 57224 - DNA, 1197 bp, Rhodopseudomonas palustris; identical to SEQ ID NO: 10768
  CDS (1)..(1197): transl_table=11

SEQ ID NO: 57225 - protein, 398 aa, Rhodopseudomonas palustris; identical to SEQ ID NO: 10769

SEQ ID NO: 57226 - DNA, 1251 bp, Schistosoma mansoni
  CDS (1)..(1251)
atgggtttgtcgaagcttagtatttcagatgttgaccttaaaggaaaacgtgttcttattcgagttgattttaacgtccctatgaaagatgggaaagtcactaacactcaaagaatagcagctgccataccaactattaaatatgctttggataagggggccaaaagtgtcgtcttaatgtcccatttaggtcggccagatgggcacaaagttgataagtattctctaaagcctgtgtgccctgaagtgtcaaagttgttaggcaaagaagttacgttcctcaatgattgtgttgggcctgacgtagttaacgcatgtgccaatcctgctcccggaagcgtttttttgctagagaatctacgctttcacgttgaagaggaaggaaaaggtgtctcaccaaccggcgaaaaaacaaaagccactgctgaccaaatcaaggctttcagtgagagtctaacaaaacttggtgatgtctacgtcaacgatgcctttgggacggcacatagagctcatgcttctatggtcggctgccaactaccacaaaaagcctgtggatttctcatgaataaagaattgacatacttcgccaaagctctggaaaatccagaacgccctttcttagctattttaggaggtgccaaggttagcgacaagatccagttgatcaataatatgcttgacaaagttaatgaattaatcatcggtggtgggatggcgtatacatttcttaagcaaatacacaatatgcatataggaaatagtttatttgatgcaccgggtgcagaaattgttcataaagtaatggaaactgcaaaggctaaaaatgttgcaattcacttaccggttgatttcgtaactgccgataaatttgctgatgatgcgaacaccgaaataagaactatacaatccggaattgccgatggttggatgggattagatattggtccaaaaacaattgaagaattcagtaaagtgattagtcgtgccaaaactattgtttggaacggtccgatgggtgtttttgaaatggacaaatttgcaacaggaacaaaagcagcaatggatgaagtagtcaaagctactaaaaatggtgctacaactattattggtggtggtgacaccgcaacatgctgcgccaaatgggacacagaagacaaagttagtcatgtcagtactggtggtggtgctagtcttgaacttctcgaaggtaaacaattacccggagttgttgcacttacggatgctcattaa

SEQ ID NO: 57227 - protein, 416 aa, Schistosoma mansoni; identical to SEQ ID NO: 10771

SEQ ID NO: 57228 - DNA, 1245 bp, Schizosaccharomyces pombe; identical to SEQ ID NO: 10498
  CDS (1)..(1245)

SEQ ID NO: 57229 - protein, 414 aa, Schizosaccharomyces pombe; identical to SEQ ID NO: 10499

SEQ ID NO: 57230 - DNA, 1176 bp, Shewanella oneidensis; identical to SEQ ID NO: 10772
  CDS (1)..(1176): transl_table=11

SEQ ID NO: 57231 - protein, 391 aa, Shewanella oneidensis; identical to SEQ ID NO: 10773

SEQ ID NO: 57232 - DNA, 1239 bp, Spiroplasma citri; identical to SEQ ID NO: 10774
  CDS (1)..(1239): transl_table=4

SEQ ID NO: 57233 - protein, 412 aa, Spiroplasma citri; identical to SEQ ID NO: 10775

SEQ ID NO: 57234 - DNA, 1191 bp, Staphylococcus aureus
  CDS (1)..(1191): transl_table=11
atggctaaaaaaattgtttctgatttagatcttaaaggtaaaacagtcctagtacgtgctgattttaacgtacctttaaaagacggtgaaattactaatgacaaccgtatcgttcaagctttacctacaattcaatacatcatcgaacaaggtggtaaaatcgtactattttcacatttaggtaaagtgaaagaagaaagtgataaagcaaaattaactttacgtccagttgctgaagacttatctaagaaattagataaagaagttgttttcgtaccagaaacacgcggcgaaaaacttgaagctgctattaaagaccttaaagaaggcgacgtattattagttgaaaatacacgttatgaagatttagacggtaaaaaagaatctaaaaatgatccagaattaggtaaatactgggcatctttaggtgatgtgtttgtaaatgatgcttttggtactgcgcatcgtgagcatgcatctaatgttggtatttctacacatttagaaactgcagctggattcttaatggataaagaaattaagtttattggtggcgtagttaacgatccacataaaccagttgttgctattttaggtggagcaaaagtatctgacaaaattaatgtcatcaaaaacttagttaacatagctgataaaattatcatcggcggaggtatggcttatactttcttaaaagcgcaaggtaaagaaattggtatttcattattagaagaagataaaatcgacttcgcaaaagatttattagaaaaacatggtgataaaattgtattaccagtagacactaaagttgctaaagaattttctaatgatgccaaaatcactgtagtaccatctgattcaattccagcagaccaagaaggtatggatattggaccaaacactgtaaaattatttgcagatgaattagaaggtgcgcacactgttgtatggaatggacctatgggtgtattcgagttcagtaactttgcacaaggtacaattggtgtatgtaaagcaattgcaaaccttaaagatgcaattacgattatcggtggcggtgattcagctgcagcagcaatctctttaggttttgaaaatgacttcactcatatttcaactggtggcggcgcgtcattagagtacctagaaggtaaagaattgcctggtatcaaagcaatcaataataaataa

SEQ ID NO: 57235 - protein, 396 aa, Staphylococcus aureus; identical to SEQ ID NO: 10439

SEQ ID NO: 57236 - DNA, 1197 bp, Streptococcus pneumoniae
  CDS (1)..(1197): transl_table=11
atggcaaaacttactgttaaagacgttgacttgaaaggtaaaaaagtcctcgttcgtgttgacttcaacgtaccattgaaagatggcgtaatcactaacgataaccgtatcacagcagctcttccaactattaagtacatcatcgaacaaggtggacgtgcaattcttttctctcaccttggacgtgtgaaagaagaagctgataaagctggtaaatcacttgctcctgtagcagctgacttggcagcaaaacttggtcaagatgttgttttcccaggtgtcactcgtggtgctgaattagaagcggcaatcaacgctcttgaagatggacaagttctcttggttgaaaacactcgttacgaagatgttgacggcaagaaagaatctaaaaacgatcctgaacttggtaaatactgggcatcacttggagatggtatcttcgtaaacgatgcattcggtacagctcaccgtgcacacgcatctaacgttggtatctcagcaaacgttgaaaaagcagttgctggtttccttcttgaaaacgaaattgcctacatccaagaagcagttgaaactccagaacgtccattcgtggctatccttggtggttcaaaagtttcagacaagatcggtgttatcgaaaacttgcttgaaaaagctgataacgtccttatcggtggtgggatgacttacacattctacaaagcacaaggtatcgaaatcggtaactcacttgtagaagaagacaaattggatgttgcgaaagctcttcttgaaaaagcaaatggtaaattgatcttgccagttgactcaaaagaagctaacgcatttgctggttacactgaagtgcgtgacactgaaggtgaagcagtttctgaaggcttccttggtcttgacatcggtccaaaatctatcgccaaatttgacgaagctttgactggtgccaaaacagtcgtatggaacggacctatgggtgtatttgaaaacccagatttccaagctggtacaatcggtgtgatggacgctatcgtgaaacaaccaggagttaaatcaatcatcggtggtggtgactcagctgccgcagcgattaaccttggccgtgcagacaagttctcatggattagtacgggtggtggagcatcaatggaacttcttgaaggtaaggttcttccaggacttgcagccttgacagaaaaataa

SEQ ID NO: 57237 - protein, 398 aa, Streptococcus pneumoniae
MAKLTVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADNVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 57238 - DNA, 1248 bp, Sulfolobus tokodaii; identical to SEQ ID NO: 10782
  CDS (1)..(1248)

SEQ ID NO: 57239 - protein, 415 aa, Sulfolobus tokodaii; identical to SEQ ID NO: 10783

SEQ ID NO: 57240 - DNA, 1203 bp, Synechococcus elongatus; identical to SEQ ID NO: 10784
  CDS (1)..(1203)

SEQ ID NO: 57241 - protein, 400 aa, Synechococcus elongatus; identical to SEQ ID NO: 10785

SEQ ID NO: 57242 - DNA, 1209 bp, Synechococcus sp; identical to SEQ ID NO: 10786
  CDS (1)..(1209): transl_table=11

SEQ ID NO: 57243 - protein, 402 aa, Synechococcus sp; identical to SEQ ID NO: 10787

SEQ ID NO: 57244 - DNA, 1206 bp, Synechocystis sp; identical to SEQ ID NO: 10788
  CDS (1)..(1206)

SEQ ID NO: 57245 - protein, 401 aa, Synechocystis sp; identical to SEQ ID NO: 10789

SEQ ID NO: 57246 - DNA, 1263 bp, Tetrahymena thermophila
  CDS (1)..(1263): transl_table=6
atgttgtctcgtaagattggtattgatcacatcttgaaacatattgaaaacaagagagttttaatgagagtagacttcaacgttcctttgaaggaaggtaaggttaaagatcctactcgtatctaaggttctgttccttctatcaagaaaatcttagagtaaaatcctaaaggtcttgtcttgatgagtcacttgggtcgtcctgatggcaacagagttgaaaagcactcaatgaagcctgttgttcctaagcttgaagaattactcggcaccaaggtaaccttcttgaatgactgtgttggtaaggatgtagaagaagctgttaaatcaagcagaaacggtgaaatcattttacttgaaaacttgcgtttccatcctgaagaagaaggaaagtacatcgatgctgcaggaaacaaggttaaggctgactctaaggcagttaaggaattcagaaaatctttgactagtttgggtgacttattcgtcaacgatgctttcggtaccgctcacagagctcactcttccatggtcggtgttgatcacaaaatcagagctgctggttacctcttgaagagagaattagactacttcagtaaggctttggaatcccctaacagacctttcttagttgtcttaggtggtgctaaggtcaaggataaaatctaattgattgaaagtatgcttgacaaggtcgatgaaatgatcattggtggtggtatggccttcactttcttgaagaaaatccacaatattgaaattggtaactccctcttcgacgaagaaggttataagattgttgaccaattgttagaaaaggctaaagctaagaatgtcaagatccatttaccagttgatttcttgtgcggtgactcacttgaagccaacgctaacacccgtagctttgacttaaagagtggtatccctgctggatggattggtttagatgctggtcctaagactatggctgaaaacgctgaagctgttgcccgtgctaacactattgtctggaatggtccttaaggtagattcgaagttgataagtttaaagtaggatcttctgaccttctcaagcacgttgctactagaacttcctaaggagctacttctattattggtggtggtgacactgtcaatcttgttcaacaagaaaaggcaactcaaaaagtcagccacgtctctactggtggtggtgcatctcttgaacttcttgaaggtaaagtccttcctggtgttgcttatcttactgatattgactaactttga

SEQ ID NO: 57247 - protein, 420 aa, Tetrahymena thermophila
MLSRKIGIDHILKHIENKRVLMRVDFNVPLKEGKVKDPTRIQGSVPSIKKILEQNPKGLVLMSHLGRPDGNRVEKHSMKPVVPKLEELLGTKVTFLNDCVGKDVEEAVKSSRNGEIILLENLRFHPEEEGKYIDAAGNKVKADSKAVKEFRKSLTSLGDLFVNDAFGTAHRAHSSMVGVDHKIRAAGYLLKRELDYFSKALESPNRPFLVVLGGAKVKDKIQLIESMLDKVDEMIIGGGMAFTFLKKIHNIEIGNSLFDEEGYKIVDQLLEKAKAKNVKIHLPVDFLCGDSLEANANTRSFDLKSGIPAGWIGLDAGPKTMAENAEAVARANTIVWNGPQGRFEVDKFKVGSSDLLKHVATRTSQGATSIIGGGDTVNLVQQEKATQKVSHVSTGGGASLELLEGKVLPGVAYLTDIDQL

SEQ ID NO: 57248 - DNA, 1173 bp, Thermus thermophilus; identical to SEQ ID NO: 10792
  CDS (1)..(1173): transl_table=11

SEQ ID NO: 57249 - protein, 390 aa, Thermus thermophilus; identical to SEQ ID NO: 10793

SEQ ID NO: 57250 - DNA, 1271 bp, Thermus thermophilus; identical to SEQ ID NO: 10506
  CDS (28)..(1200)

SEQ ID NO: 57251 - protein, 390 aa, Thermus thermophilus; identical to SEQ ID NO: 10507

SEQ ID NO: 57252 - DNA, 1185 bp, Thermoanaerobacter tengcongensis
  CDS (1)..(1185): transl_table=11
gtgaaaaagaaaactgtgagagacatagacgttagcggaaaaagagttttagttagagtagattttaacgtgccgatggatgaaaataaaaacataacagatgacaggcgcataagagaagctcttcccaccattgagtatttaataaatcacaacgcaaaagtgatactggtatctcacctggggagacctaaggggaaattcaatccggattactctttaaagcctgttgcaaaaaggctgtctgagcttttgaaaaagcctgtaattatggcagaggatgtgattggagaagatgctaaggtaaaagctgctgccttaaaagaaggggaagttctccttttggaaaatgttagattccatgcagaagaggagaagaatgaccctgaatttgcaaaagagcttgcatctttagcagatatatacgtaaatgatgcttttggcactgctcacagggctcacgcttctactgcaggagttgccaagtatcttccagcagtggcaggttttttaattgaaaaagagctttctataatgggagaagcgttggagaatcctaagagaccttttgtggcgattttaggtggagctaaagtttctgataaaattggggttataacaaatcttctggaaaaagtggacagcctgttaattggcggtggaatggcttatacctttattaaggcgaagggctacgaaatagggaaatctcttttggaagaggataaaattgaactagcaaaggaaataatggaaaaagcaaagcagaagggcgtaaatttcatgcttcctgttgatacagttatcgcgaaagagttaaaatccggggtaccttatgaagtggttgacattgacaaaatgccagaagaccagataggagttgacattgggcctaaaacaatagaagagtattcaaaagtgataaagcatgccatgacagttgtatggaatggaccaatgggagtttttgaaatacctgaatttgccaaaggtacaaaagctatcgcaaaggctttgagcgagtgcaaaggtacaacaatagtaggaggaggagattctgcagctgccatagaacagcttggctatgctgataaagtcacccacatttcaactggaggcggtgcgtcactggaatttttagaggggaaagtcttgccgggaattgacattttgaatgataagtaa

SEQ ID NO: 57253 - protein, 394 aa, Thermoanaerobacter tengcongensis; identical to SEQ ID NO: 10795

SEQ ID NO: 57254 - DNA, 1227 bp, Thermoplasma volcanium
  CDS (1)..(1227)
atggctgatttctttctcatggattctttcgatctcgcaggaaggactatatatctaagggttgatataaactcacctgtgaatccagtaactggagaaataatgggtacagataggtttagggcccatgtcgagactattaggaagctaagagattcaaaggtcgttattgtggcccatcagagccggcctggaaaggatgattttacgtcgctgaggcagcacgcgcaggtcatgtcgcgtattttgaacaagaaagtaatgtttgtagatcagctcttcggatcacttgtaaacaagactgttgaatcaatgaatgagggagatatagtaatgctagaaaacgctaggttctattcagaagaagttgaccttacgactttagaatcgatggaaaattcaaacatagttaagggtctctctactctcttcgattactatattatagatgcgtttgccgcaatacatagggcacagaccacccttgtaggtttcaggaggataaagccaaacatagcaggtgcgcttatagagaaagaggttacaatgatcgataggttcaggcatctaaacgaatctccaaaaatagccatactaggcggcgcaaagatcgacgattctatcgctgtatcagagaatttcctgaaatccggcttcgttgataaaatactcaccggcggtgttgttgcgaacgcattcctttgggccaaaggcatcgacattggaaagaagaacagggacttcataataaaaaataacggagattacgagaagttgatcgctaagtgtaagggtctgctctccgagtttggtgataggatactggtaccgtcggatttcattttaagtccttcaggagaaagggtctccgcaaacggaaagattcctgacgatcagatacttgctgacattggactcgataccgtggtcgaatactccgaaataattgataaggctaaggcaatatttatgaatggcccaatgggtatatatgagatcgaagcgtattcatctggtactagggagatattttcttctgtagcaaaatcagaggcctttagcatagcaggtggagggcatactcttagcgcactggacaagcttggtctgacaaacaggatagatcatgcgtcaacaggcggaggggcactcataagctatttaagtggtgaagctatgccagtactcgaagcattgaaggaaagcaaacgtttgtttgaggtgtag

SEQ ID NO: 57255 - protein, 408 aa, Thermoplasma volcanium
MADFFLMDSFDLAGRTIYLRVDINSPVNPVTGEIMGTDRFRAHVETIRKLRDSKVVIVAHQSRPGKDDFTSLRQHAQVMSRILNKKVMFVDQLFGSLVNKTVESMNEGDIVMLENARFYSEEVDLTTLESMENSNIVKGLSTLFDYYIIDAFAAIHRAQTTLVGFRRIKPNIAGALIEKEVTMIDRFRHLNESPKIAILGGAKIDDSIAVSENFLKSGFVDKILTGGVVANAFLWAKGIDIGKKNRDFIIKNNGDYEKLIAKCKGLLSEFGDRILVPSDFILSPSGERVSANGKIPDDQILADIGLDTVVEYSEIIDKAKAIFMNGPMGIYEIEAYSSGTREIFSSVAKSEAFSIAGGGHTLSALDKLGLTNRIDHASTGGGALISYLSGEAMPVLEALKESKRLFEV

SEQ ID NO: 57256 - DNA, 1260 bp, Treponema denticola; identical to SEQ ID NO: 10796
  CDS (1)..(1260): transl_table=11

SEQ ID NO: 57257 - protein, 419 aa, Treponema denticola; identical to SEQ ID NO: 10797

SEQ ID NO: 57258 - DNA, 1260 bp, Treponema pallidum; identical to SEQ ID NO: 10442
  CDS (1)..(1260): transl_table=11

SEQ ID NO: 57259 - protein, 419 aa, Treponema pallidum; identical to SEQ ID NO: 10443

SEQ ID NO: 57260 - DNA, 1188 bp, Tropheryma whipplei
  CDS (1)..(1188): transl_table=11
ttgagaactcttggcggtttcacctttccttgtgatgctcctgtttttgtccgggttgatttcaatgtgcctatggatgaggtcggcacaataacggatgatctgcgtataagagcttcccttccgactatagaaagcttgcttggccgtggcgcgccacttatattgatttctcatctcgggcgaccggttaaaaatgagcagcaaggattttccctaaaaccctgtgctgagcgactatcggaatatatcggagtcaatgtaccgcttgtggattttcttgatctagatacaaagctttatggtgaacttactaggcatctggacaagtctgggatagttctttttgaaaatatacgattttttgccgaggaaacttcaaaggcacaggctgatcgaaggattctggctgagcaacttgcgccttttgcgggtgcgtatgtcaatgatgcctttggtgcttcccacaggaggcatgctagtgtgtatgagcttgcacaggctttctcaaataaggcggcaggctttctcattgaatcagagatgcaggctttttcacatcttgccagcgaggccaagcgtccctataccgttattctcggcggggcaaaattatcggacaagctacggcttatagagaatatcctgccaacggttgatcgtctgttactgtgtggtggaatggcatttacatttctagcggcacaggggtgtgaaacaggcaaaagtctcctggaagagagttttatctcggaggcaaataaaatcattgattttgctaagcaaaataatgttgaacttatacttccggtagatgttattgaggcgcgaagcctaacttcaccccttggggttgtaagtaaagctgaatctatatcttatatgggtcttgatataggtcctgaaactcagagtatctttagaaatgtaatacaagattcgaaaactgttttttggaatggcccggctggtttatttgaaaacccaagcttttcaaacggaacacgtgcactgcttgatgcattgtcgtcttctagcgcgtttacatttatcggaggaggcgatacagcagcagctgtcagccttcttggttttgattatggagattttagtcatgtttcaacaggcggtggtgcctgccttgaactgctagagggaaaaatattgccagcattagaggttttgtaa

SEQ ID NO: 57261 - protein, 395 aa, Tropheryma whipplei; identical to SEQ ID NO: 10799

SEQ ID NO: 57262 - DNA, 1188 bp, Tropheryma whipplei
  CDS (1)..(1188): transl_table=11
ttgagaactcttggcggtttcacctttccttgtgatgctcctgtttttgtccgggttgatttcaatgtgcctatggatgaggtcggcacaataacggatgatctgcgtataagagcttcccttccgactatagaaagcttgcttggccgtggcgcgccacttatattgatttctcatctcgggcgaccggttaaaaatgagcagcaaggattttccctaaaaccctgtgctgagcgactatcggaatatatcggagtcaatgtaccgcttgtggattttcttgatctagatacaaagctttatggtgaacttactaggcatctggacaagtctgggatagttctttttgaaaatatacgattttttgccgaggaaacttcaaaggcacaggctgatcgaaggattctggctgagcaacttgcgccttttgcgggtgcgtatgtcaatgatgcctttggtgcttcccacaggaggcatgctagtgtgtatgagcttgcacaggctttctcaaataaggcggcaggctttttaattgaatcagagatgcaggctttttcacatcttgccagcgaggccaagcgtccctataccgttattctcggcggggcaaaattatcggacaagctacggcttatagagaatatcctgccaacggttgatcgtctgttactgtgtggtggaatggcatttacatttttagcggcacaggggtgtgaaacaggcaaaagtctcctggaagagagttttatcccggaggcaaataaaatcattgattttgctaagcaaaataatgttgaacttatacttccggtagatgttattgaggcgcgaagcctaacttcaccccttggggttgtaagtaaagctgaatctatatcttatatgggtcttgatataggtcctgaaactcagagtatctttagaaatgtaatacaagattcgaaaactgttttttggaatggcccggctggtttatttgaaaacccaagcttttcaaatggaacacgtgcactgcttgatgcattgtcgtcttctagtgcgtttacatttatcggaggaggcgatacagcagcagctgttagccttcttggttttgattatggagattttagtcatgtttcaacaggcggtggtgcctgccttgaactgctagagggaaaaatattgccagcattagaggttttataa

SEQ ID NO: 57263 - protein, 395 aa, Tropheryma whipplei
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFIPEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 57264 - DNA, 1269 bp, Ureaplasma parvum; identical to SEQ ID NO: 10416
  CDS (1)..(1269): transl_table=4

SEQ ID NO: 57265 - protein, 422 aa, Ureaplasma parvum; identical to SEQ ID NO: 10417

SEQ ID NO: 57266 - DNA, 1164 bp, Vibrio cholerae; identical to SEQ ID NO: 10800
  CDS (1)..(1164)

SEQ ID NO: 57267 - protein, 387 aa, Vibrio cholerae; identical to SEQ ID NO: 10801

SEQ ID NO: 57268 - DNA, 1185 bp, Wigglesworthia glossinidia brevipalpis; identical to SEQ ID NO: 10804
  CDS (1)..(1185)

SEQ ID NO: 57269 - protein, 394 aa, Wigglesworthia glossinidia brevipalpis; identical to SEQ ID NO: 10805

SEQ ID NO: 57270 - DNA, 1197 bp, Wolbachia pipientis wMel; identical to SEQ ID NO: 10806
  CDS (1)..(1197): transl_table=11

SEQ ID NO: 57271 - protein, 398 aa, Wolbachia pipientis wMel; identical to SEQ ID NO: 10807

SEQ ID NO: 57272 - DNA, 1206 bp, Wolinella succinogenes; identical to SEQ ID NO: 10808
  CDS (1)..(1206): transl_table=11

SEQ ID NO: 57273 - protein, 401 aa, Wolinella succinogenes; identical to SEQ ID NO: 10809

SEQ ID NO: 57274 - DNA, 1176 bp, Xanthomonas axonopodis
  CDS (1)..(1176): transl_table=11
atgtccattgtccgcatgaccgacctcgatctctccggcaagcgcgtgctgatccgccaggatctcaacgtgccgatcgacaacggccagatcacctccgaacagcgcatcaccgcctcggtgcccaccatcaagctagcgctggaaaaaggtgcggccgtcatggtgacctcgcacctgggccgccccaaggaaggcagctggaccgaagaagattcgctggcgccggttgccacgcgtctggccgcattgctgggcgtggacgtgccgctggtgcgcgactgggtcgatggcgtggaggtcgcgccgggccaggtggtgctgctggaaaactgccgcatgaatgtcggcgagggcaaggacgatgagacgctggcgcgcaagtacgccgcgttgtgcgacgtgttcgtgatggatgccttcggcaccgcgcaccgcgcgcaggcctccacgcatggcgtgatccgtttcgcgccggtcgccgcaggcggcccgctgttgatggccgaactcgacgccctggccaaggcgctggacaaccccgccaagcccttgctggcgatcgtggccggcagcaaggtgtccaccaagctggagctgctgtccaacctggtcaacaaggtcgaccagctgatcgtcggcggcggcatcgccaacaccttcatcgccgcggccgggcatgccgtgggcaagtcgttgaacgagccggatttgatcccgaccgccaaccggatcgtggccgatgccaaggcgcgtggcgccgagatcccgctgcccaccgatgtggtcgttgccaagcagttcctgcccgatgcgcaagccagcgtgaagtcgttggacgcggtcgacgcggacgatctgatcctggatatcggcccgcaaaccgcgcagcgctacgccgaactgatcgccagtgccggtaccgtggtgtggaacggtccggtgggcgtgttcgaattcgagtccttcagccacggcaccgaaaccctggcgcgcgcgatcgccagctccaaggcgttctcgatcgctggcggtggcgacaccctggccgcagtggacaaatacgacatcgcccaggacgtcacctacatttccacgggcggcggtgcgttcctggagtttctggaaggcaagaccttgccggcggtggccgcactccaggcccgcggtcagtga

SEQ ID NO: 57275 - protein, 391 aa, Xanthomonas axonopodis
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANRIVADAKARGAEIPLPTDVVVAKQFLPDAQASVKSLDAVDADDLILDIGPQTAQRYAELIASAGTVVWNGPVGVFEFESFSHGTETLARAIASSKAFSIAGGGDTLAAVDKYDIAQDVTYISTGGGAFLEFLEGKTLPAVAALQARGQ

SEQ ID NO: 57276 - DNA, 1176 bp, Xanthomonas campestris; identical to SEQ ID NO: 10810
  CDS (1)..(1176): transl_table=11

SEQ ID NO: 57277 - protein, 391 aa, Xanthomonas campestris; identical to SEQ ID NO: 10811

SEQ ID NO: 57278 - DNA, 1194 bp, Xanthobacter flavus
  CDS (1)..(1194): transl_table=11
atgatcgccttccgcaccctcgatgacgccgtggacctcgccgacaagcgggtcctcgtccgtgtcgacctcaacgttcccatggagagcgggcgcgtcaccgacgccacccgtctcaaggccatcctgcccaccattcgggacatcaccggcaagggcggcaaggccgtcctgctggcgcacttagggcggcccaagggccgcgacgaaagccagtcgctcgcccccgtcgccaaggccctcgagggtgaactcggccgcaaggtcgcgttcgcctctgattgcatcggcgacgaggcgaagagcgccgtctcccgcctcgcctccggcgaggtgatcgtgctggagaacacccgcttccatgcgggcgaggagaagaacgcgccggacttcatcgaagccctcgcgagcctcggcgatatctatgtcaacgatgccttttccaccgcccaccgcgcgcacgcctccaccgaggggctggcccgcaagctgccggcctatgccggccgctccatggaaagcgagatcgaggcgctgaccaaggccctcgaggcgccccagcgccccgtgctcgccgtggtcggcggctccaaggtgtccagcaagctcgaactgctcggcaacctcgtgaagaaggtggacatcctcgtcatcggcggcggcatggccaacaccttcctcgccgctctcggcaagaaggtgggcaagtcgctctgcgagcacgacctggccaacaccgcgcgggacatcctgaagaaggccgaggcggccggatgcgagatcgtcctgccggtggacgcggtggtcgccaccgagttcaaggccaatgccgcgcaccgcgtcaccagcgtcgatgacgtgaaggacgacgagatgatgctggacgccggtccggagacggtcggcatcgtcaagcagaagctcgacggggcgaagacggtggtctggaacgggccgttcggcgcgttcgagatgacgccgttcgatgcggcgacggtggccgtggcccgctatgtcggcgacctcacccacaaggggcggttgctgtcggttgcgggcggcggcgacacggtggccgcgctgaaccatgcggggacggcggagcgcttctcctacgtctcgacggccggcggtgccttcctcgagtggctcgagggcaaggcgcttccgggcgtggaggccctgcggcgctga

SEQ ID NO: 57279 - protein, 397 aa, Xanthobacter flavus; identical to SEQ ID NO: 10813

SEQ ID NO: 57280 - DNA, 1176 bp, Xylella fastidiosa
  CDS (1)..(1176)
atgtccatcgtccgcatgactgatctcgctttatccggtaaacgcgtactgattcgtcaggacttgaatgtaccgattgatcagggtcgtattacttccgagcagcgcattattgcttcgcttccgacgatccgtgtagcgctggagcgtggtgcggcggtcatggtgacttcgcatctgggccgtccgaaggagggcgtgtggagtgaggaggattcattggcacccgtggcgaagcgcttgtctcaattgttggggattgaggttccgttgcgtcgcgattgggtggatggcgtgcaggttgcgccagggcagttggtgttattggaaaactgccgaatgaatgtcggcgaagctgagaatgacgaggcgttggcaaggaagtatgcggcgttatgtgatgtgttcgtgatggatgcgtttggcactgcgcaccgtgcccaggcatcaacgcatggggtgatctgttgtgctgcgattgctgccggcggtccgttgttgatggctgagttggatgctttgagccggggattggagcatccggtgaagccgctgctggcgattgtggggggcagtaaggtatcgacgaaactggagttgctttccaatttggtgaataacgttgagcaattgattacggggggaggcattgccaatacgttccttgccgcagccggttactccatcggtaagtcactgtatgagggggatttgatcgagactgctcgggagattattactgcggcgaaagcgcgtggcgctgagattccgttacccacggatgtggttgttgccaagcagtttttgcctggagtcacggcaacggtgaagacggtggatgcaatcgttgcggatgatcttattttggacattggtccgcagacggcacggcactatgctgccttgattgaaacggcggcgacggtggtctggaatggtccagtgggtgtgtttgagttcgatgccttcagcaaggggaccgaggtgttagcgcgggccgttgctgcctcgtctgcgttttcgattgctggtggcggcgataccttggctgccattgataagtatggtgttgcggaccagatcagctacatctccacaggcggcggtgcttttctggagtttttggaaggtaagacgttgccggcggtggctgccttgcaggcgcgcagcggataa

SEQ ID NO: 57281 - protein, 391 aa, Xylella fastidiosa
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 57282 - DNA, 1254 bp, Yarrowia lipolytica
  CDS (1)..(1254)
atgtctcttaccaacaagctctccatcaaggatctcgatctcaagaacaagcgagtcttcatccgagtcgactttaacgttcctctcgatggcaccaccatcaccaacaaccagcgaattgttgctgccctgccctccatcaagtatgccattgatcagggtgccaaggctgtgatccttgcttctcatctcggccggcccaacggccagcgagtcgagaagtactctctcaagcccgtccaggccgagctttcaaagctccttggcaagcccgtcaccttccttgacgactgcgtcggccccaaggttgaggaggaggtctccaaggccaaggacggtgaggtcattctcctcgagaacctgcgattccaccccgaggaggagggatcccacaaggacgccgacggcaagaagatcaaggctgaccccgccaaggttgaggagttccgaaagtctctgacttctctcgccgatgtctacgtcaacgacgctttcggaaccgcccaccgagcccactcctccatggtcggcattgagcttccccagcgagccgctggtttccttgtcgccaaggagctcgagttcttcgccaaggctctggagcaccccgagcgacccttccttgccatccttggtggtgccaaggtctccgacaagatccagctcatcgacaacctacttgacaaggtcaacgccctgatcattggtggtggtatggctttcaccttcaagaagacccttgagaacgtcaagattggaaactctctcttcgacgaggatggatccaagattgtcgccggcctcgttgagaaggccaagaagaacaacgtcaagcttgtcttccccgtcgactacgtcaccgccgacaagttctccaaggatgccaaggttggccacgcaaccgacgctgagggtatccccgacggatggcagggtctggactgtggtcccaagtctatcgaggagttccagaaggtcattggcgagtccaagaccatcctctggaacggaccccccggtgtctttgagttcgacaacttcgccaagggtaccaaggctgtgcttgacgcctgtgtcaaggccgttgacaacggtgctaccgtgatcattggtggtggagataccgccactgtcgccaagaagtacggtgccgaggacaagctctcccatgtttccactggaggaggagcttctcttgagcttctcgagggtaagacccttcccggtgtcgctgctctctccgagaagaagtaa

SEQ ID NO: 57283 - protein, 417 aa, Yarrowia lipolytica
MSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 57284 - DNA, 1164 bp, Yersinia pestis
  CDS (1)..(1164): transl_table=11
atgtctgtaattaagatgaccgatctggatctggctggcaaacgtgttttgatccgtgcggacctcaatgttccggtaaaagaaggcaaagtgacttctgatgcgcgtatccgtgcctctctgccaactatcgaagcggcattgaagcaaggcgctaaagtaatggttacctctcacttgggtcgcccgaccgaaggcgagtacaacgaagagttctccttactgcccgtcgttaactacctgaaagagaagttatcttctccggtacgtctggcgaaggactatctggacggcgttgaaattgcagctggcgagttggttgttctggaaaacgttcgctttaacaaaggcgagaaaaaagacgacgaagccctgtccaagaaatatgccgcactgtgcgatgtttatgtgatggatgcttttggtaccgctcaccgcgctcaggcatcgactcacggtgtgggtaaatttgcccctatcgcttgcgccggcccgctgttgtcagcagagctggaagcattgggtaaagcgctgggtaacccagcgcgtccaatggttgctatcgttggtggctctaaagtttcaactaaactgaccgtgctgggcgcgttgtctaaaatcgcggataaactgattgttggcggtggtatcgctaataccttcgttgcggctcaaggccacaatgtcggtaaatctctgtacgaagctgatctgatcccagaagcgaaaagactgctagagacctgtgatatccctgttcctactgatgttcgtgttgccactgagttctctgaaacggcagccgcgacgctgaaacccgcgaacgaaattaaagatgacgaacaaattttggatctgggcgacgaatctgcggagcgtctggctgagatcctgaaaaatgccaaaaccattctgtggaatggtccggttggtgtgttcgagttccctaacttccgtaaagggaccgagatcgtggctcgcgccattgcagaaagcgaagcattttctatcgcaggcggtggtgatactttggcagcaatcgatctcttcggtattgctgaccaaatctcctacatttctactggcggtggtgctttcctggagttcgtcgaagggaaaaaactgcctgccgtagtgatgctggaagagcgcgctaagcagtaa

SEQ ID NO: 57285 - protein, 387 aa, Yersinia pestis; identical to SEQ ID NO: 10397

SEQ ID NO: 57286 - DNA, 1194 bp, Zymomonas mobilis
  CDS (1)..(1194): transl_table=11
atggcttttcgtacattagatgatattggtgacgtcaaaggtaagcgcgttcttgttcgcgaagatctgaacgttcctatggatggcgatcgcgttacggatgatactcgtctgcgcgctgcaatcccgaccgttaatgaattggctgaaaagggcgccaaagtccttattctggctcacttcggtcgtccaaaaggtcagccgaatcctgaaatgtccttggctcgcatcaaagatgcgctggctggcgttctgggtcgtccggttcacttcatcaatgacatcaaaggtgaagctgcagcaaaagccgttgatgccctgaatcctggtgccgttgctcttcttgaaaacacccgcttttatgctggtgaagaaaagaatgatccggctctggcagcagaagtagctaagctcggcgatttctatgtcaatgatgctttctcggctgctcaccgcgcccatgtttcgaccgaaggtctggctcacaagctgcctgctttcgctggtcgtgccatgcagaaagaattagaagctcttgaagctgcccttggtaagccgacccacccggtcgcagccgttgtcggtggtgctaaagtttctaccaagctcgacgttctgaccaaccttgtttccaaggttgaccatctgatcatcggtggtggtatggctaataccttcctcgctgctcagggtgttgatgttggtaaatcgctttgtgagcatgagctgaaagataccgttaaaggtattttcgctgctgctgaaaaaacgggctgcaaaatccatcttccgagcgatgtcgttgtcgccaaggaattcaaagccaatccgccgatccgtaccattccggtcagcgacgttgctgctgacgaaatgatccttgacgttggcccgaaagccgtcgctgctttgaccgaagttctgaaagcttccaagaccttggtctggaatggcccgttgggcgctttcgaaattgaacctttcgataaagctacggttgctctcgctaaggaagccgctgctttgaccaaagccggttctttgatctctgttgctggtggtggtgacacggttgccgctcttaaccatgctggtgtggcaaaagactttagctttgtctcaacggctggtggtgctttcctcgaatggatggaaggtaaagagctgccgggtgttaaagccctcgaagcttaa

SEQ ID NO: 57287 - protein, 397 aa, Zymomonas mobilis; identical to SEQ ID NO: 10473

SEQ ID NO: 57288 - DNA, 26 bp, Artificial sequence
  (1)..(26): primer
atgtctttatcttcaaagttgtctgt

SEQ ID NO: 57289 - DNA, 27 bp, Artificial sequence
  (1)..(27): primer
ttatttcttttcggataagaaagcaac

SEQ ID NO: 57290 - protein, 564 aa, Artificial sequence
  Variant (2)..(5): xaa in position 2 to 5 is any amino acid
  Variant (7)..(8): xaa in position 7 to 8 is any amino acid
  Variant (10)..(10): xaa in position 10 is any amino acid
  Variant (11)..(14): xaa in position 11 to 14 is any or no amino acid
  Variant (16)..(16): xaa in position 16 is any amino acid
  Variant (19)..(19): xaa in position 19 is any amino acid
  Variant (21)..(21): xaa in position 21 is any amino acid
  Variant (26)..(29): xaa in position 26 to 29 is any amino acid
  Variant (30)..(32): xaa in position 30 to 32 is any or no amino acid
  Variant (34)..(37): xaa in position 34 to 37 is any amino acid
  Variant (40)..(42): xaa in position 40 to 42 is any amino acid
  Variant (47)..(53): xaa in position 47 to 53 is any amino acid
  Variant (54)..(56): xaa in position 54 to 56 is any or no amino acid
  Variant (60)..(60): xaa in position 60 is any amino acid
  Variant (63)..(63): xaa in position 63 is any amino acid
  Variant (67)..(73): xaa in position 67 to 73 is any amino acid
  Variant (74)..(170): xaa in position 74 to 170 is any or no amino acid
  Variant (173)..(173): xaa in position 173 is any amino acid
  Variant (176)..(178): xaa in position 176 to 178 is any amino acid
  Variant (180)..(182): xaa in position 180 to 182 is any amino acid
  Variant (184)..(184): xaa in position 184 is any amino acid
  Variant (185)..(190): xaa in position 185 to 190 is any or no amino acid
  Variant (192)..(203): xaa in position 192 to 203 is any amino acid
  Variant (204)..(211): xaa in position 204 to 211 is any or no amino acid
  Variant (213)..(213): xaa in position 213 is any or no amino acid
  Variant (220)..(220): xaa in position 220 is any amino acid
  Variant (223)..(225): xaa in position 223 to 225 is any amino acid
  Variant (227)..(237): xaa in position 227 to 237 is any amino acid
  Variant (238)..(260): xaa in position 238 to 260 is any or no amino acid
  Variant (262)..(262): xaa in position 262 is any amino acid
  Variant (264)..(264): xaa in position 264 is any amino acid
  Variant (266)..(268): xaa in position 266 to 268 is any or no amino acid
  Variant (272)..(272): xaa in position 272 is any amino acid
  Variant (277)..(277): xaa in position 277 is any amino acid
  Variant (282)..(282): xaa in position 282 is any amino acid
  Variant (285)..(286): xaa in position 285 to 286 is any amino acid
  Variant (289)..(293): xaa in position 289 to 293 is any amino acid
  Variant (294)..(300): xaa in position 294 to 300 is any or no amino acid
  Variant (303)..(303): xaa in position 303 is any amino acid
  Variant (306)..(307): xaa in position 306 to 307 is any amino acid
  Variant (310)..(314): xaa in position 310 to 314 is any amino acid
  Variant (315)..(316): xaa in position 315 to 316 is any or no amino acid
  Variant (318)..(319): xaa in position 318 to 319 is any amino acid
  Variant (321)..(321): xaa in position 321 is any amino acid
  Variant (324)..(326): xaa in position 324 to 326 is any amino acid
  Variant (335)..(335): xaa in position 335 is any amino acid
  Variant (338)..(338): xaa in position 338 is any amino acid
  Variant (341)..(342): xaa in position 341 to 342 is any amino acid
  Variant (344)..(348): xaa in position 344 to 348 is any amino acid
  Variant (349)..(351): xaa in position 349 to 351 is any or no amino acid
  Variant (360)..(360): xaa in position 360 is any amino acid
  Variant (363)..(370): xaa in position 363 to 370 is any amino acid
  Variant (371)..(380): xaa in position 371 to 380 is any or no amino acid
  Variant (382)..(382): xaa in position 382 is any or no amino acid
  Variant (385)..(385): xaa in position 385 is any amino acid
  Variant (387)..(394): xaa in position 387 to 394 is any amino acid
  Variant (395)..(395): xaa in position 395 is any or no amino acid
  Variant (398)..(401): xaa in position 398 to 401 is any amino acid
  Variant (402)..(406): xaa in position 402 to 406 is any or no amino acid
  Variant (408)..(408): xaa in position 408 is any amino acid
  Variant (411)..(411): xaa in position 411 is any amino acid
  Variant (413)..(425): xaa in position 413 to 425 is any amino acid
  Variant (426)..(443): xaa in position 426 to 443 is any or no amino acid
  Variant (445)..(450): xaa in position 445 to 450 is any amino acid
  Variant (455)..(456): xaa in position 455 to 456 is any amino acid
  Variant (458)..(464): xaa in position 458 to 464 is any amino acid
  Variant (466)..(467): xaa in position 466 to 467 is any amino acid
  Variant (468)..(475): xaa in position 468 to 475 is any or no amino acid
  Variant (477)..(477): xaa in position 477 is any amino acid
  Variant (485)..(485): xaa in position 485 is any amino acid
  Variant (490)..(492): xaa in position 490 to 492 is any amino acid
  Variant (493)..(493): xaa in position 493 is any or no amino acid
  Variant (495)..(496): xaa in position 495 to 496 is any amino acid
  Variant (499)..(500): xaa in position 499 to 500 is any amino acid
  Variant (502)..(504): xaa in position 502 to 504 is any amino acid
  Variant (506)..(509): xaa in position 506 to 509 is any amino acid
  Variant (510)..(515): xaa in position 510 to 515 is any or no amino acid
  Variant (518)..(518): xaa in position 518 is any amino acid
  Variant (524)..(535): xaa in position 524 to 535 is any amino acid
  Variant (536)..(539): xaa in position 536 to 539 is any or no amino acid
  Variant (549)..(549): xaa in position 549 is any amino acid
  Variant (552)..(552): xaa in position 552 is any amino acid
  Variant (557)..(557): xaa in position 557 is any amino acid
  Variant (562)..(563): xaa in position 562 to 563 is any amino acid
LXXXXLXXKXXXXXVXIRXDXNVPLXXXXXXXIXXXXRIXXXLPTIXXXXXXXXXXVILXSHXGRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLXPVXXXLXXXLXXXXXXXVXXXXXXXXXXXXXXXXXXXXGXVLLLENXRFXXXEXXXXXXXXXXXXXXXXXXXXXXXXXXXXXXXXXXAXLXDXXXVYVXDAFGXAHRAXASXXGVXXXXXXXXXXXXAGXLMXXELXXXXXXXLXXPXRPXXXILGGAKVSXKIXVIXXLXXXXXXXXLIIGGGMAXTFXXXXXXXXXXXXXXXXXXGXSLXEXXXXXXXXXLLXXXXXXXXXIXLPXDXXXXXXXXXXXXXXXXXXXXXXXXXXXXXXXIXXXXXXLDIGXXTXXXXXXXIXXXXXXXXXXAXTIVWNGPXGVFEXXXXFXXGTXXVXXXIXXXXXXXXXXSIXGGGDTXXXXXXXXXXXXXXXXSHISTGGGAXLEXLEGKXLPGVXXL

SEQ ID NO: 57291 - protein, 50 aa, Artificial sequence
  Variant (2)..(2): xaa in position 2 is Phe, Ile, Leu or Val
  Variant (3)..(3): xaa in position 3 is any amino acid
  Variant (5)..(5): xaa in position 5 is any amino acid
  Variant (7)..(7): xaa in position 7 is any amino acid
  Variant (9)..(9): xaa in position 9 is Ser or Val
  Variant (11)..(20): xaa in position 11 to 20 is any amino acid
  Variant (21)..(21): xaa in position 21 is any or no amino acid
  Variant (23)..(44): xaa in position 23 to 44 is any amino acid
  Variant (45)..(45): xaa in position 45 is any or no amino acid
  Variant (47)..(47): xaa in position 47 is any amino acid
  Variant (48)..(48): xaa in position 48 is Gly or Ser
  Variant (49)..(49): xaa in position 49 is Asp, Lys or Arg
  Variant (50)..(50): xaa in position 50 is Ile, Pro or Val
VXXRXDXNXPXXXXXXXXXXXRXXXXXXXXXXXXXXXXXXXXXXXHXXXX

SEQ ID NO: 57292 - protein, 16 aa, Artificial sequence
  Variant (2)..(4): xaa in position 2 to 4 is any amino acid
  Variant (5)..(5): xaa in position 5 is any or no amino acid
  Variant (7)..(7): xaa in position 7 is any or no amino acid
  Variant (10)..(10): xaa in position 10 is any amino acid
  Variant (12)..(15): xaa in position 12 to 15 is any amino acid
GXXXXLXENXRXXXXE

SEQ ID NO: 57293 - protein, 12 aa, Artificial sequence
  Variant (4)..(4): xaa in position 4 is Ala, Gly or Ser
  Variant (5)..(5): xaa in position 5 is Ala, Ser or Thr
  Variant (9)..(11): xaa in position 9 to 11 is any amino acid
  Variant (12)..(12): xaa in position 12 is Asp, Ser or Thr
DAFXXAHRXXXX

SEQ ID NO: 57294 - protein, 60 aa, Artificial sequence
  Variant (2)..(2): xaa in position 2 is any amino acid
  Variant (4)..(4): xaa in position 4 is any amino acid
  Variant (5)..(6): xaa in position 5 to 6 is any or no amino acid
  Variant (8)..(20): xaa in position 8 to 20 is any amino acid
  Variant (21)..(22): xaa in position 21 to 22 is any or no amino acid
  Variant (24)..(25): xaa in position 24 to 25 is any amino acid
  Variant (26)..(26): xaa in position 26 is Ala, Gly, Ser, Thr or Val
  Variant (27)..(28): xaa in position 27 to 28 is Ile, Leu, Met or Val
  Variant (29)..(29): xaa in position 29 is Ala or Gly
  Variant (31)..(31): xaa in position 31 is Ala or Ser
  Variant (33)..(33): xaa in position 33 is Ile, Leu, Met or Val
  Variant (34)..(34): xaa in position 34 is any amino acid
  Variant (35)..(35): xaa in position 35 is Asp, Glu, Gly, Asn, Ser or Thr
  Variant (37)..(37): xaa in position 37 is Phe, Ile, Leu or Met
  Variant (38)..(38): xaa in position 38 is any amino acid
  Variant (39)..(39): xaa in position 39 is Ala, Ile, Leu or Val
  Variant (40)..(40): xaa in position 40 is Ile, Leu or Val
  Variant (41)..(42): xaa in position 41 to 42 is any amino acid
  Variant (43)..(43): xaa in position 43 is Ile, Leu or Met
  Variant (44)..(47): xaa in position 44 to 47 is any amino acid
  Variant (48)..(48): xaa in position 48 is Asp, Glu, Gly, Asn, Gln, Ser or Thr
  Variant (49)..(49): xaa in position 49 is any amino acid
  Variant (50)..(50): xaa in position 50 is Phe, Ile, Leu, Met or Val
  Variant (51)..(51): xaa in position 51 is Phe, Ile, Leu or Val
  Variant (52)..(53): xaa in position 52 to 53 is any amino acid
  Variant (55)..(55): xaa in position 55 is Ala or Gly
  Variant (56)..(56): xaa in position 56 is Ile, Leu or Met
  Variant (57)..(58): xaa in position 57 to 58 is any amino acid
GXLXXXEXXXXXXXXXXXXXXXPXXXXXXGXKXXXKXXXXXXXXXXXXXXXXXGXXXXTF

SEQ ID NO: 57295 - protein, 62 aa, Artificial sequence
  Variant (2)..(2): xaa in position 2 is any amino acid
  Variant (3)..(3): xaa in position 3 is Ala or Gly
  Variant (4)..(5): xaa in position 4 to 5 is any amino acid
  Variant (6)..(6): xaa in position 6 is Ala, Ser or Thr
  Variant (7)..(13): xaa in position 7 to 13 is any amino acid
  Variant (14)..(14): xaa in position 14 is Phe, Ile, Leu, Met or Val
  Variant (15)..(16): xaa in position 15 to 16 is any amino acid
  Variant (17)..(17): xaa in position 17 is Ala, Cys, Ser, Thr or Val
  Variant (18)..(21): xaa in position 18 to 21 is any amino acid
  Variant (26)..(26): xaa in position 26 is any amino acid
  Variant (28)..(28): xaa in position 28 is any amino acid
  Variant (31)..(36): xaa in position 31 to 36 is any amino acid
  Variant (37)..(37): xaa in position 37 is Ala, Gly or Pro
  Variant (39)..(54): xaa in position 39 to 54 is any amino acid
  Variant (55)..(58): xaa in position 55 to 58 is any or no amino acid
  Variant (62)..(62): xaa in position 62 is Asp, Glu or Gly
DXXXXXXXXXXXXXXXXXXXXWNGPXGXFEXXXXXXXTXXXXXXXXXXXXXXXXXXXXGGGX

SEQ ID NO: 57296 - protein, 23 aa, Artificial sequence
  Variant (3)..(3): xaa in position 3 is Ala or Gly
  Variant (7)..(7): xaa in position 7 is any amino acid
  Variant (10)..(10): xaa in position 10 is any amino acid
  Variant (11)..(11): xaa in position 11 is Phe, Ile, Leu, Met or Val
  Variant (13)..(13): xaa in position 13 is any or no amino acid
  Variant (15)..(15): xaa in position 15 is any amino acid
  Variant (16)..(16): xaa in position 16 is any or no amino acid
  Variant (18)..(18): xaa in position 18 is any amino acid
  Variant (19)..(19): xaa in position 19 is Ala, Cys, Gly or Ser
  Variant (20)..(22): xaa in position 20 to 22 is any amino acid
  Variant (23)..(23): xaa in position 23 is Ile, Leu, Met or Val
STXGGAXLEXXEXGXXLXXXXXX

SEQ ID NO: 57297 - DNA, 1113 bp, Saccharomyces cerevisiae; identical to SEQ ID NO: 1363
  CDS (1)..(1113)

SEQ ID NO: 57298 - protein, 370 aa, Saccharomyces cerevisiae; identical to SEQ ID NO: 1364

SEQ ID NO: 57299 - DNA, 1086 bp, Deinococcus radiodurans; identical to SEQ ID NO: 1327
  CDS (1)..(1086)

SEQ ID NO: 57300 - protein, 361 aa, Deinococcus radiodurans; identical to SEQ ID NO: 1328

SEQ ID NO: 57301 - DNA, 1071 bp, Salmonella enterica subsp. enterica serovar Typhi; identical to SEQ ID NO: 2245
  CDS (1)..(1071)

SEQ ID NO: 57302 - protein, 356 aa, Salmonella enterica subsp. enterica serovar Typhi; identical to SEQ ID NO: 2246

SEQ ID NO: 57303 - DNA, 1071 bp, Yersinia pestis; identical to SEQ ID NO: 2247
  CDS (1)..(1071)

SEQ ID NO: 57304 - protein, 356 aa, Yersinia pestis; identical to SEQ ID NO: 2248

SEQ ID NO: 57305 - DNA, 1047 bp, Yersinia pestis; identical to SEQ ID NO: 1331
  CDS (1)..(1047)

SEQ ID NO: 57306 - protein, 348 aa, Yersinia pestis; identical to SEQ ID NO: 1332

SEQ ID NO: 57307 - DNA, 1053 bp, Escherichia coli; identical to SEQ ID NO: 2251
  CDS (1)..(1053)

SEQ ID NO: 57308 - protein, 350 aa, Escherichia coli; identical to SEQ ID NO: 1580

SEQ ID NO: 57309 - DNA, 1071 bp, Escherichia coli; identical to SEQ ID NO: 1333
  CDS (1)..(1071)

SEQ ID NO: 57310 - protein, 356 aa, Escherichia coli; identical to SEQ ID NO: 1334

SEQ ID NO: 57311 - DNA, 1131 bp, Nostoc sp. PCC 7120; identical to SEQ ID NO: 1335
  CDS (1)..(1131)

SEQ ID NO: 57312 - protein, 376 aa, Nostoc sp. PCC 7120; identical to SEQ ID NO: 1336

SEQ ID NO: 57313 - DNA, 1053 bp, Salmonella enterica subsp. enterica serovar Typhi; identical to SEQ ID NO: 1337
  CDS (1)..(1053)

SEQ ID NO: 57314 - protein, 350 aa, Salmonella enterica subsp. enterica serovar Typhi; identical to SEQ ID NO: 1338

SEQ ID NO: 57315 - DNA, 1077 bp, Pseudomonas aeruginosa; identical to SEQ ID NO: 1339
  CDS (1)..(1077)

SEQ ID NO: 57316 - protein, 358 aa, Pseudomonas aeruginosa; identical to SEQ ID NO: 1340

SEQ ID NO: 57317 - DNA, 1074 bp, Vibrio cholerae; identical to SEQ ID NO: 1343
  CDS (1)..(1074)

SEQ ID NO: 57318 - protein, 357 aa, Vibrio cholerae; identical to SEQ ID NO: 1344

SEQ ID NO: 57319 - DNA, 1038 bp, Lactococcus lactis subsp. lactis; identical to SEQ ID NO: 1345
  CDS (1)..(1038)

SEQ ID NO: 57320 - protein, 345 aa, Lactococcus lactis subsp. lactis; identical to SEQ ID NO: 1346

SEQ ID NO: 57321 - DNA, 1023 bp, Lactococcus lactis subsp. lactis; identical to SEQ ID NO: 1347
  CDS (1)..(1023)

SEQ ID NO: 57322 - protein, 340 aa, Lactococcus lactis subsp. lactis; identical to SEQ ID NO: 1348

SEQ ID NO: 57323 - DNA, 1032 bp, Streptococcus pneumoniae; identical to SEQ ID NO: 1349
  CDS (1)..(1032)

SEQ ID NO: 57324 - protein, 343 aa, Streptococcus pneumoniae; identical to SEQ ID NO: 1350

SEQ ID NO: 57325 - DNA, 1056 bp, Neisseria meningitidis; identical to SEQ ID NO: 2269
  CDS (1)..(1056)

SEQ ID NO: 57326 - protein, 351 aa, Neisseria meningitidis; identical to SEQ ID NO: 2270

SEQ ID NO: 57327 - DNA, 1095 bp, Pseudomonas aeruginosa; identical to SEQ ID NO: 1351
  CDS (1)..(1095)

SEQ ID NO: 57328 - protein, 364 aa, Pseudomonas aeruginosa; identical to SEQ ID NO: 1352

SEQ ID NO: 57329 - DNA, 1032 bp, Streptococcus pneumoniae; identical to SEQ ID NO: 1355
  CDS (1)..(1032)

SEQ ID NO: 57330 - protein, 343 aa, Streptococcus pneumoniae; identical to SEQ ID NO: 1356

SEQ ID NO: 57331 - DNA, 1143 bp, Xylella fastidiosa; identical to SEQ ID NO: 1603
  CDS (1)..(1143)

SEQ ID NO: 57332 - protein, 380 aa, Xylella fastidiosa; identical to SEQ ID NO: 1604

SEQ ID NO: 57333 - DNA, 1047 bp, Buchnera aphidicola; identical to SEQ ID NO: 1357
  CDS (1)..(1047)

SEQ ID NO: 57334 - protein, 348 aa, Buchnera aphidicola; identical to SEQ ID NO: 1358

SEQ ID NO: 57335 - DNA, 1104 bp, Corynebacterium glutamicum; identical to SEQ ID NO: 2279
  CDS (1)..(1104)

SEQ ID NO: 57336 - protein, 367 aa, Corynebacterium glutamicum; identical to SEQ ID NO: 2280

SEQ ID NO: 57337 - DNA, 1089 bp, Haemophilus influenzae; identical to SEQ ID NO: 1359
  CDS (1)..(1089)

SEQ ID NO: 57338 - protein, 362 aa, Haemophilus influenzae; identical to SEQ ID NO: 1360

SEQ ID NO: 57339 - DNA, 1502 bp, Candida albicans; identical to SEQ ID NO: 1361
  CDS (336)..(1442)

SEQ ID NO: 57340 - protein, 368 aa, Candida albicans; identical to SEQ ID NO: 1362

SEQ ID NO: 57341 - DNA, 2048 bp, Saccharomyces cerevisiae; identical to SEQ ID NO: 1365
  CDS (619)..(1731)

SEQ ID NO: 57342 - protein, 370 aa, Saccharomyces cerevisiae; identical to SEQ ID NO: 1366

SEQ ID NO: 57343 - DNA, 1107 bp, Schizosaccharomyces pombe; identical to SEQ ID NO: 1367
  CDS (1)..(1107)

SEQ ID NO: 57344 - protein, 368 aa, Schizosaccharomyces pombe; identical to SEQ ID NO: 1368

SEQ ID NO: 57345 - DNA, 1089 bp, Amycolatopsis orientalis; identical to SEQ ID NO: 1369
  CDS (1)..(1089)

SEQ ID NO: 57346 - protein, 362 aa, Amycolatopsis orientalis; identical to SEQ ID NO: 1370

SEQ ID NO: 57347 - DNA, 1119 bp, Schizosaccharomyces pombe; identical to SEQ ID NO: 1371
  CDS (1)..(1119)

SEQ ID NO: 57348 - protein, 372 aa, Schizosaccharomyces pombe; identical to SEQ ID NO: 1372

SEQ ID NO: 57349 - DNA, 1083 bp, Methylophilus methylotrophus; identical to SEQ ID NO: 1375
  CDS (1)..(1083)

SEQ ID NO: 57350 - protein, 360 aa, Methylophilus methylotrophus; identical to SEQ ID NO: 1376

SEQ ID NO: 57351 - DNA, 1770 bp, Debaryomyces hansenii; identical to SEQ ID NO: 2295
  CDS (1)..(1770)

SEQ ID NO: 57352 - protein, 589 aa, Debaryomyces hansenii; identical to SEQ ID NO: 2296

SEQ ID NO: 57353 - DNA, 1107 bp, Debaryomyces hansenii; identical to SEQ ID NO: 1377
  CDS (1)..(1107)

SEQ ID NO: 57354 - protein, 368 aa, Debaryomyces hansenii; identical to SEQ ID NO: 1378

SEQ ID NO: 57355 - DNA, 1074 bp, Yarrowia lipolytica; identical to SEQ ID NO: 1379
  CDS (1)..(1074)

SEQ ID NO: 57356 - protein, 357 aa, Yarrowia lipolytica; identical to SEQ ID NO: 1380

SEQ ID NO: 57357 - DNA, 1089 bp, Yarrowia lipolytica; identical to SEQ ID NO: 1381
  CDS (1)..(1089)

SEQ ID NO: 57358 - protein, 362 aa, Yarrowia lipolytica; identical to SEQ ID NO: 1382

SEQ ID NO: 57359 - DNA, 1119 bp, Kluyveromyces lactis; identical to SEQ ID NO: 1383
  CDS (1)..(1119)

SEQ ID NO: 57360 - protein, 372 aa, Kluyveromyces lactis; identical to SEQ ID NO: 1384

SEQ ID NO: 57361 - DNA, 1095 bp, Kluyveromyces lactis; identical to SEQ ID NO: 1385
  CDS (1)..(1095)

SEQ ID NO: 57362 - protein, 364 aa, Kluyveromyces lactis; identical to SEQ ID NO: 1386

SEQ ID NO: 57363 - DNA, 1074 bp, Erwinia carotovora subsp; identical to SEQ ID NO: 1387
  CDS (1)..(1074)

SEQ ID NO: 57364 - protein, 357 aa, Erwinia carotovora subsp; identical to SEQ ID NO: 1388

SEQ ID NO: 57365 - DNA, 1047 bp, Erwinia carotovora subsp; identical to SEQ ID NO: 1389
  CDS (1)..(1047)

SEQ ID NO: 57366 - protein, 348 aa, Erwinia carotovora subsp; identical to SEQ ID NO: 1390

SEQ ID NO: 57367 - DNA, 1056 bp, Erwinia carotovora subsp; identical to SEQ ID NO: 1391
  CDS (1)..(1056)

SEQ ID NO: 57368 - protein, 351 aa, Erwinia carotovora subsp; identical to SEQ ID NO: 1392

SEQ ID NO: 57369 - DNA, 1113 bp, Acinetobacter sp; identical to SEQ ID NO: 1393
  CDS (1)..(1113)

SEQ ID NO: 57370 - protein, 370 aa, Acinetobacter sp; identical to SEQ ID NO: 1394

SEQ ID NO: 57371 - DNA, 1056 bp, Acinetobacter sp; identical to SEQ ID NO: 1395
  CDS (1)..(1056)

SEQ ID NO: 57372 - protein, 351 aa, Acinetobacter sp; identical to SEQ ID NO: 1396

SEQ ID NO: 57373 - DNA, 1119 bp, Candida glabrata; identical to SEQ ID NO: 1397
  CDS (1)..(1119)

SEQ ID NO: 57374 - protein, 372 aa, Candida glabrata; identical to SEQ ID NO: 1398

SEQ ID NO: 57375 - DNA, 1071 bp, Candida glabrata; identical to SEQ ID NO: 1399
  CDS (1)..(1071)

SEQ ID NO: 57376 - protein, 356 aa, Candida glabrata; identical to SEQ ID NO: 1400

SEQ ID NO: 57377 - DNA, 1083 bp, Photobacterium profundum; identical to SEQ ID NO: 1401
  CDS (1)..(1083)

SEQ ID NO: 57378 - protein, 360 aa, Photobacterium profundum; identical to SEQ ID NO: 1402

SEQ ID NO: 57379 - DNA, 1053 bp, Photobacterium profundum; identical to SEQ ID NO: 1403
  CDS (1)..(1053)

SEQ ID NO: 57380 - protein, 350 aa, Photobacterium profundum; identical to SEQ ID NO: 1404

SEQ ID NO: 57381 - DNA, 1113 bp, Photobacterium profundum; identical to SEQ ID NO: 1405
  CDS (1)..(1113)

SEQ ID NO: 57382 - protein, 370 aa, Photobacterium profundum; identical to SEQ ID NO: 1406

SEQ ID NO: 57383 - DNA, 1056 bp, Photobacterium profundum; identical to SEQ ID NO: 1407
  CDS (1)..(1056)

SEQ ID NO: 57384 - protein, 351 aa, Photobacterium profundum; identical to SEQ ID NO: 1408

SEQ ID NO: 57385 - DNA, 1092 bp, Parachlamydia sp; identical to SEQ ID NO: 1409
  CDS (1)..(1092)

SEQ ID NO: 57386 - protein, 363 aa, Parachlamydia sp; identical to SEQ ID NO: 1410

SEQ ID NO: 57387 - DNA, 1095 bp, Rhodopseudomonas palustris; identical to SEQ ID NO: 1411
  CDS (1)..(1095)

SEQ ID NO: 57388 - protein, 364 aa, Rhodopseudomonas palustris; identical to SEQ ID NO: 1412

SEQ ID NO: 57389 - DNA, 1100 bp, Amycolatopsis methanolica; identical to SEQ ID NO: 1413
  CDS (1)..(1086)

SEQ ID NO: 57390 - protein, 361 aa, Amycolatopsis methanolica; identical to SEQ ID NO: 1414

SEQ ID NO: 57391 - DNA, 1071 bp, Treponema denticola; identical to SEQ ID NO: 1415
  CDS (1)..(1071)

SEQ ID NO: 57392 - protein, 356 aa, Treponema denticola; identical to SEQ ID NO: 1416

SEQ ID NO: 57393 - DNA, 1068 bp, Geobacter sulfurreducens; identical to SEQ ID NO: 1417
  CDS (1)..(1068)

SEQ ID NO: 57394 - protein, 355 aa, Geobacter sulfurreducens; identical to SEQ ID NO: 1418

SEQ ID NO: 57395 - DNA, 1095 bp, Ashbya gossypii; identical to SEQ ID NO: 1419
  CDS (1)..(1095)

SEQ ID NO: 57396 - protein, 364 aa, Ashbya gossypii; identical to SEQ ID NO: 1420

SEQ ID NO: 57397 - DNA, 1122 bp, Ashbya gossypii; identical to SEQ ID NO: 1421
  CDS (1)..(1122)

SEQ ID NO: 57398 - protein, 373 aa, Ashbya gossypii; identical to SEQ ID NO: 1422

SEQ ID NO: 57399 - DNA, 1098 bp, Amycolatopsis balhimycina; identical to SEQ ID NO: 1423
  CDS (1)..(1098)

SEQ ID NO: 57400 - protein, 365 aa, Amycolatopsis balhimycina; identical to SEQ ID NO: 1424

SEQ ID NO: 57401 - DNA, 1053 bp, Vibrio vulnificus; identical to SEQ ID NO: 2345
  CDS (1)..(1053)

SEQ ID NO: 57402 - protein, 350 aa, Vibrio vulnificus; identical to SEQ ID NO: 2346

SEQ ID NO: 57403 - DNA, 1047 bp, Photorhabdus luminescens; identical to SEQ ID NO: 1427
  CDS (1)..(1047)

SEQ ID NO: 57404 - protein, 348 aa, Photorhabdus luminescens; identical to SEQ ID NO: 1428

SEQ ID NO: 57405 - DNA, 1053 bp, Photorhabdus luminescens; identical to SEQ ID NO: 1429
  CDS (1)..(1053)

SEQ ID NO: 57406 - protein, 350 aa, Photorhabdus luminescens; identical to SEQ ID NO: 1430

SEQ ID NO: 57407 - DNA, 1095 bp, Photorhabdus luminescens; identical to SEQ ID NO: 1431
  CDS (1)..(1095)

SEQ ID NO: 57408 - protein, 364 aa, Photorhabdus luminescens; identical to SEQ ID NO: 1432

SEQ ID NO: 57409 - DNA, 1119 bp, Gloeobacter violaceus; identical to SEQ ID NO: 1433
  CDS (1)..(1119)

SEQ ID NO: 57410 - protein, 372 aa, Gloeobacter violaceus; identical to SEQ ID NO: 1434

SEQ ID NO: 57411 - DNA, 1107 bp, Chromobacterium violaceum; identical to SEQ ID NO: 1435
  CDS (1)..(1107)

SEQ ID NO: 57412 - protein, 368 aa, Chromobacterium violaceum; identical to SEQ ID NO: 1436

SEQ ID NO: 57413 - DNA, 1059 bp, Chromobacterium violaceum; identical to SEQ ID NO: 1437
  CDS (1)..(1059)

SEQ ID NO: 57414 - protein, 352 aa, Chromobacterium violaceum; identical to SEQ ID NO: 1438

SEQ ID NO: 57415 - DNA, 1140 bp, Neurospora crassa; identical to SEQ ID NO: 1439
  CDS (1)..(1140)

SEQ ID NO: 57416 - protein, 379 aa, Neurospora crassa; identical to SEQ ID NO: 1440

SEQ ID NO: 57417 - DNA, 1092 bp, Neurospora crassa; identical to SEQ ID NO: 1441
  CDS (1)..(1092)

SEQ ID NO: 57418 - protein, 363 aa, Neurospora crassa; identical to SEQ ID NO: 1442

SEQ ID NO: 57419 - DNA, 1068 bp, Synechococcus sp; identical to SEQ ID NO: 1443
  CDS (1)..(1068)

SEQ ID NO: 57420 - protein, 355 aa, Synechococcus sp; identical to SEQ ID NO: 1444

SEQ ID NO: 57421 - DNA, 1053 bp, Rhodopirellula baltica; identical to SEQ ID NO: 1445
  CDS (1)..(1053)

SEQ ID NO: 57422 - protein, 350 aa, Rhodopirellula baltica; identical to SEQ ID NO: 1446

SEQ ID NO: 57423 - DNA, 1068 bp, Prochlorococcus marinus subsp; identical to SEQ ID NO: 1447
  CDS (1)..(1068)

SEQ ID NO: 57424 - protein, 355 aa, Prochlorococcus marinus subsp; identical to SEQ ID NO: 1448

SEQ ID NO: 57425 - DNA, 1083 bp, Prochlorococcus marinus; identical to SEQ ID NO: 1449
  CDS (1)..(1083)

SEQ ID NO: 57426 - protein, 360 aa, Prochlorococcus marinus; identical to SEQ ID NO: 1450

SEQ ID NO: 57427 - DNA, 1074 bp, Prochlorococcus marinus; identical to SEQ ID NO: 1451
  CDS (1)..(1074)

SEQ ID NO: 57428 - protein, 357 aa, Prochlorococcus marinus; identical to SEQ ID NO: 1452

SEQ ID NO: 57429 - DNA, 1113 bp, Haemophilus ducreyi; identical to SEQ ID NO: 1453
  CDS (1)..(1113)

SEQ ID NO: 57430 - protein, 370 aa, Haemophilus ducreyi; identical to SEQ ID NO: 1454

SEQ ID NO: 57431 - DNA, 1080 bp, Haemophilus ducreyi; identical to SEQ ID NO: 1455
  CDS (1)..(1080)

SEQ ID NO: 57432 - protein, 359 aa, Haemophilus ducreyi; identical to SEQ ID NO: 1456

SEQ ID NO: 57433 - DNA, 1086 bp, Candidatus Blochmannia floridanus; identical to SEQ ID NO: 1457
  CDS (1)..(1086)

SEQ ID NO: 57434 - protein, 361 aa, Candidatus Blochmannia floridanus; identical to SEQ ID NO: 1458

SEQ ID NO: 57435 - DNA, 1074 bp, Bordetella pertussis; identical to SEQ ID NO: 2379
  CDS (1)..(1074)

SEQ ID NO: 57436 - protein, 357 aa, Bordetella pertussis; identical to SEQ ID NO: 1460

SEQ ID NO: 57437 - DNA, 1119 bp, Bordetella bronchiseptica; identical to SEQ ID NO: 1461
  CDS (1)..(1119)

SEQ ID NO: 57438 - protein, 372 aa, Bordetella bronchiseptica; identical to SEQ ID NO: 1462

SEQ ID NO: 57439 - DNA, 1179 bp, Nitrosomonas europaea; identical to SEQ ID NO: 1463
  CDS (1)..(1179)

SEQ ID NO: 57440 - protein, 392 aa, Nitrosomonas europaea; identical to SEQ ID NO: 1464

SEQ ID NO: 57441 - DNA, 1083 bp, Coxiella burnetii; identical to SEQ ID NO: 1465
  CDS (1)..(1083)

SEQ ID NO: 57442 - protein, 360 aa, Coxiella burnetii; identical to SEQ ID NO: 1466

SEQ ID NO: 57443 - DNA, 1053 bp, Vibrio parahaemolyticus; identical to SEQ ID NO: 1471
  CDS (1)..(1053)

SEQ ID NO: 57444 - protein, 350 aa, Vibrio parahaemolyticus; identical to SEQ ID NO: 1472

SEQ ID NO: 57445 - DNA, 1053 bp, Vibrio parahaemolyticus; identical to SEQ ID NO: 1473
  CDS (1)..(1053)

SEQ ID NO: 57446 - protein, 350 aa, Vibrio parahaemolyticus; identical to SEQ ID NO: 1474

SEQ ID NO: 57447 - DNA, 1074 bp, Vibrio parahaemolyticus; identical to SEQ ID NO: 1475
  CDS (1)..(1074)

SEQ ID NO: 57448 - protein, 357 aa, Vibrio parahaemolyticus; identical to SEQ ID NO: 1476

SEQ ID NO: 57449 - DNA, 1083 bp, Pseudomonas syringae; identical to SEQ ID NO: 1477
  CDS (1)..(1083)

SEQ ID NO: 57450 - protein, 360 aa, Pseudomonas syringae; identical to SEQ ID NO: 1478

SEQ ID NO: 57451 - DNA, 1077 bp, Pseudomonas syringae; identical to SEQ ID NO: 1479
  CDS (1)..(1077)

SEQ ID NO: 57452 - protein, 358 aa, Pseudomonas syringae; identical to SEQ ID NO: 1480

SEQ ID NO: 57453 - DNA, 1062 bp, Pseudomonas putida; identical to SEQ ID NO: 1481
  CDS (1)..(1062)

SEQ ID NO: 57454 - protein, 353 aa, Pseudomonas putida; identical to SEQ ID NO: 1482

SEQ ID NO: 57455 - DNA, 1113 bp, Pseudomonas putida; identical to SEQ ID NO: 1483
  CDS (1)..(1113)

SEQ ID NO: 57456 - protein, 370 aa, Pseudomonas putida; identical to SEQ ID NO: 1484

SEQ ID NO: 57457 - DNA, 1086 bp, Bradyrhizobium japonicum; identical to SEQ ID NO: 1485
  CDS (1)..(1086)

SEQ ID NO: 57458 - protein, 361 aa, Bradyrhizobium japonicum; identical to SEQ ID NO: 1486

SEQ ID NO: 57459 - DNA, 1053 bp, Yersinia pestis; identical to SEQ ID NO: 1487
  CDS (1)..(1053)

SEQ ID NO: 57460 - protein, 350 aa, Yersinia pestis; identical to SEQ ID NO: 1488

SEQ ID NO: 57461 - DNA, 1038 bp, Wigglesworthia glossinidia brevipalpis; identical to SEQ ID NO: 1491
  CDS (1)..(1038)

SEQ ID NO: 57462 - protein, 345 aa, Wigglesworthia glossinidia brevipalpis; identical to SEQ ID NO: 1492

SEQ ID NO: 57463 - DNA, 1071 bp, Vibrio vulnificus; identical to SEQ ID NO: 1739
  CDS (1)..(1071)

SEQ ID NO: 57464 - protein, 356 aa, Vibrio vulnificus; identical to SEQ ID NO: 1740

SEQ ID NO: 57465 - DNA, 1053 bp, Vibrio vulnificus; identical to SEQ ID NO: 1493
  CDS (1)..(1053)

SEQ ID NO: 57466 - protein, 350 aa, Vibrio vulnificus; identical to SEQ ID NO: 1494

SEQ ID NO: 57467 - DNA, 1071 bp, Vibrio vulnificus; identical to SEQ ID NO: 1497
  CDS (1)..(1071)

SEQ ID NO: 57468 - protein, 356 aa, Vibrio vulnificus; identical to SEQ ID NO: 1498

SEQ ID NO: 57469 - DNA, 1062 bp, Synechococcus elongatus; identical to SEQ ID NO: 1499
  CDS (1)..(1062)

SEQ ID NO: 57470 - protein, 353 aa, Synechococcus elongatus; identical to SEQ ID NO: 1500

SEQ ID NO: 57471 - DNA, 1032 bp, Streptococcus mutans; identical to SEQ ID NO: 1501
  CDS (1)..(1032)

SEQ ID NO: 57472 - protein, 343 aa, Streptococcus mutans; identical to SEQ ID NO: 1502

SEQ ID NO: 57473 - DNA, 1035 bp, Streptococcus mutans; identical to SEQ ID NO: 1503
  CDS (1)..(1035)

SEQ ID NO: 57474 - protein, 344 aa, Streptococcus mutans; identical to SEQ ID NO: 1504

SEQ ID NO: 57475 - DNA, 1008 bp, Streptococcus agalactiae; identical to SEQ ID NO: 1505
  CDS (1)..(1008)

SEQ ID NO: 57476 - protein, 335 aa, Streptococcus agalactiae; identical to SEQ ID NO: 1506

SEQ ID NO: 57477 - DNA, 1065 bp, Shewanella oneidensis; identical to SEQ ID NO: 1507
  CDS (1)..(1065)

SEQ ID NO: 57478 - protein, 354 aa, Shewanella oneidensis; identical to SEQ ID NO: 1508

SEQ ID NO: 57479 - DNA, 1092 bp, Shewanella oneidensis; identical to SEQ ID NO: 1509
  CDS (1)..(1092)

SEQ ID NO: 57480 - protein, 363 aa, Shewanella oneidensis; identical to SEQ ID NO: 1510

SEQ ID NO: 57481 - DNA, 1059 bp, Shewanella oneidensis; identical to SEQ ID NO: 1511
  CDS (1)..(1059)

SEQ ID NO: 57482 - protein, 352 aa, Shewanella oneidensis; identical to SEQ ID NO: 1512

SEQ ID NO: 57483 - DNA, 1170 bp, Corynebacterium efficiens; identical to SEQ ID NO: 1515
  CDS (1)..(1170)

SEQ ID NO: 57484 - protein, 389 aa, Corynebacterium efficiens; identical to SEQ ID NO: 1516

SEQ ID NO: 57485 - DNA, 1134 bp, Bifidobacterium longum; identical to SEQ ID NO: 1517
  CDS (1)..(1134)

SEQ ID NO: 57486 - protein, 377 aa, Bifidobacterium longum; identical to SEQ ID NO: 1518

SEQ ID NO: 57487 - DNA, 1233 bp, Bifidobacterium longum; identical to SEQ ID NO: 1519
  CDS (1)..(1233)

SEQ ID NO: 57488 - protein, 410 aa, Bifidobacterium longum; identical to SEQ ID NO: 1520

SEQ ID NO: 57489 - DNA, 1221 bp, Phytophthora infestans; identical to SEQ ID NO: 1521
  CDS (20)..(1153)

SEQ ID NO: 57490 - protein, 377 aa, Phytophthora infestans; identical to SEQ ID NO: 1522

SEQ ID NO: 57491 - DNA, 1062 bp, Chlorobium tepidum; identical to SEQ ID NO: 1523
  CDS (1)..(1062)

SEQ ID NO: 57492 - protein, 353 aa, Chlorobium tepidum; identical to SEQ ID NO: 1524

SEQ ID NO: 57493 - DNA, 1074 bp, Xanthomonas campestris; identical to SEQ ID NO: 1525
  CDS (1)..(1074)

SEQ ID NO: 57494 - protein, 357 aa, Xanthomonas campestris; identical to SEQ ID NO: 1526

SEQ ID NO: 57495 - DNA, 1074 bp, Xanthomonas axonopodis; identical to SEQ ID NO: 1527
  CDS (1)..(1074)

SEQ ID NO: 57496 - protein, 357 aa, Xanthomonas axonopodis; identical to SEQ ID NO: 1528

SEQ ID NO: 57497 - DNA, 1080 bp, Ralstonia solanacearum; identical to SEQ ID NO: 1529
  CDS (1)..(1080)

SEQ ID NO: 57498 - protein, 359 aa, Ralstonia solanacearum; identical to SEQ ID NO: 1530

SEQ ID NO: 57499 - DNA, 1179 bp, Ralstonia solanacearum; identical to SEQ ID NO: 1531
  CDS (1)..(1179)

SEQ ID NO: 57500 - protein, 392 aa, Ralstonia solanacearum; identical to SEQ ID NO: 1532

SEQ ID NO: 57501 - DNA, 1065 bp, Synechococcus sp; identical to SEQ ID NO: 1533
  CDS (1)..(1065)

SEQ ID NO: 57502 - protein, 354 aa, Synechococcus sp; identical to SEQ ID NO: 1534

SEQ ID NO: 57503 - DNA, 1035 bp, Escherichia coli; identical to SEQ ID NO: 1535
  CDS (1)..(1035)

SEQ ID NO: 57504 - protein, 344 aa, Escherichia coli; identical to SEQ ID NO: 1536

SEQ ID NO: 57505 - DNA, 1200 bp, Stigmatella aurantiaca; identical to SEQ ID NO: 1537
  CDS (62)..(1147)

SEQ ID NO: 57506 - protein, 361 aa, Stigmatella aurantiaca; identical to SEQ ID NO: 1538

SEQ ID NO: 57507 - DNA, 1083 bp, Amycolatopsis mediterranei; identical to SEQ ID NO: 1541
  CDS (1)..(1083)

SEQ ID NO: 57508 - protein, 360 aa, Amycolatopsis mediterranei; identical to SEQ ID NO: 1542

SEQ ID NO: 57509 - DNA, 1053 bp, Pasteurella multocida; identical to SEQ ID NO: 1543
  CDS (1)..(1053)

SEQ ID NO: 57510 - protein, 350 aa, Pasteurella multocida; identical to SEQ ID NO: 1544

SEQ ID NO: 57511 - DNA, 1086 bp, Pasteurella multocida; identical to SEQ ID NO: 1545
  CDS (1)..(1086)

SEQ ID NO: 57512 - protein, 361 aa, Pasteurella multocida; identical to SEQ ID NO: 1546

SEQ ID NO: 57513 - DNA, 1125 bp, Emericella nidulans; identical to SEQ ID NO: 1547
  CDS (1)..(1125)

SEQ ID NO: 57514 - protein, 374 aa, Emericella nidulans; identical to SEQ ID NO: 1548

SEQ ID NO: 57515 - DNA, 1089 bp, Emericella nidulans; identical to SEQ ID NO: 1549
  CDS (1)..(1089)

SEQ ID NO: 57516 - protein, 362 aa, Emericella nidulans; identical to SEQ ID NO: 1550

SEQ ID NO: 57517 - DNA, 1239 bp, Vibrio cholerae; identical to SEQ ID NO: 1551
  CDS (114)..(1175)

SEQ ID NO: 57518 - protein, 353 aa, Vibrio cholerae; identical to SEQ ID NO: 1552

SEQ ID NO: 57519 - DNA, 2184 bp, Candida albicans; identical to SEQ ID NO: 1553
  CDS (461)..(1573)

SEQ ID NO: 57520 - protein, 370 aa, Candida albicans; identical to SEQ ID NO: 1554

SEQ ID NO: 57521 - DNA, 1047 bp, Buchnera aphidicola; identical to SEQ ID NO: 1555
  CDS (1)..(1047)

SEQ ID NO: 57522 - protein, 348 aa, Buchnera aphidicola; identical to SEQ ID NO: 1556

SEQ ID NO: 57523 - DNA, 1047 bp, Buchnera aphidicola; identical to SEQ ID NO: 1557
  CDS (1)..(1047)

SEQ ID NO: 57524 - protein, 348 aa, Buchnera aphidicola; identical to SEQ ID NO: 1558

SEQ ID NO: 57525 - DNA, 1047 bp, Erwinia herbicola; identical to SEQ ID NO: 1559
  CDS (1)..(1047)

SEQ ID NO: 57526 - protein, 348 aa, Erwinia herbicola; identical to SEQ ID NO: 1560

SEQ ID NO: 57527 - DNA, 1047 bp, Salmonella typhimurium; identical to SEQ ID NO: 1561
  CDS (1)..(1047)

SEQ ID NO: 57528 - protein, 348 aa, Salmonella typhimurium; identical to SEQ ID NO: 1562

SEQ ID NO: 57529 - DNA, 1047 bp, Shigella flexneri; identical to SEQ ID NO: 2473
  CDS (1)..(1047)

SEQ ID NO: 57530 - protein, 348 aa, Shigella flexneri; identical to SEQ ID NO: 2474

SEQ ID NO: 57531 - DNA, 25 bp, Artificial sequence
  (1)..(25): primer
atgttcattaaaaacgatcacgccg

SEQ ID NO: 57532 - DNA, 25 bp, Artificial sequence
  (1)..(25): primer
ctattttttcaaggcctttcttctg

SEQ ID NO: 57533 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 57534 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 57535 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 57536 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 57537 - DNA, 1755 bp, Saccharomyces cerevisiae; identical to SEQ ID NO: 7718
  CDS (1)..(1755)

SEQ ID NO: 57538 - protein, 584 aa, Saccharomyces cerevisiae; identical to SEQ ID NO: 7719

SEQ ID NO: 57539 - DNA, 1560 bp, Glycine max; identical to SEQ ID NO: 7720
  CDS (1)..(1560)

SEQ ID NO: 57540 - protein, 519 aa, Glycine max; identical to SEQ ID NO: 7721

SEQ ID NO: 57541 - DNA, 1536 bp, Glycine max; identical to SEQ ID NO: 7722
  CDS (1)..(1536)

SEQ ID NO: 57542 - protein, 511 aa, Glycine max; identical to SEQ ID NO: 7723

SEQ ID NO: 57543 - DNA, 2856 bp, Homo sapiens (man); identical to SEQ ID NO: 7724
  CDS (180)..(1658)

SEQ ID NO: 57544 - protein, 492 aa, Homo sapiens (man); identical to SEQ ID NO: 7725

SEQ ID NO: 57545 - DNA, 2487 bp, Oryctolagus cuniculus (domestic rabbit); identical to SEQ ID NO: 7726
  CDS (124)..(1602)

SEQ ID NO: 57546 - protein, 492 aa, Oryctolagus cuniculus (domestic rabbit); identical to SEQ ID NO: 7727

SEQ ID NO: 57547 - DNA, 3642 bp, Saccharomyces cerevisiae; identical to SEQ ID NO: 7728
  CDS (551)..(3205)

SEQ ID NO: 57548 - protein, 884 aa, Saccharomyces cerevisiae; identical to SEQ ID NO: 168

SEQ ID NO: 57549 - DNA, 1774 bp, Mus musculus (house mouse); identical to SEQ ID NO: 7730
  CDS (80)..(1561)

SEQ ID NO: 57550 - protein, 493 aa, Mus musculus (house mouse); identical to SEQ ID NO: 7731

SEQ ID NO: 57551 - DNA, 2798 bp, Leishmania donovani; identical to SEQ ID NO: 7732
  CDS (676)..(2319)

SEQ ID NO: 57552 - protein, 547 aa, Leishmania donovani; identical to SEQ ID NO: 7733

SEQ ID NO: 57553 - DNA, 1536 bp, Arabidopsis thaliana (mouse-ear cress); identical to SEQ ID NO: 7734
  CDS (1)..(1536)

SEQ ID NO: 57554 - protein, 511 aa, Arabidopsis thaliana (mouse-ear cress); identical to SEQ ID NO: 7735

SEQ ID NO: 57555 - DNA, 1482 bp, Arabidopsis thaliana (mouse-ear cress); identical to SEQ ID NO: 7736
  CDS (1)..(1482)

SEQ ID NO: 57556 - protein, 493 aa, Arabidopsis thaliana (mouse-ear cress); identical to SEQ ID NO: 172

SEQ ID NO: 57557 - DNA, 1395 bp, Salmonella enterica subsp. enterica serovar Typhi; identical to SEQ ID NO: 7738
  CDS (1)..(1395)

SEQ ID NO: 57558 - protein, 464 aa, Salmonella enterica subsp. enterica serovar Typhi; identical to SEQ ID NO: 7739

SEQ ID NO: 57559 - DNA, 2568 bp, Saccharomyces cerevisiae; identical to SEQ ID NO: 7740
  CDS (461)..(2299)

SEQ ID NO: 57560 - protein, 612 aa, Saccharomyces cerevisiae; identical to SEQ ID NO: 7741

SEQ ID NO: 57561 - DNA, 1449 bp, Bacillus subtilis; identical to SEQ ID NO: 173
  CDS (1)..(1449)

SEQ ID NO: 57562 - protein, 482 aa, Bacillus subtilis; identical to SEQ ID NO: 174

SEQ ID NO: 57563 - DNA, 1644 bp, Arabidopsis thaliana (mouse-ear cress); identical to SEQ ID NO: 175
  CDS (1)..(1644)

SEQ ID NO: 57564 - protein, 547 aa, Arabidopsis thaliana (mouse-ear cress); identical to SEQ ID NO: 176

SEQ ID NO: 57565 - DNA, 1560 bp, Caulobacter crescentus; identical to SEQ ID NO: 7746
  CDS (1)..(1560)

SEQ ID NO: 57566 - protein, 519 aa, Caulobacter crescentus; identical to SEQ ID NO: 7747

SEQ ID NO: 57567 - DNA, 1386 bp, Bacillus subtilis; identical to SEQ ID NO: 7748
  CDS (1)..(1386)

SEQ ID NO: 57568 - protein, 461 aa, Bacillus subtilis; identical to SEQ ID NO: 7749

SEQ ID NO: 57569 - DNA, 1743 bp, Arabidopsis thaliana (mouse-ear cress); identical to SEQ ID NO: 7750
  CDS (1)..(1743)

SEQ ID NO: 57570 - protein, 580 aa, Arabidopsis thaliana (mouse-ear cress); identical to SEQ ID NO: 7751

SEQ ID NO: 57571 - DNA, 1774 bp, Arabidopsis thaliana (mouse-ear cress); identical to SEQ ID NO: 7752
  CDS (1)..(1743)

SEQ ID NO: 57572 - protein, 580 aa, Arabidopsis thaliana (mouse-ear cress); identical to SEQ ID NO: 7753

SEQ ID NO: 57573 - DNA, 1554 bp, Arabidopsis thaliana (mouse-ear cress); identical to SEQ ID NO: 7754
  CDS (1)..(1554)

SEQ ID NO: 57574 - protein, 517 aa, Arabidopsis thaliana (mouse-ear cress); identical to SEQ ID NO: 7755

SEQ ID NO: 57575 - DNA, 1260 bp, Bacillus subtilis; identical to SEQ ID NO: 7756
  CDS (1)..(1260)

SEQ ID NO: 57576 - protein, 419 aa, Bacillus subtilis; identical to SEQ ID NO: 7757

SEQ ID NO: 57577 - DNA, 1518 bp, Bacillus subtilis; identical to SEQ ID NO: 7758
  CDS (16)..(1389)

SEQ ID NO: 57578 - protein, 457 aa, Bacillus subtilis; identical to SEQ ID NO: 7759

SEQ ID NO: 57579 - DNA, 1695 bp, Arabidopsis thaliana (mouse-ear cress); identical to SEQ ID NO: 7760
  CDS (12)..(1475)

SEQ ID NO: 57580 - protein, 487 aa, Arabidopsis thaliana (mouse-ear cress); identical to SEQ ID NO: 7761

SEQ ID NO: 57581 - DNA, 1395 bp, Bacillus subtilis; identical to SEQ ID NO: 177
  CDS (1)..(1395)

SEQ ID NO: 57582 - protein, 464 aa, Bacillus subtilis; identical to SEQ ID NO: 178

SEQ ID NO: 57583 - DNA, 1780 bp, Arabidopsis thaliana (mouse-ear cress); identical to SEQ ID NO: 7764
  CDS (1)..(1749)

SEQ ID NO: 57584 - protein, 582 aa, Arabidopsis thaliana (mouse-ear cress); identical to SEQ ID NO: 7765

SEQ ID NO: 57585 - DNA, 1368 bp, Clostridium acetobutylicum; identical to SEQ ID NO: 7766
  CDS (1)..(1368)

SEQ ID NO: 57586 - protein, 455 aa, Clostridium acetobutylicum; identical to SEQ ID NO: 7767

SEQ ID NO: 57587 - DNA, 1422 bp, Bacillus subtilis; identical to SEQ ID NO: 7768
  CDS (1)..(1422)

SEQ ID NO: 57588 - protein, 473 aa, Bacillus subtilis; identical to SEQ ID NO: 7769

SEQ ID NO: 57589 - DNA, 1566 bp, Arabidopsis thaliana (mouse-ear cress); identical to SEQ ID NO: 181
  CDS (1)..(1566)

SEQ ID NO: 57590 - protein, 521 aa, Arabidopsis thaliana (mouse-ear cress); identical to SEQ ID NO: 182

SEQ ID NO: 57591 - DNA, 1302 bp, Lactococcus lactis subsp. lactis; identical to SEQ ID NO: 7772
  CDS (1)..(1302)

SEQ ID NO: 57592 - protein, 433 aa, Lactococcus lactis subsp. lactis; identical to SEQ ID NO: 7773

SEQ ID NO: 57593 - DNA, 1536 bp, Arabidopsis thaliana (mouse-ear cress); identical to SEQ ID NO: 183
  CDS (1)..(1536)

SEQ ID NO: 57594 - protein, 511 aa, Arabidopsis thaliana (mouse-ear cress); identical to SEQ ID NO: 184

SEQ ID NO: 57595 - DNA, 1410 bp, Clostridium acetobutylicum; identical to SEQ ID NO: 185
  CDS (1)..(1410)

SEQ ID NO: 57596 - protein, 469 aa, Clostridium acetobutylicum; identical to SEQ ID NO: 186

SEQ ID NO: 57597 - DNA, 2890 bp, Saccharomyces cerevisiae; identical to SEQ ID NO: 189
  CDS (818)..(2443)

SEQ ID NO: 57598 - protein, 541 aa, Saccharomyces cerevisiae; identical to SEQ ID NO: 190

SEQ ID NO: 57599 - DNA, 2613 bp, Mus musculus (house mouse); identical to SEQ ID NO: 7780
  CDS (180)..(1658)

SEQ ID NO: 57600 - protein, 492 aa, Mus musculus (house mouse); identical to SEQ ID NO: 7781

SEQ ID NO: 57601 - DNA, 1559 bp, Synechocystis sp; identical to SEQ ID NO: 7782
  CDS (92)..(1498)

SEQ ID NO: 57602 - protein, 468 aa, Synechocystis sp; identical to SEQ ID NO: 7783

SEQ ID NO: 57603 - DNA, 1704 bp, Kluyveromyces marxianus var. lactis, Candida sphaerica; identical to SEQ ID NO: 193
  CDS (1)..(1704)

SEQ ID NO: 57604 - protein, 567 aa, Kluyveromyces marxianus var. lactis, Candida sphaerica; identical to SEQ ID NO: 194

SEQ ID NO: 57605 - DNA, 1545 bp, Arabidopsis thaliana (mouse-ear cress); identical to SEQ ID NO: 7786
  CDS (1)..(1545)

SEQ ID NO: 57606 - protein, 514 aa, Arabidopsis thaliana (mouse-ear cress); identical to SEQ ID NO: 7787

SEQ ID NO: 57607 - DNA, 1853 bp, Nicotiana tabacum (common tobacco); identical to SEQ ID NO: 7788
  CDS (103)..(1674)

SEQ ID NO: 57608 - protein, 523 aa, Nicotiana tabacum (common tobacco); identical to SEQ ID NO: 7789

SEQ ID NO: 57609 - DNA, 2114 bp, Saccharomyces cerevisiae; identical to SEQ ID NO: 7790
  CDS (373)..(2076)

SEQ ID NO: 57610 - protein, 567 aa, Saccharomyces cerevisiae; identical to SEQ ID NO: 196

SEQ ID NO: 57611 - DNA, 1605 bp, Chlorella kessleri; identical to SEQ ID NO: 7792
  CDS (1)..(1605)

SEQ ID NO: 57612 - protein, 534 aa, Chlorella kessleri; identical to SEQ ID NO: 7793

SEQ ID NO: 57613 - DNA, 2160 bp, Saccharomyces cerevisiae; identical to SEQ ID NO: 197
  CDS (216)..(1928)

SEQ ID NO: 57614 - protein, 570 aa, Saccharomyces cerevisiae; identical to SEQ ID NO: 198

SEQ ID NO: 57615 - DNA, 1673 bp, Rattus norvegicus (Norway rat); identical to SEQ ID NO: 7796
  CDS (85)..(1566)

SEQ ID NO: 57616 - protein, 493 aa, Rattus norvegicus (Norway rat); identical to SEQ ID NO: 7797

SEQ ID NO: 57617 - DNA, 2209 bp, Saccharomyces cerevisiae; identical to SEQ ID NO: 7798
  CDS (213)..(1925)

SEQ ID NO: 57618 - protein, 570 aa, Saccharomyces cerevisiae; identical to SEQ ID NO: 7799

SEQ ID NO: 57619 - DNA, 3025 bp, Saccharomyces cerevisiae; identical to SEQ ID NO: 201
  CDS (510)..(2288)

SEQ ID NO: 57620 - protein, 592 aa, Saccharomyces cerevisiae; identical to SEQ ID NO: 202

SEQ ID NO: 57621 - DNA, 1683 bp, Saccharomyces cerevisiae; identical to SEQ ID NO: 7802
  CDS (1)..(1683)

SEQ ID NO: 57622 - protein, 560 aa, Saccharomyces cerevisiae; identical to SEQ ID NO: 7803

SEQ ID NO: 57623 - DNA, 1463 bp, Klebsiella oxytoca; identical to SEQ ID NO: 7804
  CDS (27)..(1445)

SEQ ID NO: 57624 - protein, 472 aa, Klebsiella oxytoca; identical to SEQ ID NO: 7805

SEQ ID NO: 57625 - DNA, 1641 bp, Saccharomyces cerevisiae; identical to SEQ ID NO: 203
  CDS (1)..(1641)

SEQ ID NO: 57626 - protein, 546 aa, Saccharomyces cerevisiae; identical to SEQ ID NO: 204

SEQ ID NO: 57627 - DNA, 1695 bp, Saccharomyces cerevisiae; identical to SEQ ID NO: 205
  CDS (1)..(1695)

SEQ ID NO: 57628 - protein, 564 aa, Saccharomyces cerevisiae; identical to SEQ ID NO: 206

SEQ ID NO: 57629 - DNA, 3277 bp, Saccharomyces cerevisiae; identical to SEQ ID NO: 207
  CDS (802)..(2505)

SEQ ID NO: 57630 - protein, 567 aa, Saccharomyces cerevisiae; identical to SEQ ID NO: 208

SEQ ID NO: 57631 - DNA, 1710 bp, Saccharomyces cerevisiae; identical to SEQ ID NO: 209
  CDS (1)..(1710)

SEQ ID NO: 57632 - protein, 569 aa, Saccharomyces cerevisiae; identical to SEQ ID NO: 210

SEQ ID NO: 57633 - DNA, 1701 bp, Kluyveromyces marxianus var. lactis, Candida sphaerica; identical to SEQ ID NO: 211
  CDS (1)..(1701)

SEQ ID NO: 57634 - protein, 566 aa, Kluyveromyces marxianus var. lactis, Candida sphaerica; identical to SEQ ID NO: 212

SEQ ID NO: 57635 - DNA, 1704 bp, Saccharomyces cerevisiae; identical to SEQ ID NO: 7816
  CDS (1)..(1704)

SEQ ID NO: 57636 - protein, 567 aa, Saccharomyces cerevisiae; identical to SEQ ID NO: 7817

SEQ ID NO: 57637 - DNA, 3323 bp, Saccharomyces cerevisiae; identical to SEQ ID NO: 217
  CDS (1189)..(2883)

SEQ ID NO: 57638 - protein, 564 aa, Saccharomyces cerevisiae; identical to SEQ ID NO: 218

SEQ ID NO: 57639 - DNA, 3143 bp, Saccharomyces cerevisiae; identical to SEQ ID NO: 219
  CDS (962)..(2686)

SEQ ID NO: 57640 - protein, 574 aa, Saccharomyces cerevisiae; identical to SEQ ID NO: 220

SEQ ID NO: 57641 - DNA, 4409 bp, Saccharomyces cerevisiae; identical to SEQ ID NO: 221
  CDS (1233)..(3524)

SEQ ID NO: 57642 - protein, 763 aa, Saccharomyces cerevisiae; identical to SEQ ID NO: 222

SEQ ID NO: 57643 - DNA, 1668 bp, Saccharomyces cerevisiae; identical to SEQ ID NO: 7824
  CDS (1)..(1668)

SEQ ID NO: 57644 - protein, 555 aa, Saccharomyces cerevisiae; identical to SEQ ID NO: 7825

SEQ ID NO: 57645 - DNA, 1542 bp, Arabidopsis thaliana (mouse-ear cress); identical to SEQ ID NO: 7826
  CDS (1)..(1542)

SEQ ID NO: 57646 - protein, 513 aa, Arabidopsis thaliana (mouse-ear cress); identical to SEQ ID NO: 7827

SEQ ID NO: 57647 - DNA, 1524 bp, Arabidopsis thaliana (mouse-ear cress); identical to SEQ ID NO: 7828
  CDS (1)..(1524)

SEQ ID NO: 57648 - protein, 507 aa, Arabidopsis thaliana (mouse-ear cress); identical to SEQ ID NO: 7829

SEQ ID NO: 57649 - DNA, 1868 bp, Arabidopsis thaliana (mouse-ear cress); identical to SEQ ID NO: 7830
  CDS (73)..(1653)

SEQ ID NO: 57650 - protein, 526 aa, Arabidopsis thaliana (mouse-ear cress); identical to SEQ ID NO: 7831

SEQ ID NO: 57651 - DNA, 1527 bp, Arabidopsis thaliana (mouse-ear cress); identical to SEQ ID NO: 7832
  CDS (1)..(1527)

SEQ ID NO: 57652 - protein, 508 aa, Arabidopsis thaliana (mouse-ear cress); identical to SEQ ID NO: 7833

SEQ ID NO: 57653 - DNA, 2118 bp, Lycopersicon esculentum (tomato); identical to SEQ ID NO: 7834
  CDS (93)..(1664)

SEQ ID NO: 57654 - protein, 523 aa, Lycopersicon esculentum (tomato); identical to SEQ ID NO: 7835

SEQ ID NO: 57655 - DNA, 1779 bp, Ricinus communis (castor bean); identical to SEQ ID NO: 7836
  CDS (86)..(1657)

SEQ ID NO: 57656 - protein, 523 aa, Ricinus communis (castor bean); identical to SEQ ID NO: 7837

SEQ ID NO: 57657 - DNA, 1966 bp, Ricinus communis (castor bean); identical to SEQ ID NO: 7838
  CDS (63)..(1595): n means a or g or c or t/u, s means g or c

SEQ ID NO: 57658 - protein, 510 aa, Ricinus communis (castor bean); identical to SEQ ID NO: 7839
  Xaa in positions 117 and 122 is unknown

SEQ ID NO: 57659 - DNA, 1861 bp, Ricinus communis (castor bean); identical to SEQ ID NO: 7840
  CDS (102)..(1670)

SEQ ID NO: 57660 - protein, 522 aa, Ricinus communis (castor bean); identical to SEQ ID NO: 7841

SEQ ID NO: 57661 - DNA, 1672 bp, Vicia faba (fava bean); identical to SEQ ID NO: 7842
  CDS (18)..(1568)

SEQ ID NO: 57662 - protein, 516 aa, Vicia faba (fava bean); identical to SEQ ID NO: 7843

SEQ ID NO: 57663 - DNA, 2020 bp, Beta vulgaris (beet); identical to SEQ ID NO: 229
  CDS (190)..(1662)

SEQ ID NO: 57664 - protein, 490 aa, Beta vulgaris (beet); identical to SEQ ID NO: 230

SEQ ID NO: 57665 - DNA, 1925 bp, Beta vulgaris (beet); identical to SEQ ID NO: 7846
  CDS (40)..(1689)

SEQ ID NO: 57666 - protein, 549 aa, Beta vulgaris (beet); identical to SEQ ID NO: 7847

SEQ ID NO: 57667 - DNA, 1820 bp, Picea abies (Norway spruce); identical to SEQ ID NO: 7848
  CDS (33)..(1574)

SEQ ID NO: 57668 - protein, 513 aa, Picea abies (Norway spruce); identical to SEQ ID NO: 7849

SEQ ID NO: 57669 - DNA, 1920 bp, Caenorhabditis elegans; identical to SEQ ID NO: 7850
  CDS (1)..(1920)

SEQ ID NO: 57670 - protein, 639 aa, Caenorhabditis elegans; identical to SEQ ID NO: 7851

SEQ ID NO: 57671 - DNA, 1821 bp, Caenorhabditis elegans; identical to SEQ ID NO: 7852
  CDS (1)..(1821)

SEQ ID NO: 57672 - protein, 606 aa, Caenorhabditis elegans; identical to SEQ ID NO: 7853

SEQ ID NO: 57673 - DNA, 1842 bp, Caenorhabditis elegans; identical to SEQ ID NO: 7854
  CDS (1)..(1842)

SEQ ID NO: 57674 - protein, 613 aa, Caenorhabditis elegans; identical to SEQ ID NO: 7855

SEQ ID NO: 57675 - DNA, 1419 bp, Streptomyces coelicolor; identical to SEQ ID NO: 7856
  CDS (1)..(1419)

SEQ ID NO: 57676 - protein, 472 aa, Streptomyces coelicolor; identical to SEQ ID NO: 7857

SEQ ID NO: 57677 - DNA, 1674 bp, Schizosaccharomyces pombe; identical to SEQ ID NO: 233
  CDS (1)..(1674)

SEQ ID NO: 57678 - protein, 557 aa, Schizosaccharomyces pombe; identical to SEQ ID NO: 234

SEQ ID NO: 57679 - DNA, 2407 bp, Schizosaccharomyces pombe; identical to SEQ ID NO: 7860
  CDS (401)..(2128)

SEQ ID NO: 57680 - protein, 575 aa, Schizosaccharomyces pombe; identical to SEQ ID NO: 7861

SEQ ID NO: 57681 - DNA, 1998 bp, Neurospora crassa; identical to SEQ ID NO: 7862
  CDS (1)..(1998)

SEQ ID NO: 57682 - protein, 665 aa, Neurospora crassa; identical to SEQ ID NO: 7863

SEQ ID NO: 57683 - DNA, 1678 bp, Arabidopsis thaliana (mouse-ear cress); identical to SEQ ID NO: 7864
  CDS (40)..(1530)

SEQ ID NO: 57684 - protein, 496 aa, Arabidopsis thaliana (mouse-ear cress); identical to SEQ ID NO: 7865

SEQ ID NO: 57685 - DNA, 2072 bp, Mus sp; identical to SEQ ID NO: 7866
  CDS (21)..(1454)

SEQ ID NO: 57686 - protein, 477 aa, Mus sp; identical to SEQ ID NO: 7867

SEQ ID NO: 57687 - DNA, 2177 bp, Homo sapiens; identical to SEQ ID NO: 7868
  CDS (288)..(2177)

SEQ ID NO: 57688 - protein, 629 aa, Homo sapiens; identical to SEQ ID NO: 7869

SEQ ID NO: 57689 - DNA, 1422 bp, Bacillus megaterium; identical to SEQ ID NO: 7870
  CDS (1)..(1422)

SEQ ID NO: 57690 - protein, 473 aa, Bacillus megaterium; identical to SEQ ID NO: 7871

SEQ ID NO: 57691 - DNA, 1711 bp, Amanita muscaria; identical to SEQ ID NO: 247
  CDS (38)..(1600)

SEQ ID NO: 57692 - protein, 520 aa, Amanita muscaria; identical to SEQ ID NO: 248

SEQ ID NO: 57693 - DNA, 2700 bp, Kluyveromyces lactis; identical to SEQ ID NO: 7874
  CDS (453)..(2603)

SEQ ID NO: 57694 - protein, 716 aa, Kluyveromyces lactis; identical to SEQ ID NO: 7875

SEQ ID NO: 57695 - DNA, 2065 bp, Prunus armeniaca; identical to SEQ ID NO: 7876
  CDS (363)..(1790)

SEQ ID NO: 57696 - protein, 475 aa, Prunus armeniaca; identical to SEQ ID NO: 7877

SEQ ID NO: 57697 - DNA, 1893 bp, Petunia hybrida; identical to SEQ ID NO: 7878
  CDS (253)..(1785)

SEQ ID NO: 57698 - protein, 510 aa, Petunia hybrida; identical to SEQ ID NO: 7879

SEQ ID NO: 57699 - DNA, 1425 bp, Tetragenococcus halophilus; identical to SEQ ID NO: 249
  CDS (1)..(1425)

SEQ ID NO: 57700 - protein, 474 aa, Tetragenococcus halophilus; identical to SEQ ID NO: 250

SEQ ID NO: 57701 - DNA, 2846 bp, Pichia stipitis; identical to SEQ ID NO: 251
  CDS (175)..(1836)

SEQ ID NO: 57702 - protein, 553 aa, Pichia stipitis; identical to SEQ ID NO: 252

SEQ ID NO: 57703 - DNA, 2054 bp, Beta vulgaris subsp; identical to SEQ ID NO: 253
  CDS (94)..(1731)

SEQ ID NO: 57704 - protein, 545 aa, Beta vulgaris subsp; identical to SEQ ID NO: 254

SEQ ID NO: 57705 - DNA, 1708 bp, Taenia solium; identical to SEQ ID NO: 7886
  CDS (46)..(1548)

SEQ ID NO: 57706 - protein, 500 aa, Taenia solium; identical to SEQ ID NO: 7887

SEQ ID NO: 57707 - DNA, 1753 bp, Medicago truncatula; identical to SEQ ID NO: 7888
  CDS (29)..(1585)

SEQ ID NO: 57708 - protein, 518 aa, Medicago truncatula; identical to SEQ ID NO: 7889

SEQ ID NO: 57709 - DNA, 1726 bp, Saccharum hybrid; identical to SEQ ID NO: 7890
  CDS (73)..(1629)

SEQ ID NO: 57710 - protein, 518 aa, Saccharum hybrid; identical to SEQ ID NO: 7891

SEQ ID NO: 57711 - DNA, 1638 bp, Debaryomyces hansenii; identical to SEQ ID NO: 265
  CDS (1)..(1638)

SEQ ID NO: 57712 - protein, 545 aa, Debaryomyces hansenii; identical to SEQ ID NO: 266

SEQ ID NO: 57713 - DNA, 1737 bp, Debaryomyces hansenii; identical to SEQ ID NO: 277
  CDS (1)..(1737)

SEQ ID NO: 57714 - protein, 578 aa, Debaryomyces hansenii; identical to SEQ ID NO: 278

SEQ ID NO: 57715 - DNA, 1584 bp, Debaryomyces hansenii; identical to SEQ ID NO: 279
  CDS (1)..(1584)

SEQ ID NO: 57716 - protein, 527 aa, Debaryomyces hansenii; identical to SEQ ID NO: 280

SEQ ID NO: 57717 - DNA, 1674 bp, Debaryomyces hansenii; identical to SEQ ID NO: 281
  CDS (1)..(1674)

SEQ ID NO: 57718 - protein, 557 aa, Debaryomyces hansenii; identical to SEQ ID NO: 282

SEQ ID NO: 57719 - DNA, 1671 bp, Debaryomyces hansenii; identical to SEQ ID NO: 7900
  CDS (1)..(1671)

SEQ ID NO: 57720 - protein, 556 aa, Debaryomyces hansenii; identical to SEQ ID NO: 7901

SEQ ID NO: 57721 - DNA, 1947 bp, Debaryomyces hansenii; identical to SEQ ID NO: 7902
  CDS (1)..(1947)

SEQ ID NO: 57722 - protein, 648 aa, Debaryomyces hansenii; identical to SEQ ID NO: 7903

SEQ ID NO: 57723 - DNA, 2196 bp, Debaryomyces hansenii; identical to SEQ ID NO: 287
  CDS (1)..(2196)

SEQ ID NO: 57724 - protein, 731 aa, Debaryomyces hansenii; identical to SEQ ID NO: 288

SEQ ID NO: 57725 - DNA, 1659 bp, Debaryomyces hansenii; identical to SEQ ID NO: 291
  CDS (1)..(1659)

SEQ ID NO: 57726 - protein, 552 aa, Debaryomyces hansenii; identical to SEQ ID NO: 292

SEQ ID NO: 57727 - DNA, 1623 bp, Yarrowia lipolytica; identical to SEQ ID NO: 293
  CDS (1)..(1623)

SEQ ID NO: 57728 - protein, 540 aa, Yarrowia lipolytica; identical to SEQ ID NO: 294

SEQ ID NO: 57729 - DNA, 1602 bp, Yarrowia lipolytica; identical to SEQ ID NO: 295
  CDS (1)..(1602)

SEQ ID NO: 57730 - protein, 533 aa, Yarrowia lipolytica; identical to SEQ ID NO: 296

SEQ ID NO: 57731 - DNA, 1980 bp, Yarrowia lipolytica; identical to SEQ ID NO: 7912
  CDS (1)..(1980)

SEQ ID NO: 57732 - protein, 659 aa, Yarrowia lipolytica; identical to SEQ ID NO: 7913

SEQ ID NO: 57733 - DNA, 1548 bp, Yarrowia lipolytica; identical to SEQ ID NO: 305
  CDS (1)..(1548)

SEQ ID NO: 57734 - protein, 515 aa, Yarrowia lipolytica; identical to SEQ ID NO: 306

SEQ ID NO: 57735 - DNA, 1665 bp, Yarrowia lipolytica; identical to SEQ ID NO: 309
  CDS (1)..(1665)

SEQ ID NO: 57736 - protein, 554 aa, Yarrowia lipolytica; identical to SEQ ID NO: 310

SEQ ID NO: 57737 - DNA, 2364 bp, Kluyveromyces lactis; identical to SEQ ID NO: 317
  CDS (1)..(2364)

SEQ ID NO: 57738 - protein, 787 aa, Kluyveromyces lactis; identical to SEQ ID NO: 318

SEQ ID NO: 57739 - DNA, 1710 bp, Kluyveromyces lactis; identical to SEQ ID NO: 7920
  CDS (1)..(1710)

SEQ ID NO: 57740 - protein, 569 aa, Kluyveromyces lactis; identical to SEQ ID NO: 7921

SEQ ID NO: 57741 - DNA, 1530 bp, Equus caballus; identical to SEQ ID NO: 7922
  CDS (1)..(1530): n means a or g or c or t/u, s means g or c

SEQ ID NO: 57742 - protein, 509 aa, Equus caballus; identical to SEQ ID NO: 7923
  Xaa in position 16 is unknown

SEQ ID NO: 57743 - DNA, 1850 bp, Oryza sativa; identical to SEQ ID NO: 7924
  CDS (99)..(1634)

SEQ ID NO: 57744 - protein, 511 aa, Oryza sativa; identical to SEQ ID NO: 7925

SEQ ID NO: 57745 - DNA, 1644 bp, Candida glabrata; identical to SEQ ID NO: 7926
  CDS (1)..(1644)

SEQ ID NO: 57746 - protein, 547 aa, Candida glabrata; identical to SEQ ID NO: 7927

SEQ ID NO: 57747 - DNA, 2571 bp, Candida glabrata; identical to SEQ ID NO: 329
  CDS (1)..(2571)

SEQ ID NO: 57748 - protein, 856 aa, Candida glabrata; identical to SEQ ID NO: 330

SEQ ID NO: 57749 - DNA, 1713 bp, Candida glabrata; identical to SEQ ID NO: 7930
  CDS (1)..(1713)

SEQ ID NO: 57750 - protein, 570 aa, Candida glabrata; identical to SEQ ID NO: 7931

SEQ ID NO: 57751 - DNA, 2289 bp, Candida glabrata; identical to SEQ ID NO: 331
  CDS (1)..(2289)

SEQ ID NO: 57752 - protein, 762 aa, Candida glabrata; identical to SEQ ID NO: 332

SEQ ID NO: 57753 - DNA, 1695 bp, Candida glabrata; identical to SEQ ID NO: 335
  CDS (1)..(1695)

SEQ ID NO: 57754 - protein, 564 aa, Candida glabrata; identical to SEQ ID NO: 336

SEQ ID NO: 57755 - DNA, 1692 bp, Candida glabrata; identical to SEQ ID NO: 341
  CDS (1)..(1692)

SEQ ID NO: 57756 - protein, 563 aa, Candida glabrata; identical to SEQ ID NO: 342

SEQ ID NO: 57757 - DNA, 1707 bp, Candida glabrata; identical to SEQ ID NO: 343
  CDS (1)..(1707)

SEQ ID NO: 57758 - protein, 568 aa, Candida glabrata; identical to SEQ ID NO: 344

SEQ ID NO: 57759 - DNA, 1671 bp, Candida glabrata; identical to SEQ ID NO: 345
  CDS (1)..(1671)

SEQ ID NO: 57760 - protein, 556 aa, Candida glabrata; identical to SEQ ID NO: 346

SEQ ID NO: 57761 - DNA, 1754 bp, Oryza sativa; identical to SEQ ID NO: 7942
  CDS (115)..(1677)

SEQ ID NO: 57762 - protein, 520 aa, Oryza sativa; identical to SEQ ID NO: 7943

SEQ ID NO: 57763 - DNA, 2196 bp, Oryza sativa; identical to SEQ ID NO: 7944
  CDS (301)..(1746)

SEQ ID NO: 57764 - protein, 481 aa, Oryza sativa; identical to SEQ ID NO: 7945

SEQ ID NO: 57765 - DNA, 2048 bp, Equus caballus; identical to SEQ ID NO: 355
  CDS (178)..(1752): n means a or g or c or t/u, s means g or c

SEQ ID NO: 57766 - protein, 524 aa, Equus caballus; identical to SEQ ID NO: 356

SEQ ID NO: 57767 - DNA, 1443 bp, Photobacterium profundum; identical to SEQ ID NO: 7948
  CDS (1)..(1443)

SEQ ID NO: 57768 - protein, 480 aa, Photobacterium profundum; identical to SEQ ID NO: 7949

SEQ ID NO: 57769 - DNA, 2181 bp, Drosophila melanogaster; identical to SEQ ID NO: 7950
  CDS (549)..(2015)

SEQ ID NO: 57770 - protein, 488 aa, Drosophila melanogaster; identical to SEQ ID NO: 7951

SEQ ID NO: 57771 - DNA, 2536 bp, Pichia angusta; identical to SEQ ID NO: 7952
  CDS (578)..(2203)

SEQ ID NO: 57772 - protein, 541 aa, Pichia angusta; identical to SEQ ID NO: 7953

SEQ ID NO: 57773 - DNA, 1544 bp, Bos taurus; identical to SEQ ID NO: 7954
  CDS (12)..(1541)

SEQ ID NO: 57774 - protein, 509 aa, Bos taurus; identical to SEQ ID NO: 7955

SEQ ID NO: 57775 - DNA, 1590 bp, Oryza sativa; identical to SEQ ID NO: 7956
  CDS (1)..(1590)

SEQ ID NO: 57776 - protein, 529 aa, Oryza sativa; identical to SEQ ID NO: 7957

SEQ ID NO: 57777 - DNA, 1548 bp, Oryza sativa; identical to SEQ ID NO: 7958
  CDS (1)..(1548)

SEQ ID NO: 57778 - protein, 515 aa, Oryza sativa; identical to SEQ ID NO: 7959

SEQ ID NO: 57779 - DNA, 2355 bp, Oryctolagus cuniculus; identical to SEQ ID NO: 7960
  CDS (1)..(1530)

SEQ ID NO: 57780 - protein, 509 aa, Oryctolagus cuniculus; identical to SEQ ID NO: 7961

SEQ ID NO: 57781 - DNA, 2073 bp, Bos taurus; identical to SEQ ID NO: 7962
  CDS (96)..(1532)

SEQ ID NO: 57782 - protein, 478 aa, Bos taurus; identical to SEQ ID NO: 7963

SEQ ID NO: 57783 - DNA, 1560 bp, Oryza sativa; identical to SEQ ID NO: 7964
  CDS (1)..(1560)

SEQ ID NO: 57784 - protein, 519 aa, Oryza sativa; identical to SEQ ID NO: 7965

SEQ ID NO: 57785 - DNA, 1891 bp, Plantago major; identical to SEQ ID NO: 369
  CDS (146)..(1738)

SEQ ID NO: 57786 - protein, 530 aa, Plantago major; identical to SEQ ID NO: 370

SEQ ID NO: 57787 - DNA, 1987 bp, Plantago major; identical to SEQ ID NO: 371
  CDS (116)..(1705)

SEQ ID NO: 57788 - protein, 529 aa, Plantago major; identical to SEQ ID NO: 372

SEQ ID NO: 57789 - DNA, 1407 bp, Bacillus cereus; identical to SEQ ID NO: 7970
  CDS (1)..(1407)

SEQ ID NO: 57790 - protein, 468 aa, Bacillus cereus; identical to SEQ ID NO: 7971

SEQ ID NO: 57791 - DNA, 1431 bp, Mycobacterium paratuberculosis; identical to SEQ ID NO: 7972
  CDS (1)..(1431)

SEQ ID NO: 57792 - protein, 476 aa, Mycobacterium paratuberculosis; identical to SEQ ID NO: 7973

SEQ ID NO: 57793 - DNA, 1716 bp, Ashbya gossypii; identical to SEQ ID NO: 7974
  CDS (1)..(1716)

SEQ ID NO: 57794 - protein, 571 aa, Ashbya gossypii; identical to SEQ ID NO: 7975

SEQ ID NO: 57795 - DNA, 1608 bp, Ashbya gossypii; identical to SEQ ID NO: 375
  CDS (1)..(1608)

SEQ ID NO: 57796 - protein, 535 aa, Ashbya gossypii; identical to SEQ ID NO: 376

SEQ ID NO: 57797 - DNA, 1641 bp, Ashbya gossypii; identical to SEQ ID NO: 377
  CDS (1)..(1641)

SEQ ID NO: 57798 - protein, 546 aa, Ashbya gossypii; identical to SEQ ID NO: 378

SEQ ID NO: 57799 - DNA, 1620 bp, Ashbya gossypii; identical to SEQ ID NO: 379
  CDS (1)..(1620)

SEQ ID NO: 57800 - protein, 539 aa, Ashbya gossypii; identical to SEQ ID NO: 380

SEQ ID NO: 57801 - DNA, 1644 bp, Ashbya gossypii; identical to SEQ ID NO: 381
  CDS (1)..(1644)

SEQ ID NO: 57802 - protein, 547 aa, Ashbya gossypii; identical to SEQ ID NO: 382

SEQ ID NO: 57803 - DNA, 1995 bp, Ashbya gossypii; identical to SEQ ID NO: 383
  CDS (1)..(1995)

SEQ ID NO: 57804 - protein, 664 aa, Ashbya gossypii; identical to SEQ ID NO: 384

SEQ ID NO: 57805 - DNA, 1476 bp, Shigella flexneri; identical to SEQ ID NO: 7986
  CDS (1)..(1476)

SEQ ID NO: 57806 - protein, 491 aa, Shigella flexneri; identical to SEQ ID NO: 7987

SEQ ID NO: 57807 - DNA, 1557 bp, Oryza sativa; identical to SEQ ID NO: 7988
  CDS (1)..(1557)

SEQ ID NO: 57808 - protein, 518 aa, Oryza sativa; identical to SEQ ID NO: 7989

SEQ ID NO: 57809 - DNA, 1774 bp, Anopheles gambiae str; identical to SEQ ID NO: 7990
  CDS (94)..(1542)

SEQ ID NO: 57810 - protein, 482 aa, Anopheles gambiae str; identical to SEQ ID NO: 7991

SEQ ID NO: 57811 - DNA, 1785 bp, Neurospora crassa; identical to SEQ ID NO: 7992
  CDS (1)..(1785)

SEQ ID NO: 57812 - protein, 594 aa, Neurospora crassa; identical to SEQ ID NO: 7993

SEQ ID NO: 57813 - DNA, 1620 bp, Neurospora crassa; identical to SEQ ID NO: 387
  CDS (1)..(1620)

SEQ ID NO: 57814 - protein, 539 aa, Neurospora crassa; identical to SEQ ID NO: 388

SEQ ID NO: 57815 - DNA, 1752 bp, Neurospora crassa; identical to SEQ ID NO: 401
  CDS (1)..(1752)

SEQ ID NO: 57816 - protein, 583 aa, Neurospora crassa; identical to SEQ ID NO: 402

SEQ ID NO: 57817 - DNA, 1464 bp, Neurospora crassa; identical to SEQ ID NO: 7998
  CDS (1)..(1464)

SEQ ID NO: 57818 - protein, 487 aa, Neurospora crassa; identical to SEQ ID NO: 7999

SEQ ID NO: 57819 - DNA, 1509 bp, Mycobacterium bovis; identical to SEQ ID NO: 425
  CDS (1)..(1509)

SEQ ID NO: 57820 - protein, 502 aa, Mycobacterium bovis; identical to SEQ ID NO: 426

SEQ ID NO: 57821 - DNA, 1455 bp, Rhodopirellula baltica; identical to SEQ ID NO: 8002
  CDS (1)..(1455)

SEQ ID NO: 57822 - protein, 484 aa, Rhodopirellula baltica; identical to SEQ ID NO: 8003

SEQ ID NO: 57823 - DNA, 1847 bp, Oryza sativa; identical to SEQ ID NO: 8004
  CDS (94)..(1647)

SEQ ID NO: 57824 - protein, 517 aa, Oryza sativa; identical to SEQ ID NO: 8005

SEQ ID NO: 57825 - DNA, 2251 bp, Oryza sativa; identical to SEQ ID NO: 427
  CDS (152)..(1723)

SEQ ID NO: 57826 - protein, 523 aa, Oryza sativa; identical to SEQ ID NO: 428

SEQ ID NO: 57827 - DNA, 1894 bp, Glycine max; identical to SEQ ID NO: 8008
  CDS (163)..(1734)

SEQ ID NO: 57828 - protein, 523 aa, Glycine max; identical to SEQ ID NO: 8009

SEQ ID NO: 57829 - DNA, 1648 bp, Orobanche ramosa; identical to SEQ ID NO: 429
  CDS (46)..(1605)

SEQ ID NO: 57830 - protein, 519 aa, Orobanche ramosa; identical to SEQ ID NO: 430

SEQ ID NO: 57831 - DNA, 1975 bp, Oryza sativa; identical to SEQ ID NO: 8012
  CDS (96)..(1604)

SEQ ID NO: 57832 - protein, 502 aa, Oryza sativa; identical to SEQ ID NO: 8013

SEQ ID NO: 57833 - DNA, 2458 bp, Oryza sativa; identical to SEQ ID NO: 8014
  CDS (510)..(2255)

SEQ ID NO: 57834 - protein, 581 aa, Oryza sativa; identical to SEQ ID NO: 8015

SEQ ID NO: 57835 - DNA, 2574 bp, Oryza sativa; identical to SEQ ID NO: 435
  CDS (569)..(2089)

SEQ ID NO: 57836 - protein, 506 aa, Oryza sativa; identical to SEQ ID NO: 436

SEQ ID NO: 57837 - DNA, 1413 bp, Streptomyces avermitilis; identical to SEQ ID NO: 8018
  CDS (1)..(1413)

SEQ ID NO: 57838 - protein, 470 aa, Streptomyces avermitilis; identical to SEQ ID NO: 8019

SEQ ID NO: 57839 - DNA, 1230 bp, Coxiella burnetii; identical to SEQ ID NO: 8020
  CDS (1)..(1230)

SEQ ID NO: 57840 - protein, 409 aa, Coxiella burnetii; identical to SEQ ID NO: 8021

SEQ ID NO: 57841 - DNA, 1407 bp, Shigella flexneri; identical to SEQ ID NO: 8022
  CDS (1)..(1407)

SEQ ID NO: 57842 - protein, 468 aa, Shigella flexneri; identical to SEQ ID NO: 8023

SEQ ID NO: 57843 - DNA, 1927 bp, Prunus cerasus; identical to SEQ ID NO: 441
  CDS (56)..(1585)

SEQ ID NO: 57844 - protein, 509 aa, Prunus cerasus; identical to SEQ ID NO: 442

SEQ ID NO: 57845 - DNA, 1838 bp, Medicago truncatula; identical to SEQ ID NO: 8026
  CDS (112)..(1650)

SEQ ID NO: 57846 - protein, 512 aa, Medicago truncatula; identical to SEQ ID NO: 8027

SEQ ID NO: 57847 - DNA, 1764 bp, Datisca glomerata; identical to SEQ ID NO: 8028
  CDS (79)..(1650)

SEQ ID NO: 57848 - protein, 523 aa, Datisca glomerata; identical to SEQ ID NO: 8029

SEQ ID NO: 57849 - DNA, 2032 bp, Prunus cerasus; identical to SEQ ID NO: 443
  CDS (74)..(1690)

SEQ ID NO: 57850 - protein, 538 aa, Prunus cerasus; identical to SEQ ID NO: 444

SEQ ID NO: 57851 - DNA, 1784 bp, Malus domestica; identical to SEQ ID NO: 8032
  CDS (116)..(1561)

SEQ ID NO: 57852 - protein, 481 aa, Malus domestica; identical to SEQ ID NO: 8033

SEQ ID NO: 57853 - DNA, 2012 bp, Malus domestica; identical to SEQ ID NO: 445
  CDS (104)..(1579)

SEQ ID NO: 57854 - protein, 491 aa, Malus domestica; identical to SEQ ID NO: 446

SEQ ID NO: 57855 - DNA, 2178 bp, Mesembryanthemum crystallinum; identical to SEQ ID NO: 8036
  CDS (512)..(2008)

SEQ ID NO: 57856 - protein, 498 aa, Mesembryanthemum crystallinum; identical to SEQ ID NO: 8037

SEQ ID NO: 57857 - DNA, 1569 bp, Oryza sativa; identical to SEQ ID NO: 8038
  CDS (1)..(1569)

SEQ ID NO: 57858 - protein, 522 aa, Oryza sativa; identical to SEQ ID NO: 8039

SEQ ID NO: 57859 - DNA, 1724 bp, Oryza sativa; identical to SEQ ID NO: 8040
  CDS (1)..(1578)

SEQ ID NO: 57860 - protein, 525 aa, Oryza sativa; identical to SEQ ID NO: 8041

SEQ ID NO: 57861 - DNA, 1422 bp, Pseudomonas syringae; identical to SEQ ID NO: 8042
  CDS (1)..(1422)

SEQ ID NO: 57862 - protein, 473 aa, Pseudomonas syringae; identical to SEQ ID NO: 8043

SEQ ID NO: 57863 - DNA, 1467 bp, Lactobacillus plantarum; identical to SEQ ID NO: 8044
  CDS (1)..(1467)

SEQ ID NO: 57864 - protein, 488 aa, Lactobacillus plantarum; identical to SEQ ID NO: 8045

SEQ ID NO: 57865 - DNA, 1413 bp, Lactobacillus plantarum; identical to SEQ ID NO: 8046
  CDS (1)..(1413)

SEQ ID NO: 57866 - protein, 470 aa, Lactobacillus plantarum; identical to SEQ ID NO: 8047

SEQ ID NO: 57867 - DNA, 1401 bp, Lactobacillus plantarum; identical to SEQ ID NO: 8048
  CDS (1)..(1401)

SEQ ID NO: 57868 - protein, 466 aa, Lactobacillus plantarum; identical to SEQ ID NO: 8049

SEQ ID NO: 57869 - DNA, 1383 bp, Bacteroides thetaiotaomicron; identical to SEQ ID NO: 8050
  CDS (1)..(1383)

SEQ ID NO: 57870 - protein, 460 aa, Bacteroides thetaiotaomicron; identical to SEQ ID NO: 8051

SEQ ID NO: 57871 - DNA, 1407 bp, Bacteroides thetaiotaomicron; identical to SEQ ID NO: 453
  CDS (1)..(1407)

SEQ ID NO: 57872 - protein, 468 aa, Bacteroides thetaiotaomicron; identical to SEQ ID NO: 454

SEQ ID NO: 57873 - DNA, 1455 bp, Bacteroides thetaiotaomicron; identical to SEQ ID NO: 8054
  CDS (1)..(1455)

SEQ ID NO: 57874 - protein, 484 aa, Bacteroides thetaiotaomicron; identical to SEQ ID NO: 8055

SEQ ID NO: 57875 - DNA, 1407 bp, Bacteroides thetaiotaomicron; identical to SEQ ID NO: 455
  CDS (1)..(1407)

SEQ ID NO: 57876 - protein, 468 aa, Bacteroides thetaiotaomicron; identical to SEQ ID NO: 456

SEQ ID NO: 57877 - DNA, 1404 bp, Staphylococcus epidermidis; identical to SEQ ID NO: 457
  CDS (1)..(1404)

SEQ ID NO: 57878 - protein, 467 aa, Staphylococcus epidermidis; identical to SEQ ID NO: 458

SEQ ID NO: 57879 - DNA, 1392 bp, Oceanobacillus iheyensis; identical to SEQ ID NO: 8060
  CDS (1)..(1392)

SEQ ID NO: 57880 - protein, 463 aa, Oceanobacillus iheyensis; identical to SEQ ID NO: 8061

SEQ ID NO: 57881 - DNA, 1548 bp, Escherichia coli O6; identical to SEQ ID NO: 8062
  CDS (1)..(1548)

SEQ ID NO: 57882 - protein, 515 aa, Escherichia coli O6; identical to SEQ ID NO: 8063

SEQ ID NO: 57883 - DNA, 1554 bp, Bifidobacterium longum; identical to SEQ ID NO: 8064
  CDS (1)..(1554)

SEQ ID NO: 57884 - protein, 517 aa, Bifidobacterium longum; identical to SEQ ID NO: 8065

SEQ ID NO: 57885 - DNA, 1515 bp, Arabidopsis thaliana; identical to SEQ ID NO: 8066
  CDS (1)..(1515)

SEQ ID NO: 57886 - protein, 504 aa, Arabidopsis thaliana; identical to SEQ ID NO: 8067

SEQ ID NO: 57887 - DNA, 1545 bp, Aspergillus niger; identical to SEQ ID NO: 459
  CDS (1)..(1545)

SEQ ID NO: 57888 - protein, 514 aa, Aspergillus niger; identical to SEQ ID NO: 460

SEQ ID NO: 57889 - DNA, 1752 bp, Aspergillus niger; identical to SEQ ID NO: 463
  CDS (1)..(1752)

SEQ ID NO: 57890 - protein, 583 aa, Aspergillus niger; identical to SEQ ID NO: 464

SEQ ID NO: 57891 - DNA, 1584 bp, Emericella nidulans; identical to SEQ ID NO: 467
  CDS (1)..(1584)

SEQ ID NO: 57892 - protein, 527 aa, Emericella nidulans; identical to SEQ ID NO: 468

SEQ ID NO: 57893 - DNA, 1512 bp, Arabidopsis thaliana; identical to SEQ ID NO: 8074
  CDS (1)..(1512)

SEQ ID NO: 57894 - protein, 503 aa, Arabidopsis thaliana; identical to SEQ ID NO: 472

SEQ ID NO: 57895 - DNA, 1837 bp, Arabidopsis thaliana; identical to SEQ ID NO: 8076
  CDS (131)..(1699)

SEQ ID NO: 57896 - protein, 522 aa, Arabidopsis thaliana; identical to SEQ ID NO: 8077

SEQ ID NO: 57897 - DNA, 1536 bp, Oryza sativa; identical to SEQ ID NO: 8078
  CDS (1)..(1536)

SEQ ID NO: 57898 - protein, 511 aa, Oryza sativa; identical to SEQ ID NO: 8079

SEQ ID NO: 57899 - DNA, 1673 bp, Drosophila melanogaster; identical to SEQ ID NO: 8080
  CDS (88)..(1554)

SEQ ID NO: 57900 - protein, 488 aa, Drosophila melanogaster; identical to SEQ ID NO: 8081

SEQ ID NO: 57901 - DNA, 2234 bp, Kluyveromyces lactis; identical to SEQ ID NO: 473
  CDS (402)..(2102)

SEQ ID NO: 57902 - protein, 566 aa, Kluyveromyces lactis; identical to SEQ ID NO: 474

SEQ ID NO: 57903 - DNA, 1476 bp, Corynebacterium glutamicum; identical to SEQ ID NO: 8084
  CDS (1)..(1476)

SEQ ID NO: 57904 - protein, 491 aa, Corynebacterium glutamicum; identical to SEQ ID NO: 476

SEQ ID NO: 57905 - DNA, 1446 bp, Xanthomonas campestris; identical to SEQ ID NO: 8086
  CDS (1)..(1446)

SEQ ID NO: 57906 - protein, 481 aa, Xanthomonas campestris; identical to SEQ ID NO: 8087

SEQ ID NO: 57907 - DNA, 1428 bp, Xanthomonas axonopodis; identical to SEQ ID NO: 8088
  CDS (1)..(1428)

SEQ ID NO: 57908 - protein, 475 aa, Xanthomonas axonopodis; identical to SEQ ID NO: 8089

SEQ ID NO: 57909 - DNA, 1778 bp, Apium graveolens var; identical to SEQ ID NO: 8090
  CDS (79)..(1650)

SEQ ID NO: 57910 - protein, 523 aa, Apium graveolens var; identical to SEQ ID NO: 8091

SEQ ID NO: 57911 - DNA, 2118 bp, Homo sapiens; identical to SEQ ID NO: 8092
  CDS (110)..(1603)

SEQ ID NO: 57912 - protein, 497 aa, Homo sapiens; identical to SEQ ID NO: 8093

SEQ ID NO: 57913 - DNA, 1449 bp, Arabidopsis thaliana; identical to SEQ ID NO: 8094
  CDS (1)..(1449)

SEQ ID NO: 57914 - protein, 482 aa, Arabidopsis thaliana; identical to SEQ ID NO: 482

SEQ ID NO: 57915 - DNA, 1561 bp, Arabidopsis thaliana; identical to SEQ ID NO: 8096
  CDS (1)..(1530)

SEQ ID NO: 57916 - protein, 509 aa, Arabidopsis thaliana; identical to SEQ ID NO: 8097

SEQ ID NO: 57917 - DNA, 1420 bp, Arabidopsis thaliana; identical to SEQ ID NO: 8098
  CDS (1)..(1389)

SEQ ID NO: 57918 - protein, 462 aa, Arabidopsis thaliana; identical to SEQ ID NO: 8099

SEQ ID NO: 57919 - DNA, 1998 bp, Oryza sativa; identical to SEQ ID NO: 8100
  CDS (197)..(1717)

SEQ ID NO: 57920 - protein, 506 aa, Oryza sativa; identical to SEQ ID NO: 8101

SEQ ID NO: 57921 - DNA, 2145 bp, Homo sapiens; identical to SEQ ID NO: 8102
  CDS (46)..(1479)

SEQ ID NO: 57922 - protein, 477 aa, Homo sapiens; identical to SEQ ID NO: 8103

SEQ ID NO: 57923 - DNA, 1419 bp, Salmonella typhimurium; identical to SEQ ID NO: 8104
  CDS (1)..(1419)

SEQ ID NO: 57924 - protein, 472 aa, Salmonella typhimurium; identical to SEQ ID NO: 8105

SEQ ID NO: 57925 - DNA, 2039 bp, Olea europaea; identical to SEQ ID NO: 8106
  CDS (133)..(1767)

SEQ ID NO: 57926 - protein, 544 aa, Olea europaea; identical to SEQ ID NO: 8107

SEQ ID NO: 57927 - DNA, 1521 bp, Arabidopsis thaliana; identical to SEQ ID NO: 8108
  CDS (1)..(1521)

SEQ ID NO: 57928 - protein, 506 aa, Arabidopsis thaliana; identical to SEQ ID NO: 8109

SEQ ID NO: 57929 - DNA, 1557 bp, Arabidopsis thaliana; identical to SEQ ID NO: 8110
  CDS (1)..(1467)

SEQ ID NO: 57930 - protein, 488 aa, Arabidopsis thaliana; identical to SEQ ID NO: 8111

SEQ ID NO: 57931 - DNA, 1876 bp, Arabidopsis thaliana; identical to SEQ ID NO: 8112
  CDS (87)..(1727)

SEQ ID NO: 57932 - protein, 546 aa, Arabidopsis thaliana; identical to SEQ ID NO: 8113

SEQ ID NO: 57933 - DNA, 1377 bp, Arabidopsis thaliana; identical to SEQ ID NO: 8114
  CDS (1)..(1377)

SEQ ID NO: 57934 - protein, 458 aa, Arabidopsis thaliana; identical to SEQ ID NO: 8115

SEQ ID NO: 57935 - DNA, 1608 bp, Oryza sativa; identical to SEQ ID NO: 8116
  CDS (1)..(1608)

SEQ ID NO: 57936 - protein, 535 aa, Oryza sativa; identical to SEQ ID NO: 8117

SEQ ID NO: 57937 - DNA, 1606 bp, Arabidopsis thaliana; identical to SEQ ID NO: 8118
  CDS (18)..(1454)

SEQ ID NO: 57938 - protein, 478 aa, Arabidopsis thaliana; identical to SEQ ID NO: 8119

SEQ ID NO: 57939 - DNA, 1787 bp, Arabidopsis thaliana; identical to SEQ ID NO: 8120
  CDS (100)..(1524)

SEQ ID NO: 57940 - protein, 474 aa, Arabidopsis thaliana; identical to SEQ ID NO: 8121

SEQ ID NO: 57941 - DNA, 1539 bp, Oryza sativa; identical to SEQ ID NO: 8122
  CDS (1)..(1539)

SEQ ID NO: 57942 - protein, 512 aa, Oryza sativa; identical to SEQ ID NO: 8123

SEQ ID NO: 57943 - DNA, 1702 bp, Oryza sativa; identical to SEQ ID NO: 8124
  CDS (87)..(1628)

SEQ ID NO: 57944 - protein, 513 aa, Oryza sativa; identical to SEQ ID NO: 8125

SEQ ID NO: 57945 - DNA, 1569 bp, Uromyces fabae; identical to SEQ ID NO: 487
  CDS (1)..(1569)

SEQ ID NO: 57946 - protein, 522 aa, Uromyces fabae; identical to SEQ ID NO: 488

SEQ ID NO: 57947 - DNA, 1380 bp, Sulfolobus tokodaii; identical to SEQ ID NO: 8128
  CDS (1)..(1380)

SEQ ID NO: 57948 - protein, 459 aa, Sulfolobus tokodaii; identical to SEQ ID NO: 8129

SEQ ID NO: 57949 - DNA, 1503 bp, Thermoplasma volcanium; identical to SEQ ID NO: 8130
  CDS (1)..(1503)

SEQ ID NO: 57950 - protein, 500 aa, Thermoplasma volcanium; identical to SEQ ID NO: 8131

SEQ ID NO: 57951 - DNA, 1440 bp, Zymomonas mobilis; identical to SEQ ID NO: 493
  CDS (1)..(1440)

SEQ ID NO: 57952 - protein, 479 aa, Zymomonas mobilis; identical to SEQ ID NO: 494

SEQ ID NO: 57953 - DNA, 1865 bp, Arabidopsis thaliana; identical to SEQ ID NO: 8134
  CDS (66)..(1742)

SEQ ID NO: 57954 - protein, 558 aa, Arabidopsis thaliana; identical to SEQ ID NO: 8135

SEQ ID NO: 57955 - DNA, 1545 bp, Arabidopsis thaliana; identical to SEQ ID NO: 8136
  CDS (1)..(1545)

SEQ ID NO: 57956 - protein, 514 aa, Arabidopsis thaliana; identical to SEQ ID NO: 8137

SEQ ID NO: 57957 - DNA, 1766 bp, Apium graveolens var; identical to SEQ ID NO: 495
  CDS (17)..(1558)

SEQ ID NO: 57958 - protein, 513 aa, Apium graveolens var; identical to SEQ ID NO: 496

SEQ ID NO: 57959 - DNA, 2041 bp, Mesembryanthemum crystallinum; identical to SEQ ID NO: 497
  CDS (118)..(1785)

SEQ ID NO: 57960 - protein, 555 aa, Mesembryanthemum crystallinum; identical to SEQ ID NO: 498

SEQ ID NO: 57961 - DNA, 1961 bp, Saccharomyces pastorianus; identical to SEQ ID NO: 8142
  CDS (192)..(1904)

SEQ ID NO: 57962 - protein, 570 aa, Saccharomyces pastorianus; identical to SEQ ID NO: 8143

SEQ ID NO: 57963 - DNA, 1458 bp, Thermoplasma acidophilum; identical to SEQ ID NO: 8144
  CDS (1)..(1458)

SEQ ID NO: 57964 - protein, 485 aa, Thermoplasma acidophilum; identical to SEQ ID NO: 8145

SEQ ID NO: 57965 - DNA, 1413 bp, Lactobacillus casei; identical to SEQ ID NO: 8146
  CDS (1)..(1413)

SEQ ID NO: 57966 - protein, 470 aa, Lactobacillus casei; identical to SEQ ID NO: 8147

SEQ ID NO: 57967 - DNA, 1699 bp, Lycopersicon esculentum; identical to SEQ ID NO: 8148
  CDS (24)..(1466)

SEQ ID NO: 57968 - protein, 480 aa, Lycopersicon esculentum; identical to SEQ ID NO: 8149

SEQ ID NO: 57969 - DNA, 2013 bp, Mesembryanthemum crystallinum; identical to SEQ ID NO: 8150
  CDS (131)..(1876)

SEQ ID NO: 57970 - protein, 581 aa, Mesembryanthemum crystallinum; identical to SEQ ID NO: 8151

SEQ ID NO: 57971 - DNA, 2422 bp, Mesembryanthemum crystallinum; identical to SEQ ID NO: 8152
  CDS (386)..(2131)

SEQ ID NO: 57972 - protein, 581 aa, Mesembryanthemum crystallinum; identical to SEQ ID NO: 8153

SEQ ID NO: 57973 - DNA, 1864 bp, Spinacia oleracea; identical to SEQ ID NO: 501
  CDS (61)..(1716)

SEQ ID NO: 57974 - protein, 551 aa, Spinacia oleracea; identical to SEQ ID NO: 502

SEQ ID NO: 57975 - DNA, 1822 bp, Arabidopsis thaliana; identical to SEQ ID NO: 503
  CDS (65)..(1684)

SEQ ID NO: 57976 - protein, 539 aa, Arabidopsis thaliana; identical to SEQ ID NO: 504

SEQ ID NO: 57977 - DNA, 1545 bp, Arabidopsis thaliana; identical to SEQ ID NO: 8158
  CDS (1)..(1545)

SEQ ID NO: 57978 - protein, 514 aa, Arabidopsis thaliana; identical to SEQ ID NO: 8159

SEQ ID NO: 57979 - DNA, 1624 bp, Arabidopsis thaliana; identical to SEQ ID NO: 8160
  CDS (73)..(1464)

SEQ ID NO: 57980 - protein, 463 aa, Arabidopsis thaliana; identical to SEQ ID NO: 8161

SEQ ID NO: 57981 - DNA, 1578 bp, Arabidopsis thaliana; identical to SEQ ID NO: 8162
  CDS (1)..(1434)

SEQ ID NO: 57982 - protein, 477 aa, Arabidopsis thaliana; identical to SEQ ID NO: 8163

SEQ ID NO: 57983 - DNA, 1524 bp, Arabidopsis thaliana; identical to SEQ ID NO: 8164
  CDS (1)..(1524)

SEQ ID NO: 57984 - protein, 507 aa, Arabidopsis thaliana; identical to SEQ ID NO: 8165

SEQ ID NO: 57985 - DNA, 1976 bp, Lycopersicon esculentum; identical to SEQ ID NO: 8166
  CDS (87)..(1658)

SEQ ID NO: 57986 - protein, 523 aa, Lycopersicon esculentum; identical to SEQ ID NO: 8167

SEQ ID NO: 57987 - DNA, 1653 bp, Pichia stipitis; identical to SEQ ID NO: 505
  CDS (1)..(1653)

SEQ ID NO: 57988 - protein, 550 aa, Pichia stipitis; identical to SEQ ID NO: 506

SEQ ID NO: 57989 - DNA, 2169 bp, Drosophila melanogaster; identical to SEQ ID NO: 8170
  CDS (579)..(2024)

SEQ ID NO: 57990 - protein, 481 aa, Drosophila melanogaster; identical to SEQ ID NO: 8171

SEQ ID NO: 57991 - DNA, 1587 bp, Drosophila melanogaster; identical to SEQ ID NO: 8172
  CDS (47)..(1444)

SEQ ID NO: 57992 - protein, 465 aa, Drosophila melanogaster; identical to SEQ ID NO: 8173

SEQ ID NO: 57993 - DNA, 2514 bp, Drosophila melanogaster; identical to SEQ ID NO: 8174
  CDS (463)..(2082)

SEQ ID NO: 57994 - protein, 539 aa, Drosophila melanogaster; identical to SEQ ID NO: 8175

SEQ ID NO: 57995 - DNA, 1560 bp, Vitis vinifera; identical to SEQ ID NO: 8176
  CDS (1)..(1560)

SEQ ID NO: 57996 - protein, 519 aa, Vitis vinifera; identical to SEQ ID NO: 8177

SEQ ID NO: 57997 - DNA, 1686 bp, Arabidopsis thaliana; identical to SEQ ID NO: 8178
  CDS (130)..(1521)

SEQ ID NO: 57998 - protein, 463 aa, Arabidopsis thaliana; identical to SEQ ID NO: 8179

SEQ ID NO: 57999 - DNA, 2468 bp, Mus musculus; identical to SEQ ID NO: 515
  CDS (34)..(1605)

SEQ ID NO: 58000 - protein, 523 aa, Mus musculus; identical to SEQ ID NO: 516

SEQ ID NO: 58001 - DNA, 2355 bp, Canis familiaris; identical to SEQ ID NO: 517
  CDS (201)..(1688)

SEQ ID NO: 58002 - protein, 495 aa, Canis familiaris; identical to SEQ ID NO: 518

SEQ ID NO: 58003 - DNA, 1485 bp, Ovis aries; identical to SEQ ID NO: 519
  CDS (1)..(1485)

SEQ ID NO: 58004 - protein, 494 aa, Ovis aries; identical to SEQ ID NO: 520

SEQ ID NO: 58005 - DNA, 2425 bp, Kluyveromyces lactis; identical to SEQ ID NO: 523
  CDS (539)..(2194)

SEQ ID NO: 58006 - protein, 551 aa, Kluyveromyces lactis; identical to SEQ ID NO: 524

SEQ ID NO: 58007 - DNA, 2353 bp, Chlorella kessleri; identical to SEQ ID NO: 8188
  CDS (57)..(1679)

SEQ ID NO: 58008 - protein, 540 aa, Chlorella kessleri; identical to SEQ ID NO: 8189

SEQ ID NO: 58009 - DNA, 1731 bp, Saccharomyces cerevisiae; identical to SEQ ID NO: 8190
  CDS (1)..(1731)

SEQ ID NO: 58010 - protein, 576 aa, Saccharomyces cerevisiae; identical to SEQ ID NO: 526

SEQ ID NO: 58011 - DNA, 3261 bp, Homo sapiens; identical to SEQ ID NO: 8192
  CDS (109)..(1998): n means a or g or c or t/u, s means g or c

SEQ ID NO: 58012 - protein, 629 aa, Homo sapiens; identical to SEQ ID NO: 8193
  Xaa in positions 227 and 436 is unknown

SEQ ID NO: 58013 - DNA, 2504 bp, Rattus norvegicus; identical to SEQ ID NO: 8194
  CDS (145)..(2001)

SEQ ID NO: 58014 - protein, 618 aa, Rattus norvegicus; identical to SEQ ID NO: 8195

SEQ ID NO: 58015 - DNA, 3642 bp, Saccharomyces cerevisiae; identical to SEQ ID NO: 7728
  CDS (749)..(3205)

SEQ ID NO: 58016 - protein, 818 aa, Saccharomyces cerevisiae; identical to SEQ ID NO: 8197

SEQ ID NO: 58017 - DNA, 1374 bp, Lactobacillus brevis; identical to SEQ ID NO: 8198
  CDS (1)..(1374)

SEQ ID NO: 58018 - protein, 457 aa, Lactobacillus brevis; identical to SEQ ID NO: 8199

SEQ ID NO: 58019 - DNA, 1500 bp, Xenopus laevis; identical to SEQ ID NO: 8200
  CDS (1)..(1500)

SEQ ID NO: 58020 - protein, 499 aa, Xenopus laevis; identical to SEQ ID NO: 8201

SEQ ID NO: 58021 - DNA, 1470 bp, Gadus morhua; identical to SEQ ID NO: 8202
  CDS (1)..(1470)

SEQ ID NO: 58022 - protein, 489 aa, Gadus morhua; identical to SEQ ID NO: 8203

SEQ ID NO: 58023 - DNA, 25 bp, Artificial sequence
  (1)..(25): primer
atgggaatacacataccatatctca

SEQ ID NO: 58024 - DNA, 26 bp, Artificial sequence
  (1)..(26): primer
ctatatatcctctataatctcttgag

SEQ ID NO: 58025 - protein, 728 aa, Artificial sequence; identical to SEQ ID NO: 34657
  Variant (2)..(3): xaa in position 2 to 3 is any amino acid
  Variant (8)..(9): xaa in position 8 to 9 is any amino acid
  Variant (10)..(44): xaa in position 10 to 44 is any or no amino acid
  Variant (46)..(46): xaa in position 46 is any amino acid
  Variant (48)..(67): xaa in position 48 to 67 is any amino acid
  Variant (68)..(88): xaa in position 68 to 88 is any or no amino acid
  Variant (90)..(93): xaa in position 90 to 93 is any amino acid
  Variant (95)..(97): xaa in position 95 to 97 is any amino acid
  Variant (99)..(109): xaa in position 99 to 109 is any amino acid
  Variant (113)..(114): xaa in position 113 to 114 is any amino acid
  Variant (116)..(124): xaa in position 116 to 124 is any amino acid
  Variant (126)..(131): xaa in position 126 to 131 is any amino acid
  Variant (133)..(136): xaa in position 133 to 136 is any amino acid
  Variant (137)..(155): xaa in position 137 to 155 is any or no amino acid
  Variant (157)..(158): xaa in position 157 to 158 is any amino acid
  Variant (161)..(161): xaa in position 161 is any amino acid
  Variant (163)..(163): xaa in position 163 is any amino acid
  Variant (165)..(165): xaa in position 165 is any amino acid
  Variant (169)..(174): xaa in position 169 to 174 is any amino acid
  Variant (181)..(181): xaa in position 181 is any amino acid
  Variant (184)..(184): xaa in position 184 is any amino acid
  Variant (185)..(186): xaa in position 185 to 186 is any or no amino acid
  Variant (189)..(189): xaa in position 189 is any or no amino acid
  Variant (191)..(195): xaa in position 191 to 195 is any amino acid
  Variant (197)..(197): xaa in position 197 is any amino acid
  Variant (199)..(200): xaa in position 199 to 200 is any amino acid
  Variant (203)..(212): xaa in position 203 to 212 is any amino acid
  Variant (213)..(256): xaa in position 213 to 256 is any or no amino acid
  Variant (259)..(261): xaa in position 259 to 261 is any amino acid
  Variant (264)..(267): xaa in position 264 to 267 is any amino acid
  Variant (269)..(277): xaa in position 269 to 277 is any amino acid
  Variant (278)..(278): xaa in position 278 is any or no amino acid
  Variant (287)..(294): xaa in position 287 to 294 is any amino acid
  Variant (295)..(338): xaa in position 295 to 338 is any or no amino acid
  Variant (340)..(342): xaa in position 340 to 342 is any amino acid
  Variant (344)..(363): xaa in position 344 to 363 is any amino acid
  Variant (364)..(411): xaa in position 364 to 411 is any or no amino acid
  Variant (413)..(414): xaa in position 413 to 414 is any amino acid
  Variant (416)..(417): xaa in position 416 to 417 is any amino acid
  Variant (419)..(421): xaa in position 419 to 421 is any amino acid
  Variant (424)..(425): xaa in position 424 to 425 is any amino acid
  Variant (427)..(427): xaa in position 427 is any amino acid
  Variant (429)..(429): xaa in position 429 is any amino acid
  Variant (431)..(431): xaa in position 431 is any amino acid
  Variant (434)..(436): xaa in position 434 to 436 is any amino acid
  Variant (439)..(452): xaa in position 439 to 452 is any amino acid
  Variant (453)..(465): xaa in position 453 to 465 is any or no amino acid
  Variant (467)..(479): xaa in position 467 to 479 is any amino acid
  Variant (483)..(483): xaa in position 483 is any amino acid
  Variant (487)..(487): xaa in position 487 is any amino acid
  Variant (489)..(489): xaa in position 489 is any amino acid
  Variant (491)..(491): xaa in position 491 is any amino acid
  Variant (492)..(502): xaa in position 492 to 502 is any or no amino acid
  Variant (504)..(522): xaa in position 504 to 522 is any amino acid
  Variant (523)..(622): xaa in position 523 to 622 is any or no amino acid
  Variant (624)..(627): xaa in position 624 to 627 is any amino acid
  Variant (628)..(628): xaa in position 628 is any or no amino acid
  Variant (631)..(632): xaa in position 631 to 632 is any amino acid
  Variant (634)..(637): xaa in position 634 to 637 is any amino acid
  Variant (639)..(639): xaa in position 639 is any amino acid
  Variant (641)..(641): xaa in position 641 is any amino acid
  Variant (643)..(643): xaa in position 643 is any amino acid
  Variant (645)..(646): xaa in position 645 to 646 is any amino acid
  Variant (648)..(648): xaa in position 648 is any amino acid
  Variant (650)..(650): xaa in position 650 is any or no amino acid
  Variant (652)..(654): xaa in position 652 to 654 is any amino acid
  Variant (656)..(657): xaa in position 656 to 657 is any or no amino acid
  Variant (659)..(660): xaa in position 659 to 660 is any or no amino acid
  Variant (662)..(665): xaa in position 662 to 665 is any amino acid
  Variant (667)..(672): xaa in position 667 to 672 is any amino acid
  Variant (674)..(679): xaa in position 674 to 679 is any amino acid
  Variant (681)..(687): xaa in position 681 to 687 is any amino acid
  Variant (688)..(698): xaa in position 688 to 698 is any or no amino acid
  Variant (700)..(701): xaa in position 700 to 701 is any amino acid
  Variant (703)..(711): xaa in position 703 to 711 is any amino acid
  Variant (713)..(716): xaa in position 713 to 716 is any amino acid
  Variant (723)..(724): xaa in position 723 to 724 is any amino acid
  Variant (727)..(727): xaa in position 727 is any amino acid

SEQ ID NO: 58026 - protein, 20 aa, Artificial sequence
  Variant (1)..(1): xaa in position 1 is Leu, Val, Ile, Met, Phe or Ala
  Variant (2)..(4): xaa in position 2 to 4 is any amino acid
  Variant (5)..(5): xaa in position 5 is Gln, Asn, Gly or Leu
  Variant (6)..(6): xaa in position 6 is Gln or Ile
  Variant (7)..(8): xaa in position 7 to 8 is any amino acid
  Variant (10)..(10): xaa in position 10 is any amino acid
  Variant (11)..(11): xaa in position 11 is Asn, Asp, Ser, Pro or Glu
  Variant (12)..(14): xaa in position 12 to 14 is any amino acid
  Variant (15)..(15): xaa in position 15 is Tyr, Phe, Leu or Ser
  Variant (16)..(16): xaa in position 16 is Tyr or Phe
  Variant (17)..(19): xaa in position 17 to 19 is any amino acid
  Variant (20)..(20): xaa in position 20 is Ile, Leu, Val or Phe
XXXXXXXXGXXXXXXXXXXX

SEQ ID NO: 58027 - DNA, 657 bp, Saccharomyces cerevisiae
  CDS (1)..(657)
atggcagattattcttcccttactgttgttcaattgaaagatttactgaccaagagaaatctgtctgtaggcggattgaagaatgaactagttcaaagactgataaaggacgatgaagaatcaaagggtgaaagtgaagtttctccacaggaacaaaaccaggaacaagggtcagaacctgcggcgatagaagaaccagcctcccagaacattactgaaaaaaaggaagtttcaagcgagcctaaagaaacaaacgaacccaaggaggaaaataaggacgttcaaaagccctctgatggaccttctgctactgcttcagagaacgaacaagctgctgcttccactgctgctcccgctttgtcaccagaagaaattaaggccaaagcattggatcttttaaataagaaactgcaccgcgctaacaaattcggtcaagatcaagcggatattgactctttacaaagacagataaatcgtgtggagaagtttggtgttgacttgaatagcaagttggctgaagaactgggccttgtcagtaggaaaaatgaacctgaaagtggcaataacggtaaatttaaaaatagaaacaaaaatgcaaacaaccgctccagagtaagtaaaaacaggagaggcaaccgctctggttacagaagataa

SEQ ID NO: 58028 - protein, 218 aa, Saccharomyces cerevisiae
MADYSSLTVVQLKDLLTKRNLSVGGLKNELVQRLIKDDEESKGESEVSPQEQNQEQGSEPAAIEEPASQNITEKKEVSSEPKETNEPKEENKDVQKPSDGPSATASENEQAAASTAAPALSPEEIKAKALDLLNKKLHRANKFGQDQADIDSLQRQINRVEKFGVDLNSKLAEELGLVSRKNEPESGNNGKFKNRNKNANNRSRVSKNRRGNRSGYRR

SEQ ID NO: 58029 - DNA, 618 bp, Eremothecium gossypii
  CDS (1)..(618)
atggacatcgatcacgtggcatcagcggcgcgcaaagcgggcgcgaccgacgccaccggctggccctggctggccaaccgtcagagccacgacgagatgacggactacgccagcatgacagttgcacagctgaaggacgtgctcaaggagcgcgagcttcccacacagggcctaaaagcggcgcttgtggagcggctgcagcaggcagacgcgacagcggctgagcctaccgacgcgaccacgcgtcctgccgcagaggagcacacgccggaggcggcggagcctgctgcaacgcctgcagaggccgaggctcctgtggctgagcagcgtgcagcagctgagccccgcacgctctcccccgaagagatgaagcaggctgctgtggcgcacctcagcaagaaattgcaccgcgcacgcaagttcggcgaggacgacgcggcagtgggtgcgctgcaaaagcagctagcgcggctcgagaagttcggcctggacctaacgacgcagcttgcccaggagctcggtttcggccgcggccctgcggcggccgtcggaaagcatgccttccacaggcgacgtggctaccaccagggcaagaagtttaaggcccagcgcaggtga

SEQ ID NO: 58030 - protein, 205 aa, Eremothecium gossypii
MDIDHVASAARKAGATDATGWPWLANRQSHDEMTDYASMTVAQLKDVLKERELPTQGLKAALVERLQQADATAAEPTDATTRPAAEEHTPEAAEPAATPAEAEAPVAEQRAAAEPRTLSPEEMKQAAVAHLSKKLHRARKFGEDDAAVGALQKQLARLEKFGLDLTTQLAQELGFGRGPAAAVGKHAFHRRRGYHQGKKFKAQRR

SEQ ID NO: 58031 - DNA, 1908 bp, Magnaporthe grisea 70-15
  CDS (1)..(1908)
atgacgactgactggagtaaaaacaaggttgtcgaccttagagccgagctcactcgcagaggcctagctaccaatggcctaaagcaggaactggtagatcgcctgacaagcgacgatgaagccaagctgaaggaggaacctgaagccgatgcgcccaagcctgatgatcaatcaccccccgccgatgaatcgacagatgttgcagccgaacaacctgaagctgtgcaagaaaccgcaacaccccaacaagccgaacctgcgcaggacctgccgaacgagaccacgacagaggcgcaagaaattgcaaattccgatgcgcccgcagctcttttggctgatgcagtcggcgatgagaagaaacgcaagcgtcgctcagccagtccgccaccgcctcacgatgatacaccgaggaagcgtcttcggcaggagaatagcgacgtaatggagaacggtggcaatgatgccgatccagtcaccagtgatctctcacagcctgtatctgccacccacgatgatgaagatgtcaccatgcaggaaggtgcggaacatcaggccgcaccaacggcaaaagatgctacacgcggagccccaccagagtccagccaaaagatggagcaagaggatgttgttgactacggagccgactcgccggtagctcagcaagacacggagcaggtttcctcaaataagcaagagtcgggagacggcgatatcgacatgaaggacgttgcgaaagatgccgccctacagggtacagaccaattttattacgacgtccctcgcgcaagagatggggatgactctgttgagcctgcgctgcaccctgcaaccgatagtctgttcattggtaactttatgcgcccgcttcgagccgacgttgtcgaggatcatcttgttgaactggccatgagccctggtgcggcacccgatcgctcggtactgtcacagttgtgggtagacagtattcgtacccacgctcttgtacagttccaatccgttgcagccgcatcccgtgtacggacagctctccacggaaaagtgtggccagacgagaggaacaggaaagcgctttgggttgacttcatcccgtcagatcaggttagtgactggatcgccaaggagaaggcagagggaagtagcagaaggggcgacgtctctaggtgggaggtggtgtaccagaaagagggcgacatcatggttgcaacgcaccaagtcgccattgcagagccaaaaacaaccgcaccgccatcaggaccgaacggtgcatcgcgggctgtacctaccggcccagcaaaccagtacccgggcatagaatctgcaccatcaggtcctcgcaacatgggcggtcgacgtggtgccggcgatgcccgaggaaatggacacgagcgtacacgcacatcaccgtctatcagttggcagcccgtttctgctgatcttgctcgccggcgactcgacaacctcaacggcttcgtctccaaggacccaaatcgcgacgtaggccgcgattgccaccgttactcctttactcgaagtgaccagttcatagaccgcggcccagagatgtttgttggaattcggcccccgcaccgtgaacgcgagcgtcgtcagatgggcggccaggctggtgggcatgcaaacggtggtggtgcgagagcaggagctggtggatctggccatggctcatcacgccaacccctcccaccccaatcatatgaggctcctgctcctaggcgtggtcctcgaggtggaggtggccgccgtaacaggcatggtggcggtggcggaggcgggaattctgggtatgggcgatatggtcaagggggtcgtttcggtgatggcctagcccctaggtatgaagatttcaggtacaggccttcggacaatgaccatcggtcagacaggcgatga

SEQ ID NO: 58032 - protein, 635 aa, Magnaporthe grisea 70-15
MTTDWSKNKVVDLRAELTRRGLATNGLKQELVDRLTSDDEAKLKEEPEADAPKPDDQSPPADESTDVAAEQPEAVQETATPQQAEPAQDLPNETTTEAQEIANSDAPAALLADAVGDEKKRKRRSASPPPPHDDTPRKRLRQENSDVMENGGNDADPVTSDLSQPVSATHDDEDVTMQEGAEHQAAPTAKDATRGAPPESSQKMEQEDVVDYGADSPVAQQDTEQVSSNKQESGDGDIDMKDVAKDAALQGTDQFYYDVPRARDGDDSVEPALHPATDSLFIGNFMRPLRADVVEDHLVELAMSPGAAPDRSVLSQLWVDSIRTHALVQFQSVAAASRVRTALHGKVWPDERNRKALWVDFIPSDQVSDWIAKEKAEGSSRRGDVSRWEVVYQKEGDIMVATHQVAIAEPKTTAPPSGPNGASRAVPTGPANQYPGIESAPSGPRNMGGRRGAGDARGNGHERTRTSPSISWQPVSADLARRRLDNLNGFVSKDPNRDVGRDCHRYSFTRSDQFIDRGPEMFVGIRPPHRERERRQMGGQAGGHANGGGARAGAGGSGHGSSRQPLPPQSYEAPAPRRGPRGGGGRRNRHGGGGGGGNSGYGRYGQGGRFGDGLAPRYEDFRYRPSDNDHRSDRR

SEQ ID NO: 58033 - DNA, 933 bp, Magnaporthe grisea 70-15
  CDS (1)..(933)
atggctgagtactcatcaatgaaagttcccgagctcaagaagatgctcggcgaacgcggcctcccgcagtctggcaacaaaccggacctgattgcgcgcctcaaggaggacgacgagaagaaggagcctgccggcgcaaagacgacagacagcaagcccgccgccgagaccgaggacgtcatcaactgggacgacgaggacgacacggccgcagcaaagccacaacccgctgctgcaccagcggctgcggagccggccaagactgccgagcccgccgcgaaaccgtcagagcctgcacccgctgcggacaagtcagcagatgcgcccgcgtcatccacaaaggaggaagcttccgctgccgcacccgcagatgctacccccgccgccagtgcaggagacgaggccaaggcgcccgcagaacccacagagcccgccaagccggccctgagccaaaacctcccatcgacgtcggtcgacgccgaggcagccaagcgggcggcgcgtgcaaagaggttcggcattgaggcgccgacagaggacgaagaggcgcgcaggaaggctgagcgcgcaaagaagtttggtgtcgaggacgctacaaaggcgctcgacgccagccggttggactcggcgctgccggaccgcccgctgaagcgcgggcgcgacaagggcgaacagcagcaggagggtggtgagggtaaggggaacggcgccaagcgccagcaacagcagcagggcggcggcgacgggcgaaggaacaacaacagggacggtggccggcgcgacaggaggaggggacgccccaacggcggcggcggcggtggtggtggtggcgcgaggaacggtggcggcggcggtggtggttccggtattctcaacgacccggagcagaagcgcaaggccgaggcgagggccgcgaggttcgcttcatcatga

SEQ ID NO: 58034 - protein, 310 aa, Magnaporthe grisea 70-15
MAEYSSMKVPELKKMLGERGLPQSGNKPDLIARLKEDDEKKEPAGAKTTDSKPAAETEDVINWDDEDDTAAAKPQPAAAPAAAEPAKTAEPAAKPSEPAPAADKSADAPASSTKEEASAAAPADATPAASAGDEAKAPAEPTEPAKPALSQNLPSTSVDAEAAKRAARAKRFGIEAPTEDEEARRKAERAKKFGVEDATKALDASRLDSALPDRPLKRGRDKGEQQQEGGEGKGNGAKRQQQQQGGGDGRRNNNRDGGRRDRRRGRPNGGGGGGGGGARNGGGGGGGSGILNDPEQKRKAEARAARFASS

SEQ ID NO: 58035 - DNA, 780 bp, Gibberella zeae PH-1
  CDS (1)..(780)
atggctgaatactccacgcttaaggtgcctgagctcaaaaagctgttggcggaaaagagccttcctcagactggaaacaaggccgatcttatcgccagactccaggagaacgacaagcagtccgagacagaggcgaagcctgccgagaacaaagaagacgagatcagctacagtgatgatgaggctcccgccgcacctgctgctgccgccccagttacttcggcacccgttgccgatgcccctgctgccgaggccgctcctgccgaacccacgaatgctgaggagcctgctgcggtagaagcacctgcagagacagcagaggcgcctgctgagcctgaaaagtcttacgccatgggattatcatccactgctgccgatgatgaggccaagaagcgtgctgaacgtgctaagcgatttggcattgaagaggacgaagacgcgatcaagcgcgctgatcgtgcgaagagattcggtctcgatgagaaggagttggctactaccctggactctgctcttcctgagcgctcccgaaagcgaggccgagaccgcaacaccgagactgaagggaaccgaccggaaaagcgacagagcatggacagacgaaatggtcctggcggtcgacaacgtagaggccgtggtggtcgcgacaacggtcgcgatcgcggtgctcgaaaggagggcactcaaaaggagggtgccgcaacccgaagtggtatccttgatgacccaactgagaaagccaaggcggagaaacgcgcagccaggttcgctgggaactga

SEQ ID NO: 58036 - protein, 259 aa, Gibberella zeae PH-1
MAEYSTLKVPELKKLLAEKSLPQTGNKADLIARLQENDKQSETEAKPAENKEDEISYSDDEAPAAPAAAAPVTSAPVADAPAAEAAPAEPTNAEEPAAVEAPAETAEAPAEPEKSYAMGLSSTAADDEAKKRAERAKRFGIEEDEDAIKRADRAKRFGLDEKELATTLDSALPERSRKRGRDRNTETEGNRPEKRQSMDRRNGPGGRQRRGRGGRDNGRDRGARKEGTQKEGAATRSGILDDPTEKAKAEKRAARFAGN

SEQ ID NO: 58037 - DNA, 885 bp, Aspergillus nidulans FGSC A4
  CDS (1)..(885)
atggccaccgactacgccaagaagaccaacgctgagctcgttgagatcctcaagtcacggaacctccctcacactggcaagaaggcggacatggttgcgcgcctcctggaagacgacagctcgaaagccgctgcgcccgctcaaaacgagaacgcggatgatgtgatcgactgggaggatgatgaagttcctgccgcaacctctaccacgacgaccaaagccgccgagactgatgctgcagctgcagctgtggctccggcccctgctgaagagaccgccaccgccgctcccaaggcggaggaaaccgaaacagatggcgcgaaatcggcgacgggagcaaccaaagacagtgcaaagccctcaggtacagtagaaccgacgggcgcggaggaacaggcagcccagcagcctgcggaggagaagccagcacccaacttcgctctcggtctcactgtgacggatttggaggaagagttgaagaagcgcaaggcccgcgcggagaagttcggtatcacggaggagtcgcaggctgcgattgacgaggcggcgaagaagcttgaacgcgctaaacggttcggcacagcgggtgaagcgcctgctgtggagagcgtgagccggcttgaccaggctttgccggagggatcacggaagaggggtcgtggtgagaacgaccagggtggccgaggcggcaagaaacggaatcacaacgggcggaacaaccagcgccagcgtggtcgcggccatagaggccagggacaaggccagagccagaagcacggacaggcccagaaatctgctacgaataacggcgcctcgaatggctggagtgagaaggataaggcggccatggaggctcggaagaaacgcttcggcaccggcgcgtga

SEQ ID NO: 58038 - protein, 294 aa, Aspergillus nidulans FGSC A4
MATDYAKKTNAELVEILKSRNLPHTGKKADMVARLLEDDSSKAAAPAQNENADDVIDWEDDEVPAATSTTTTKAAETDAAAAAVAPAPAEETATAAPKAEETETDGAKSATGATKDSAKPSGTVEPTGAEEQAAQQPAEEKPAPNFALGLTVTDLEEELKKRKARAEKFGITEESQAAIDEAAKKLERAKRFGTAGEAPAVESVSRLDQALPEGSRKRGRGENDQGGRGGKKRNHNGRNNQRQRGRGHRGQGQGQSQKHGQAQKSATNNGASNGWSEKDKAAMEARKKRFGTGA

SEQ ID NO: 58039 - DNA, 693 bp, Candida glabrata CBS138
  CDS (1)..(693)
atgagcaattattctgcgttgactgtggtgcaattgaaggagctgctgactgagcgtaatctgtccgtcgcgggcttgaagaaccagttggttgagcgtttaactaacgatgacaaggccaaggaggctgctggtgaggctgctccagctcctgtgaccgaagaggctgcaccagcaccagctgctgcaccagtggctgctgaagttgaggaggccaagccagaagaggccaagccagaagaagaaacaaaggctgagccggccagcaatgaggctgctccagctgttgcaagcgagcagccagcggaagctagtgaggacaagcctgctgaggttcaagaaaaggcacctgaggtaaaagagccagagaaggagcttttcgatattctaacagcggaagagatcaagcaaagagccaccgaattgatagacaagaaacttcaccgtgcgaagaagttcggtgctgaacaagaccaaattgactcattggagaagctgaaggtgagaatcgatagatttggtgtcgaccgtaatatgtctattgctcttgaacttggcttggtaaagcctaaggaagtgcgtcaacaaaacagaagcaacaagaacaacaatagaaacggtcacaaaggaggtaataacaagaacagaaagggtagagtgaacaagaatagaggttctggtagaaggtggtaa

SEQ ID NO: 58040 - protein, 230 aa, Candida glabrata CBS138
MSNYSALTVVQLKELLTERNLSVAGLKNQLVERLTNDDKAKEAAGEAAPAPVTEEAAPAPAAAPVAAEVEEAKPEEAKPEEETKAEPASNEAAPAVASEQPAEASEDKPAEVQEKAPEVKEPEKELFDILTAEEIKQRATELIDKKLHRAKKFGAEQDQIDSLEKLKVRIDRFGVDRNMSIALELGLVKPKEVRQQNRSNKNNNRNGHKGGNNKNRKGRVNKNRGSGRRW

SEQ ID NO: 58041 - DNA, 732 bp, Kluyveromyces lactis NRRL Y-1140
  CDS (1)..(732)
atgttgacatttgatatatgtatacgtatcttggaaacgacttattggcatgcgcgactaccgagacaattggaaagtaaaacctcctcttttcccgacccgaactattcaaaaacatattctcctttgttcgctatgtcgtattctggtaacaccgttgctcaattgaaggagttgttgaagcaaagaaatctatctacagatggtttgaaagcagacctaataaacagactacaagatgatgactccacaaaaaacagtgcaaccaatgaaccatcgtctatagcggaagtagaagcgaccgcttctgccaccgctgccgctgcccctacgataacttcttccatcccagatgctgtacctgcagatgcatcagctgcggttcctgaaaatgaaaacgtaccatctaccgaagaagacaaactcgaaaaaactcctcctgctaccccagccccaaagaatccagagctatcgcaagatcaattgaaacaagcggccattgaccatttacagaaaaaaatctatcgtgctgaaaaattcggacaagatgattctaccatcgatgacttgcaaaggcagatcaaccgtattgaaaagttcggtttagatttgtctacccaattggctaaggagctaggattcggtaagggtcccgacgcagccgtcggtaagccagacaggaaatccttccagaagaaaaatcgtaataaatcaaacaacaaacgccgttaa

SEQ ID NO: 58042 - protein, 243 aa, Kluyveromyces lactis NRRL Y-1140
MLTFDICIRILETTYWHARLPRQLESKTSSFPDPNYSKTYSPLFAMSYSGNTVAQLKELLKQRNLSTDGLKADLINRLQDDDSTKNSATNEPSSIAEVEATASATAAAAPTITSSIPDAVPADASAAVPENENVPSTEEDKLEKTPPATPAPKNPELSQDQLKQAAIDHLQKKIYRAEKFGQDDSTIDDLQRQINRIEKFGLDLSTQLAKELGFGKGPDAAVGKPDRKSFQKKNRNKSNNKRR

SEQ ID NO: 58043 - DNA, 579 bp, Debaryomyces hansenii CBS767
  CDS (1)..(579)
atgtcagactactcatcccaaacagttgttcaattaaaagaattgctaacttcaagaagtttgccaacagatggtaaaaaggctgatttggttcaacgtttagttgacaacgatgcgcaatctagtggagcacaaccggaagaaacacaacaaactgaaagtactgctacttctgtagaagagccagtagctgaaaaagaatcagaatctaacaatgattcagaagcaactttgaaggtaattcaaccaacagaaaaaagtgaagaagctacgaatgaggaggaagccaagcaaaaacctccagttttgacaccagaagaaagaaaacaattagccgttcaattgataaacaaaaagattcaaagagcagaaaagtttggtgatgaaactgcagcagaggccgctagaaaagatttagctagagttgaaaaattcggagtagaattaggtactgcattggccagagagatcggtcttgttgacaaaagcttaccaaatggccataagaagcatttcaagaaaaactataaggacaagaaaaactttaagcccaacttcaaaaatagacgtagaaactaa

SEQ ID NO: 58044 - protein, 192 aa, Debaryomyces hansenii CBS767
MSDYSSQTVVQLKELLTSRSLPTDGKKADLVQRLVDNDAQSSGAQPEETQQTESTATSVEEPVAEKESESNNDSEATLKVIQPTEKSEEATNEEEAKQKPPVLTPEERKQLAVQLINKKIQRAEKFGDETAAEAARKDLARVEKFGVELGTALAREIGLVDKSLPNGHKKHFKKNYKDKKNFKPNFKNRRRN

SEQ ID NO: 58045 - DNA, 741 bp, Yarrowia lipolytica CLIB99
  CDS (1)..(741)
atgtccgactattccagcaaaaaagtggccgagctcaaggagcttttgtcggcccggggcctggctgtttccggcaacaaggccgatctggtggctcgattagaggaggccgacaaggccatcccggccgacaaggcggcggccaccgctgaggctggtgctgccgccgacgcagccgtcgacgcggccgtggaggagacttcctctgccaccgcgactgctcccgaggtgattgaggttgccaagaccgaggagtccgctcctgctgctgatgctgctgctgctgctgctgctgctgctaccaaggagactccctcgacctccaccgaagccatcaccgtggaagacgacgtggaggagacggttgtggagctttccgatgaggacaagcagaagcaggcaattgaggatctggaaaagcagatcaagcgaaagaagcggtttgcgaccggcgacaacgacgcagatatcgccgagctggaaaaacagctggagcgaatcaagcgattcggagtgactgccgtcgccacgaacgacctgtcgctggacaagggcctggacaccttggccaagggccgacgaaaggagagcggcaaggtgcgacgagagtccgtgtccgccaaggacaagaacacagcccacccctacaataagagcgagaacggtctcaagcccggcgtgaaaattgctactgtggacgaggagaagatcaaggcccgacaggcccgatttttccagtag

SEQ ID NO: 58046 - protein, 246 aa, Yarrowia lipolytica CLIB99
MSDYSSKKVAELKELLSARGLAVSGNKADLVARLEEADKAIPADKAAATAEAGAAADAAVDAAVEETSSATATAPEVIEVAKTEESAPAADAAAAAAAAATKETPSTSTEAITVEDDVEETVVELSDEDKQKQAIEDLEKQIKRKKRFATGDNDADIAELEKQLERIKRFGVTAVATNDLSLDKGLDTLAKGRRKESGKVRRESVSAKDKNTAHPYNKSENGLKPGVKIATVDEEKIKARQARFFQ

SEQ ID NO: 58047 - DNA, 1314 bp, Entamoeba histolytica HM-1:IMSS
  CDS (1)..(1314)
atgtctagattgaatagaggaggtaaaattgcatctcttattgatcgttatgaaaataacgacaaaaaaaagcaagaagatgctagaattgtagctgaagtccgtgcttctcctagaaaagcagctgaagcaaaggctaaagaagaagctgaagcaaaaaagatacaagaagaaaatgaaaaaaaaattttagaagaagccagaatcaaagaagaagctgaagcaaaagccaaagaagaagctgaagcaaaagctaaagaagaagctgaagcaaaagctaaagaagaagctgaagcaaaagctaaagaagaagctgaagcaaaagccaaagaagaagctgaagcaaaagctaaagaagaagctgaagcaaaagccaaagaagaagctgaagcaaaagctaaagaagaagctgaagcaaaagctaaagaagaagctgaagcaaaagctaaagaagaagctgaagcaaaagctaaagaagaagctgaagcaaaagccaaagaagaagctgaagcaaaagctaaagaagaagctgaagcaaaagccaaagaagaagctgaagcaaaagctaaagaagaagctgaagcaaaagctaaagaagaagctgaagcaaaagctaaagaagaagctgaagcaaaagctaaagaagaagctgaaaagaaagctaaagaagaagttaaagaagaaaataaagaagaagttaaagaagaagttaaagaagaagttaaagaagaagttaaagaagaaaataaagaagaaaataaagaagaaaataaagaagaaaataaagaagaaaataaagaagaaaataaagaagaaaataaagaagaaagtgaggttcaagatactacaccatctgaaagagtaatgtcaaaaggagagaagaaagcaagaaaagcacttgaaaaagttggacttgttgaagtaccaaatgttattgaattttcacttaaaagagcaggaagtaaattcgttattaatcagccagctgtttataaacttccatcaagtgaacattatgtagtatacggtgaaccaagaaatgaatatatggacgaaaagactaaacgtattcttgaacaacttcaagctaacatgaaagaacaacaaaatacaactgaagagaaaaaagaagaacaagtcaatgaaagtagtgctccagctaccactgaagctgttgaagatgatggatatgttccagttgaagctgatgtcaatgtgcttatgtctcaagctaacaccacacacgaaaaagcatatgcagctcttaaaaagacaaaaggtgatcttgtgagtgctttctttgaattccaataa

SEQ ID NO: 58048 - protein, 437 aa, Entamoeba histolytica HM-1:IMSS
MSRLNRGGKIASLIDRYENNDKKKQEDARIVAEVRASPRKAAEAKAKEEAEAKKIQEENEKKILEEARIKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEKKAKEEVKEENKEEVKEEVKEEVKEEVKEENKEENKEENKEENKEENKEENKEENKEESEVQDTTPSERVMSKGEKKARKALEKVGLVEVPNVIEFSLKRAGSKFVINQPAVYKLPSSEHYVVYGEPRNEYMDEKTKRILEQLQANMKEQQNTTEEKKEEQVNESSAPATTEAVEDDGYVPVEADVNVLMSQANTTHEKAYAALKKTKGDLVSAFFEFQ

SEQ ID NO: 58049 - DNA, 582 bp, Candida albicans SC5314
  CDS (1)..(582): transl_table=12
atgtcagattattcaactcaaacagtagctcaattaaaggagattttaaaaggaaaaggtttatcaattgaaggtaaaaaagcagatttagttcaaagattacatgaacacgacactcaacaacaacaaccaccaccacaacaacaacaaccagaaccagaagtagccgaacaacaaccagagcaaccagaaactaaattagagggaaaaacacaagaaaatgaaagcacactaactgttattcaaccaaaagaacaacaacaacaacaacaacaacaagaagaaccaaaaccaaaacaattatctccagaagaaaggaaacaattagctattgaattattaactaaaaaagttcaacgtgctgaaaaatttggtgatgaacaagctgctaatgatgcaaaaaaagatttggcaagagtagagaaatttggagttgaattgggaacagcattggctagagaaattggattagtggataattccttatcaaacaagaaatttaatcatcataaacgtaataataaacgtggattcaagggtaataaaggtagaaaaggggggtttagaaagaatcgtaattag

SEQ ID NO: 58050 - protein, 193 aa, Candida albicans SC5314
MSDYSTQTVAQLKEILKGKGLSIEGKKADLVQRLHEHDTQQQQPPPQQQQPEPEVAEQQPEQPETKLEGKTQENESTLTVIQPKEQQQQQQQQEEPKPKQLSPEERKQLAIELLTKKVQRAEKFGDEQAANDAKKDLARVEKFGVELGTALAREIGLVDNSLSNKKFNHHKRNNKRGFKGNKGRKGGFRKNRN

SEQ ID NO: 58051 - DNA, 909 bp, Aspergillus fumigatus Af293
  CDS (1)..(909)
atgaccaccgactacagcaagaagacgaacgcggagctagtggagattctcaaatctcgctcgctccctcacacaggcaagaaggcggagatggtcgctcgcctccaggaagacgaccaaaacaaagccaaggccgcaacggcccctgcccctgcccctgctgcaaagactgacgccgcggacgacgtcattgactgggaagatgatgatgtacctgctgctgatactactgccgtgaagccttcaactgaggctggcgccgctgccattgctgctggcggcaaaggtgcggtcgccaaccccgtcgctgttccgaaccagaaagtcgataccgaccccgctactacgaacgatctgaaggtcgaatcaaagggcgcggcaccatcggccgagagtggggcgcaagggcacgaaggcacggaaggtgcgccagttgaggcagcacctgctgcgccggccgaagaaaaaccggcaccggactattctatggggctgcccatcaccgagatggaagaggagttgaagaaacgcaaggctcgcgcggagaagtttggtattaccgaggagtctaaggctgcaattgcggaggcggagaagcaactcgaaagggcgaagcggttcggtactgtggttcatcctactcctgctggtggtgtcaaaggcctggacgaagctctcccgacagagaagtctcgcaagagaggccggggtgataatgaccaagcctcacgagggggcaagcgacgtgatattggcggccgaggcaaattccggggaaaaggccgcggaaatcgaaaccagaatcaacggaatgaaggaaacgctgggaaaacaagcgggcagagtaacctgagtgagaaagatcgaaagaaacaagtaatagtctcaattactggatcggaatattag

SEQ ID NO: 58052 - protein, 302 aa, Aspergillus fumigatus Af293
MTTDYSKKTNAELVEILKSRSLPHTGKKAEMVARLQEDDQNKAKAATAPAPAPAAKTDAADDVIDWEDDDVPAADTTAVKPSTEAGAAAIAAGGKGAVANPVAVPNQKVDTDPATTNDLKVESKGAAPSAESGAQGHEGTEGAPVEAAPAAPAEEKPAPDYSMGLPITEMEEELKKRKARAEKFGITEESKAAIAEAEKQLERAKRFGTVVHPTPAGGVKGLDEALPTEKSRKRGRGDNDQASRGGKRRDIGGRGKFRGKGRGNRNQNQRNEGNAGKTSGQSNLSEKDRKKQVIVSITGSEY

SEQ ID NO: 58053 - DNA, 792 bp, Ustilago maydis 521
  CDS (1)..(792)
atggagaccaaacttcaagcgctgagagtgaccgacctgaaggcgttgctcacctcggctggcttgttggtctcgggtaacaagccggatttgatccagaggttgttggagaacccaagtgctacagcttcacttggtggagcagagcaagagacagaggcagcagcaacagcggcagcagcagaagcggttccgacacccgctgcgacttcggtacaagcactagccccggcagcggtagcggtagaagcgttgccggcagcatccgcgtctgcacccgcgcccgcgcccgtggccgcatttgtcgcacctgtcgcatccgttcctgcacaagtcaacaacggatcaccagtagaagcgcctccacagcccgaggcggaagcgcaccgtcaagcgcttatcgtcgaactggagaaacgcaagcagcgagcggccaagttcggccaacctctcggcgaggcggaacgcaaactggaacgcgccatcaagttcggcctggacgccgaagaccaagccaacgtggccaagctcatgcaaccgctcggatccagaccggcaaaacccgccaagccgaccaagcagagttcagacaagacaacaccagtgcataccgaacaagagaacaaggctcgattcgcgcaattgcaagtggacaaggagaaggcgaaaaagcgcgctgagagattcggcttggtcaacgaggcgcgcgagcttgatgaggaaaagaaacgcaagcgcaacgcgcgcgacgacggcgcgttgacggatgcagacaagaagatcaaggcttga

SEQ ID NO: 58054 - protein, 263 aa, Ustilago maydis 521
METKLQALRVTDLKALLTSAGLLVSGNKPDLIQRLLENPSATASLGGAEQETEAAATAAAAEAVPTPAATSVQALAPAAVAVEALPAASASAPAPAPVAAFVAPVASVPAQVNNGSPVEAPPQPEAEAHRQALIVELEKRKQRAAKFGQPLGEAERKLERAIKFGLDAEDQANVAKLMQPLGSRPAKPAKPTKQSSDKTTPVHTEQENKARFAQLQVDKEKAKKRAERFGLVNEARELDEEKKRKRNARDDGALTDADKKIKA

SEQ ID NO: 58055 - DNA, 1035 bp, Neurospora crassa
  CDS (1)..(1035)
atgtcggactacaacagcatgaaggtccccgagctcaagaagctcctcaacgagcgctctttgccccagaccggcaacaaggccgacctgatcgctcgtcttcaggagcacgacaaacagcaggcgaagcccgccgatgccgcgcccgccaccaccaagaaggacggcgaggctgaggatgaaattgactacgaggatgatgacttccccgccggcgacaagaaggccgccaccgagaccaccgacgagaaagcccctgccagcgccgccgccgccgagactgctacagagtcagagcccaaggccccagtagaatccgaggcacagaagacaacagaagccgcccccgctgccgctgccagcacagaacaacccgccgcttcttccgctcagggagaggaggtcgccgccaaggacactactaccgccaccgctactactgccgaagatcccagcaaagcagaggagcagaagccggccgagcctctcttctcccaacaccttccccccaccgatgccaagtccgaagccgagaagcgcgccgcccgcgccgcccgctttggcatcacgacagacgagaagtccgaggaggcccagaaagctgcgcgcgccgcccgctttggcctggctaacgaccaggtgtcagctcttgacagcgcgttacccgataggccgcgcaagcgtggtcgtggcggcaaagaggagggtgctggcgaggagggtggcagtgagagggcagctaagcagcagaagaccactgctgctgctcctcaagagaacaagggcggcaaccagaggcaaggtggtggtggtggtggtgctggtggtggaaggaacaggcatgggaggaataggaacaacaacaacaacaacaacaacaaccgtggtggtcaaagtcaaaacagcagcaggcaacaagggaatcagcccaagcaacagcagcaacaacagaaaaagcctgctgctgctctcgacccagcggaaaaggccaagatggaggctagagcgaagcgctttgctgctgcgtcctcctaa

SEQ ID NO: 58056 - protein, 344 aa, Neurospora crassa
MSDYNSMKVPELKKLLNERSLPQTGNKADLIARLQEHDKQQAKPADAAPATTKKDGEAEDEIDYEDDDFPAGDKKAATETTDEKAPASAAAAETATESEPKAPVESEAQKTTEAAPAAAASTEQPAASSAQGEEVAAKDTTTATATTAEDPSKAEEQKPAEPLFSQHLPPTDAKSEAEKRAARAARFGITTDEKSEEAQKAARAARFGLANDQVSALDSALPDRPRKRGRGGKEEGAGEEGGSERAAKQQKTTAAAPQENKGGNQRQGGGGGGAGGGRNRHGRNRNNNNNNNNNRGGQSQNSSRQQGNQPKQQQQQQKKPAAALDPAEKAKMEARAKRFAAASS

SEQ ID NO: 58057 - DNA, 738 bp, Schizosaccharomyces pombe
  CDS (1)..(738)
atgtcagattacaagagtcttaaagttgcagaactgcgtgaaaaacttgcggagaaaggcctctccactgctggaaacaaagctgaattggtaagccgattgacagcagcgaccgagagtaacgatgaaaatacttcgaataacaacgctacagatctaggagatcttgctcctcccgaggatgatattgattggggagacatggagaatgatactatttcaactgacgttaacaagccagcagaacccgaaagtaaagagaccagtgctcctgccgctgctgtagagattgaaaaggaaaatgaaagcattatttcgaaagagacttcacaagctcctgaaacttccactggtgctgaagagcatcaagaaaccacagaggaatccaaacaaagtgtatctaatgaagtctctagcccagatgtagctaaagagcaagaaaaactcatccaaagggctaaacgatttggcattcctgtggacgatgaacaaattaagaaagctgctcgtgctgcacgttttggcattcaacaacctttagcgtcaagtaataacaaaaaccataatcaatctaagaaccctcaaaatcgttccaactcacgttctaaacaaagaaataagaatgcgcctcctaaaagtgctccatccaagcggaagagtaatattttggacgaccctatagaggcagaaaaagctaggaagcgtgctgagcgctttggtgttgctgccaagaattaa

SEQ ID NO: 58058 - protein, 245 aa, Schizosaccharomyces pombe
MSDYKSLKVAELREKLAEKGLSTAGNKAELVSRLTAATESNDENTSNNNATDLGDLAPPEDDIDWGDMENDTISTDVNKPAEPESKETSAPAAAVEIEKENESIISKETSQAPETSTGAEEHQETTEESKQSVSNEVSSPDVAKEQEKLIQRAKRFGIPVDDEQIKKAARAARFGIQQPLASSNNKNHNQSKNPQNRSNSRSKQRNKNAPPKSAPSKRKSNILDDPIEAEKARKRAERFGVAAKN

SEQ ID NO: 58059 - DNA, 25 bp, Artificial sequence
  (1)..(25): primer
atggcagattattcttcccttactg

SEQ ID NO: 58060 - DNA, 24 bp, Artificial sequence
  (1)..(24): primer
ttatcttctgtaaccagagcggtt

SEQ ID NO: 58061 - protein, 210 aa, Artificial sequence
  Variant (2)..(5): xaa in position 2 to 5 is any amino acid
  Variant (7)..(8): xaa in position 7 to 8 is any amino acid
  Variant (11)..(11): xaa in position 11 is any amino acid
  Variant (14)..(15): xaa in position 14 to 15 is any amino acid
  Variant (17)..(17): xaa in position 17 is any amino acid
  Variant (19)..(21): xaa in position 19 to 21 is any amino acid
  Variant (23)..(23): xaa in position 23 is any amino acid
  Variant (25)..(25): xaa in position 25 is any amino acid
  Variant (29)..(29): xaa in position 29 is any amino acid
  Variant (32)..(34): xaa in position 32 to 34 is any amino acid
  Variant (36)..(85): xaa in position 36 to 85 is any amino acid
  Variant (86)..(146): xaa in position 86 to 146 is any or no amino acid
  Variant (148)..(158): xaa in position 148 to 158 is any amino acid
  Variant (159)..(176): xaa in position 159 to 176 is any or no amino acid
  Variant (178)..(180): xaa in position 178 to 180 is any amino acid
  Variant (183)..(183): xaa in position 183 is any amino acid
  Variant (187)..(193): xaa in position 187 to 193 is any amino acid
  Variant (194)..(199): xaa in position 194 to 199 is any or no amino acid
  Variant (201)..(203): xaa in position 201 to 203 is any amino acid
  Variant (205)..(206): xaa in position 205 to 206 is any amino acid
YXXXXVXXLKXLLXXRXLXXXGXKXDLVXRLXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXKXXXRAXKFGXXXXXXXXXXXXXKXXXRXXKFGV

SEQ ID NO: 58062 - protein, 31 aa, Artificial sequence
  Variant (2)..(2): xaa in position 2 is Ala, Pro, Thr or Val
  Variant (3)..(3): xaa in position 3 is Asp, Glu or Gln
  Variant (5)..(5): xaa in position 5 is Lys or Arg
  Variant (6)..(7): xaa in position 6 to 7 is any amino acid
  Variant (9)..(11): xaa in position 9 to 11 is any amino acid
  Variant (12)..(12): xaa in position 12 is Glu, Gly, Asn or Ser
  Variant (14)..(15): xaa in position 14 to 15 is any amino acid
  Variant (16)..(16): xaa in position 16 is Ala, Asp, Glu, Gly, Asn, Gln, Ser or Thr
  Variant (18)..(18): xaa in position 18 is any or no amino acid
  Variant (20)..(21): xaa in position 20 to 21 is any amino acid
  Variant (22)..(22): xaa in position 22 is any or no amino acid
  Variant (24)..(24): xaa in position 24 is Ile or Val
  Variant (25)..(25): xaa in position 25 is Ala, Asp, Glu, Asn, Gln or Ser
  Variant (28)..(30): xaa in position 28 to 30 is any amino acid
  Variant (31)..(31): xaa in position 31 is Asp, Pro or Thr
VXXLXXXLXXXXLXXXGXKXXXLXXRLXXXX

SEQ ID NO: 58063 - protein, 17 aa, Artificial sequence
  Variant (2)..(4): xaa in position 2 to 4 is any amino acid
  Variant (7)..(7): xaa in position 7 is any amino acid
  Variant (8)..(8): xaa in position 8 is Lys or Arg
  Variant (11)..(11): xaa in position 11 is any amino acid
  Variant (12)..(12): xaa in position 12 is Asp, Glu, Pro or Thr
  Variant (13)..(14): xaa in position 13 to 14 is any amino acid
  Variant (15)..(15): xaa in position 15 is Ala, Asp, Glu, Gln, Ser or Thr
  Variant (16)..(16): xaa in position 16 is any amino acid
  Variant (17)..(17): xaa in position 17 is Ala, Asp, Glu, Gly, Gln or Ser
KXXXRAXXFGXXXXXXX

SEQ ID NO: 58064 - DNA, 1512 bp, Saccharomyces cerevisiae; identical to SEQ ID NO: 45354
  CDS (1)..(1512)

SEQ ID NO: 58065 - protein, 503 aa, Saccharomyces cerevisiae; identical to SEQ ID NO: 45355

SEQ ID NO: 58066 - DNA, 1479 bp, Homo sapiens; identical to SEQ ID NO: 45356
  CDS (1)..(1479)

SEQ ID NO: 58067 - protein, 492 aa, Homo sapiens; identical to SEQ ID NO: 45357

SEQ ID NO: 58068 - DNA, 1215 bp, Xenopus tropicalis; identical to SEQ ID NO: 45358
  CDS (1)..(1215)

SEQ ID NO: 58069 - protein, 404 aa, Xenopus tropicalis; identical to SEQ ID NO: 45359

SEQ ID NO: 58070 - DNA, 1248 bp, Mus musculus; identical to SEQ ID NO: 45360
  CDS (1)..(1248)

SEQ ID NO: 58071 - protein, 415 aa, Mus musculus; identical to SEQ ID NO: 45361

SEQ ID NO: 58072 - DNA, 1092 bp, Archaeoglobus fulgidus DSM 4304; identical to SEQ ID NO: 45362
  CDS (1)..(1092): transl_table=11

SEQ ID NO: 58073 - protein, 363 aa, Archaeoglobus fulgidus DSM 4304; identical to SEQ ID NO: 45363

SEQ ID NO: 58074 - DNA, 1212 bp, Arabidopsis thaliana; identical to SEQ ID NO: 45364
  CDS (1)..(1212)

SEQ ID NO: 58075 - protein, 403 aa, Arabidopsis thaliana; identical to SEQ ID NO: 45365

SEQ ID NO: 58076 - DNA, 2772 bp, Bacillus halodurans C-125; identical to SEQ ID NO: 45366
  CDS (1)..(2772): transl_table=11

SEQ ID NO: 58077 - protein, 923 aa, Bacillus halodurans C-125; identical to SEQ ID NO: 45367

SEQ ID NO: 58078 - DNA, 1119 bp, Clostridium acetobutylicum ATCC 824; identical to SEQ ID NO: 45368
  CDS (1)..(1119): transl_table=11

SEQ ID NO: 58079 - protein, 372 aa, Clostridium acetobutylicum ATCC 824; identical to SEQ ID NO: 45369

SEQ ID NO: 58080 - DNA, 1203 bp, Caenorhabditis elegans; identical to SEQ ID NO: 45370
  CDS (1)..(1203)

SEQ ID NO: 58081 - protein, 400 aa, Caenorhabditis elegans; identical to SEQ ID NO: 45371

SEQ ID NO: 58082 - DNA, 1314 bp, Caenorhabditis elegans; identical to SEQ ID NO: 45372
  CDS (1)..(1314)

SEQ ID NO: 58083 - protein, 437 aa, Caenorhabditis elegans; identical to SEQ ID NO: 45373

SEQ ID NO: 58084 - DNA, 1215 bp, Thermoanaerobacter tengcongensis MB4; identical to SEQ ID NO: 45374
  CDS (1)..(1215): transl_table=11

SEQ ID NO: 58085 - protein, 404 aa, Thermoanaerobacter tengcongensis MB4; identical to SEQ ID NO: 45375

SEQ ID NO: 58086 - DNA, 1275 bp, Drosophila melanogaster; identical to SEQ ID NO: 45376
  CDS (1)..(1275)

SEQ ID NO: 58087 - protein, 424 aa, Drosophila melanogaster; identical to SEQ ID NO: 45377

SEQ ID NO: 58088 - DNA, 1428 bp, Drosophila melanogaster; identical to SEQ ID NO: 45378
  CDS (1)..(1428)

SEQ ID NO: 58089 - protein, 475 aa, Drosophila melanogaster; identical to SEQ ID NO: 45379

SEQ ID NO: 58090 - DNA, 1353 bp, Mus musculus; identical to SEQ ID NO: 45380
  CDS (1)..(1353)

SEQ ID NO: 58091 - protein, 450 aa, Mus musculus; identical to SEQ ID NO: 45381

SEQ ID NO: 58092 - DNA, 972 bp, Homo sapiens; identical to SEQ ID NO: 45382
  CDS (1)..(972)

SEQ ID NO: 58093 - protein, 323 aa, Homo sapiens; identical to SEQ ID NO: 45383

SEQ ID NO: 58094 - DNA, 1464 bp, Xenopus tropicalis; identical to SEQ ID NO: 45384
  CDS (1)..(1464)

SEQ ID NO: 58095 - protein, 487 aa, Xenopus tropicalis; identical to SEQ ID NO: 45385

SEQ ID NO: 58096 - DNA, 1248 bp, Rattus norvegicus; identical to SEQ ID NO: 45386
  CDS (1)..(1248)

SEQ ID NO: 58097 - protein, 415 aa, Rattus norvegicus; identical to SEQ ID NO: 45387

SEQ ID NO: 58098 - DNA, 1242 bp, Anopheles gambiae str. PEST; identical to SEQ ID NO: 45388
  CDS (1)..(1242)

SEQ ID NO: 58099 - protein, 413 aa, Anopheles gambiae str. PEST; identical to SEQ ID NO: 45389

SEQ ID NO: 58100 - DNA, 1479 bp, Rattus norvegicus; identical to SEQ ID NO: 45390
  CDS (1)..(1479)

SEQ ID NO: 58101 - protein, 492 aa, Rattus norvegicus; identical to SEQ ID NO: 45391

SEQ ID NO: 58102 - DNA, 1950 bp, Magnaporthe grisea 70-15; identical to SEQ ID NO: 45392
  CDS (1)..(1950)

SEQ ID NO: 58103 - protein, 649 aa, Magnaporthe grisea 70-15; identical to SEQ ID NO: 45393

SEQ ID NO: 58104 - DNA, 1422 bp, Gibberella zeae PH-1; identical to SEQ ID NO: 45394
  CDS (1)..(1422)

SEQ ID NO: 58105 - protein, 473 aa, Gibberella zeae PH-1; identical to SEQ ID NO: 45395

SEQ ID NO: 58106 - DNA, 1437 bp, Aspergillus nidulans FGSC A4; identical to SEQ ID NO: 45396
  CDS (1)..(1437)

SEQ ID NO: 58107 - protein, 478 aa, Aspergillus nidulans FGSC A4; identical to SEQ ID NO: 45397

SEQ ID NO: 58108 - DNA, 1557 bp, Gallus gallus; identical to SEQ ID NO: 45398
  CDS (1)..(1557)

SEQ ID NO: 58109 - protein, 518 aa, Gallus gallus; identical to SEQ ID NO: 45399

SEQ ID NO: 58110 - DNA, 972 bp, Gallus gallus; identical to SEQ ID NO: 45400
  CDS (1)..(972)

SEQ ID NO: 58111 - protein, 323 aa, Gallus gallus; identical to SEQ ID NO: 45401

SEQ ID NO: 58112 - DNA, 1257 bp, Oryza sativa (japonica cultivar-group); identical to SEQ ID NO: 45402
  CDS (1)..(1257)

SEQ ID NO: 58113 - protein, 418 aa, Oryza sativa (japonica cultivar-group); identical to SEQ ID NO: 45403

SEQ ID NO: 58114 - DNA, 1311 bp, Pan troglodytes; identical to SEQ ID NO: 45404
  CDS (1)..(1311)

SEQ ID NO: 58115 - protein, 436 aa, Pan troglodytes; identical to SEQ ID NO: 45405

SEQ ID NO: 58116 - DNA, 1251 bp, Canis familiaris; identical to SEQ ID NO: 45406
  CDS (1)..(1251)

SEQ ID NO: 58117 - protein, 416 aa, Canis familiaris; identical to SEQ ID NO: 45407

SEQ ID NO: 58118 - DNA, 1506 bp, Cryptococcus neoformans var. neoformans JEC21; identical to SEQ ID NO: 45408
  CDS (1)..(1506)

SEQ ID NO: 58119 - protein, 501 aa, Cryptococcus neoformans var. neoformans JEC21; identical to SEQ ID NO: 45409

SEQ ID NO: 58120 - DNA, 1251 bp, Bos taurus; identical to SEQ ID NO: 45410
  CDS (1)..(1251)

SEQ ID NO: 58121 - protein, 416 aa, Bos taurus; identical to SEQ ID NO: 45411

SEQ ID NO: 58122 - DNA, 1500 bp, Bos taurus; identical to SEQ ID NO: 45412
  CDS (1)..(1500)

SEQ ID NO: 58123 - protein, 499 aa, Bos taurus; identical to SEQ ID NO: 45413

SEQ ID NO: 58124 - DNA, 1224 bp, Apis mellifera; identical to SEQ ID NO: 45414
  CDS (1)..(1224)

SEQ ID NO: 58125 - protein, 407 aa, Apis mellifera; identical to SEQ ID NO: 45415

SEQ ID NO: 58126 - DNA, 1428 bp, Cryptosporidium parvum; identical to SEQ ID NO: 45416
  CDS (1)..(1428)

SEQ ID NO: 58127 - protein, 475 aa, Cryptosporidium parvum; identical to SEQ ID NO: 45417

SEQ ID NO: 58128 - DNA, 1518 bp, Dictyostelium discoideum; identical to SEQ ID NO: 45418
  CDS (1)..(1518)

SEQ ID NO: 58129 - protein, 505 aa, Dictyostelium discoideum; identical to SEQ ID NO: 45419

SEQ ID NO: 58130 - DNA, 1263 bp, Dictyostelium discoideum; identical to SEQ ID NO: 45420
  CDS (1)..(1263)

SEQ ID NO: 58131 - protein, 420 aa, Dictyostelium discoideum; identical to SEQ ID NO: 45421

SEQ ID NO: 58132 - DNA, 1143 bp, Entamoeba histolytica HM-1:IMSS; identical to SEQ ID NO: 45422
  CDS (1)..(1143)

SEQ ID NO: 58133 - protein, 380 aa, Entamoeba histolytica HM-1:IMSS; identical to SEQ ID NO: 45423

SEQ ID NO: 58134 - DNA, 1338 bp, Entamoeba histolytica HM-1:IMSS; identical to SEQ ID NO: 45424
  CDS (1)..(1338)

SEQ ID NO: 58135 - protein, 445 aa, Entamoeba histolytica HM-1:IMSS; identical to SEQ ID NO: 45425

SEQ ID NO: 58136 - DNA, 1392 bp, Cryptosporidium hominis; identical to SEQ ID NO: 45426
  CDS (1)..(1392)

SEQ ID NO: 58137 - protein, 463 aa, Cryptosporidium hominis; identical to SEQ ID NO: 45427

SEQ ID NO: 58138 - DNA, 1344 bp, Cryptosporidium hominis; identical to SEQ ID NO: 45428
  CDS (1)..(1344)

SEQ ID NO: 58139 - protein, 447 aa, Cryptosporidium hominis; identical to SEQ ID NO: 45429

SEQ ID NO: 58140 - DNA, 1572 bp, Danio rerio; identical to SEQ ID NO: 45430
  CDS (1)..(1572)

SEQ ID NO: 58141 - protein, 523 aa, Danio rerio; identical to SEQ ID NO: 45431

SEQ ID NO: 58142 - DNA, 1413 bp, Aspergillus fumigatus Af293; identical to SEQ ID NO: 45432
  CDS (1)..(1413)

SEQ ID NO: 58143 - protein, 470 aa, Aspergillus fumigatus Af293; identical to SEQ ID NO: 45433

SEQ ID NO: 58144 - DNA, 1818 bp, Ustilago maydis 521; identical to SEQ ID NO: 45434
  CDS (1)..(1818)

SEQ ID NO: 58145 - protein, 605 aa, Ustilago maydis 521; identical to SEQ ID NO: 45435

SEQ ID NO: 58146 - DNA, 1431 bp, Strongylocentrotus purpuratus; identical to SEQ ID NO: 45436
  CDS (1)..(1431)

SEQ ID NO: 58147 - protein, 476 aa, Strongylocentrotus purpuratus; identical to SEQ ID NO: 45437

SEQ ID NO: 58148 - DNA, 1236 bp, Strongylocentrotus purpuratus; identical to SEQ ID NO: 45438
  CDS (1)..(1236)

SEQ ID NO: 58149 - protein, 411 aa, Strongylocentrotus purpuratus; identical to SEQ ID NO: 45439

SEQ ID NO: 58150 - DNA, 1518 bp, Trypanosoma cruzi; identical to SEQ ID NO: 45440
  CDS (1)..(1518)

SEQ ID NO: 58151 - protein, 505 aa, Trypanosoma cruzi; identical to SEQ ID NO: 45441

SEQ ID NO: 58152 - DNA, 1530 bp, Trypanosoma brucei; identical to SEQ ID NO: 45442
  CDS (1)..(1530)

SEQ ID NO: 58153 - protein, 509 aa, Trypanosoma brucei; identical to SEQ ID NO: 45443

SEQ ID NO: 58154 - DNA, 1086 bp, Synechococcus elongatus PCC 6301; identical to SEQ ID NO: 45444
  CDS (1)..(1086): transl_table=11

SEQ ID NO: 58155 - protein, 361 aa, Synechococcus elongatus PCC 6301; identical to SEQ ID NO: 45445

SEQ ID NO: 58156 - DNA, 1056 bp, Methanosarcina barkeri str. fusaro; identical to SEQ ID NO: 45446
  CDS (1)..(1056): transl_table=11

SEQ ID NO: 58157 - protein, 351 aa, Methanosarcina barkeri str. fusaro; identical to SEQ ID NO: 45447

SEQ ID NO: 58158 - DNA, 1524 bp, Nostoc punctiforme PCC 73102; identical to SEQ ID NO: 45448
  CDS (1)..(1524)

SEQ ID NO: 58159 - protein, 507 aa, Nostoc punctiforme PCC 73102; identical to SEQ ID NO: 45449

SEQ ID NO: 58160 - DNA, 1125 bp, Cytophaga hutchinsonii; identical to SEQ ID NO: 45450
  CDS (1)..(1125)

SEQ ID NO: 58161 - protein, 374 aa, Cytophaga hutchinsonii; identical to SEQ ID NO: 45451

SEQ ID NO: 58162 - DNA, 1995 bp, Mus musculus; identical to SEQ ID NO: 45452
  CDS (7)..(1485)

SEQ ID NO: 58163 - protein, 492 aa, Mus musculus; identical to SEQ ID NO: 45453

SEQ ID NO: 58164 - DNA, 1446 bp, Xenopus laevis; identical to SEQ ID NO: 45454
  CDS (1)..(1446)

SEQ ID NO: 58165 - protein, 481 aa, Xenopus laevis; identical to SEQ ID NO: 45455

SEQ ID NO: 58166 - DNA, 2310 bp, Tetraodon nigroviridis; identical to SEQ ID NO: 45456
  CDS (1)..(2310)

SEQ ID NO: 58167 - protein, 769 aa, Tetraodon nigroviridis; identical to SEQ ID NO: 45457

SEQ ID NO: 58168 - DNA, 1350 bp, Schistosoma japonicum; identical to SEQ ID NO: 45458
  CDS (61)..(1248)

SEQ ID NO: 58169 - protein, 395 aa, Schistosoma japonicum; identical to SEQ ID NO: 45459

SEQ ID NO: 58170 - DNA, 1479 bp, Homo sapiens; identical to SEQ ID NO: 45460
  CDS (1)..(1479)

SEQ ID NO: 58171 - protein, 492 aa, Homo sapiens; identical to SEQ ID NO: 45461

SEQ ID NO: 58172 - DNA, 1728 bp, Caenorhabditis briggsae; identical to SEQ ID NO: 45462
  CDS (1)..(1728)

SEQ ID NO: 58173 - protein, 575 aa, Caenorhabditis briggsae; identical to SEQ ID NO: 45463

SEQ ID NO: 58174 - DNA, 1215 bp, Xenopus laevis; identical to SEQ ID NO: 45464
  CDS (1)..(1215)

SEQ ID NO: 58175 - protein, 404 aa, Xenopus laevis; identical to SEQ ID NO: 45465

SEQ ID NO: 58176 - DNA, 987 bp, Homo sapiens; identical to SEQ ID NO: 45466
  CDS (1)..(987)

SEQ ID NO: 58177 - protein, 328 aa, Homo sapiens; identical to SEQ ID NO: 45467

SEQ ID NO: 58178 - DNA, 1272 bp, Brachydanio rerio; identical to SEQ ID NO: 45468
  CDS (1)..(1272)

SEQ ID NO: 58179 - protein, 423 aa, Brachydanio rerio; identical to SEQ ID NO: 45469

SEQ ID NO: 58180 - DNA, 1527 bp, Brachydanio rerio; identical to SEQ ID NO: 45470
  CDS (1)..(1527)

SEQ ID NO: 58181 - protein, 508 aa, Brachydanio rerio; identical to SEQ ID NO: 45471

SEQ ID NO: 58182 - DNA, 1275 bp, Drosophila melanogaster; identical to SEQ ID NO: 45472
  CDS (1)..(1275)

SEQ ID NO: 58183 - protein, 424 aa, Drosophila melanogaster; identical to SEQ ID NO: 45473

SEQ ID NO: 58184 - DNA, 1095 bp, Homo sapiens; identical to SEQ ID NO: 45474
  CDS (1)..(1095)

SEQ ID NO: 58185 - protein, 364 aa, Homo sapiens; identical to SEQ ID NO: 45475

SEQ ID NO: 58186 - DNA, 1092 bp, Actinobacillus actinomycetemcomitans; identical to SEQ ID NO: 45476
  CDS (1)..(1092): transl_table=11

SEQ ID NO: 58187 - protein, 363 aa, Actinobacillus actinomycetemcomitans; identical to SEQ ID NO: 45477

SEQ ID NO: 58188 - DNA, 1218 bp, Arabidopsis thaliana; identical to SEQ ID NO: 45478
  CDS (1)..(1218)

SEQ ID NO: 58189 - protein, 405 aa, Arabidopsis thaliana; identical to SEQ ID NO: 45479

SEQ ID NO: 58190 - DNA, 1416 bp, Schizosaccharomyces pombe; identical to SEQ ID NO: 45480
  CDS (1)..(1416)

SEQ ID NO: 58191 - protein, 471 aa, Schizosaccharomyces pombe; identical to SEQ ID NO: 45481

SEQ ID NO: 58192 - DNA, 1647 bp, Saccharomyces cerevisiae; identical to SEQ ID NO: 45482
  CDS (1)..(1647)

SEQ ID NO: 58193 - protein, 548 aa, Saccharomyces cerevisiae; identical to SEQ ID NO: 45483

SEQ ID NO: 58194 - DNA, 1545 bp, Ashbya gossypii; identical to SEQ ID NO: 45484
  CDS (1)..(1545)

SEQ ID NO: 58195 - protein, 514 aa, Ashbya gossypii; identical to SEQ ID NO: 45485

SEQ ID NO: 58196 - DNA, 1377 bp, Candida glabrata; identical to SEQ ID NO: 45486
  CDS (1)..(1377)

SEQ ID NO: 58197 - protein, 458 aa, Candida glabrata; identical to SEQ ID NO: 45487

SEQ ID NO: 58198 - DNA, 1431 bp, Debaryomyces hansenii; identical to SEQ ID NO: 45488
  CDS (1)..(1431)

SEQ ID NO: 58199 - protein, 476 aa, Debaryomyces hansenii; identical to SEQ ID NO: 45489

SEQ ID NO: 58200 - DNA, 1251 bp, Homo sapiens; identical to SEQ ID NO: 45490
  CDS (1)..(1251)

SEQ ID NO: 58201 - protein, 416 aa, Homo sapiens; identical to SEQ ID NO: 45491

SEQ ID NO: 58202 - DNA, 1512 bp, Kluyveromyces lactis; identical to SEQ ID NO: 45492
  CDS (1)..(1512)

SEQ ID NO: 58203 - protein, 503 aa, Kluyveromyces lactis; identical to SEQ ID NO: 45493

SEQ ID NO: 58204 - DNA, 1248 bp, Mus musculus; identical to SEQ ID NO: 45494
  CDS (1)..(1248)

SEQ ID NO: 58205 - protein, 415 aa, Mus musculus; identical to SEQ ID NO: 45495

SEQ ID NO: 58206 - DNA, 1416 bp, Neurospora crassa; identical to SEQ ID NO: 45496
  CDS (1)..(1416)

SEQ ID NO: 58207 - protein, 471 aa, Neurospora crassa; identical to SEQ ID NO: 45497

SEQ ID NO: 58208 - DNA, 1368 bp, Rhizomucor pusillus; identical to SEQ ID NO: 45498
  CDS (1)..(1368)

SEQ ID NO: 58209 - protein, 455 aa, Rhizomucor pusillus; identical to SEQ ID NO: 45499

SEQ ID NO: 58210 - DNA, 1536 bp, Schizosaccharomyces pombe; identical to SEQ ID NO: 45500
  CDS (1)..(1536)

SEQ ID NO: 58211 - protein, 511 aa, Schizosaccharomyces pombe; identical to SEQ ID NO: 45501

SEQ ID NO: 58212 - DNA, 1383 bp, Yarrowia lipolytica; identical to SEQ ID NO: 45502
  CDS (1)..(1383)

SEQ ID NO: 58213 - protein, 460 aa, Yarrowia lipolytica; identical to SEQ ID NO: 45503

SEQ ID NO: 58214 - DNA, 27 bp, Artificial sequence
  (1)..(27): primer
atgattgaaaaggataaaagaacgatt

SEQ ID NO: 58215 - DNA, 26 bp, Artificial sequence
  (1)..(26): primer
ttatatttcttcataagggtaggaga

SEQ ID NO: 58216 - protein, 581 aa, Artificial sequence; identical to SEQ ID NO: 45506
  Variant (2)..(7): xaa in position 2 to 7 is any amino acid
  Variant (8)..(8): xaa in position 8 is any or no amino acid
  Variant (10)..(15): xaa in position 10 to 15 is any amino acid
  Variant (17)..(22): xaa in position 17 to 22 is any amino acid
  Variant (23)..(28): xaa in position 23 to 28 is any or no amino acid
  Variant (30)..(46): xaa in position 30 to 46 is any amino acid
  Variant (47)..(49): xaa in position 47 to 49 is any or no amino acid
  Variant (51)..(51): xaa in position 51 is any amino acid
  Variant (53)..(55): xaa in position 53 to 55 is any amino acid
  Variant (57)..(63): xaa in position 57 to 63 is any amino acid
  Variant (64)..(72): xaa in position 64 to 72 is any or no amino acid
  Variant (74)..(76): xaa in position 74 to 76 is any or no amino acid
  Variant (78)..(79): xaa in position 78 to 79 is any amino acid
  Variant (80)..(81): xaa in position 80 to 81 is any or no amino acid
  Variant (83)..(85): xaa in position 83 to 85 is any amino acid
  Variant (87)..(93): xaa in position 87 to 93 is any amino acid
  Variant (94)..(186): xaa in position 94 to 186 is any or no amino acid
  Variant (188)..(189): xaa in position 188 to 189 is any amino acid
  Variant (190)..(210): xaa in position 190 to 210 is any or no amino acid
  Variant (212)..(213): xaa in position 212 to 213 is any or no amino acid
  Variant (215)..(220): xaa in position 215 to 220 is any amino acid
  Variant (222)..(227): xaa in position 222 to 227 is any amino acid
  Variant (228)..(228): xaa in position 228 is any or no amino acid
  Variant (231)..(231): xaa in position 231 is any or no amino acid
  Variant (233)..(234): xaa in position 233 to 234 is any or no amino acid
  Variant (237)..(237): xaa in position 237 is any or no amino acid
  Variant (240)..(241): xaa in position 240 to 241 is any amino acid
  Variant (242)..(246): xaa in position 242 to 246 is any or no amino acid
  Variant (248)..(252): xaa in position 248 to 252 is any amino acid
  Variant (253)..(265): xaa in position 253 to 265 is any or no amino acid
  Variant (270)..(285): xaa in position 270 to 285 is any amino acid
  Variant (286)..(315): xaa in position 286 to 315 is any or no amino acid
  Variant (319)..(320): xaa in position 319 to 320 is any amino acid
  Variant (322)..(324): xaa in position 322 to 324 is any amino acid
  Variant (326)..(328): xaa in position 326 to 328 is any amino acid
  Variant (330)..(330): xaa in position 330 is any amino acid
  Variant (332)..(332): xaa in position 332 is any amino acid
  Variant (334)..(336): xaa in position 334 to 336 is any amino acid
  Variant (338)..(339): xaa in position 338 to 339 is any amino acid
  Variant (340)..(364): xaa in position 340 to 364 is any or no amino acid
  Variant (368)..(368): xaa in position 368 is any or no amino acid
  Variant (371)..(374): xaa in position 371 to 374 is any amino acid
  Variant (375)..(376): xaa in position 375 to 376 is any or no amino acid
  Variant (378)..(378): xaa in position 378 is any amino acid
  Variant (379)..(384): xaa in position 379 to 384 is any or no amino acid
  Variant (386)..(393): xaa in position 386 to 393 is any or no amino acid
  Variant (395)..(424): xaa in position 395 to 424 is any or no amino acid
  Variant (426)..(426): xaa in position 426 is any amino acid
  Variant (428)..(439): xaa in position 428 to 439 is any amino acid
  Variant (441)..(445): xaa in position 441 to 445 is any amino acid
  Variant (446)..(450): xaa in position 446 to 450 is any or no amino acid
  Variant (454)..(456): xaa in position 454 to 456 is any amino acid
  Variant (462)..(463): xaa in position 462 to 463 is any amino acid
  Variant (466)..(466): xaa in position 466 is any amino acid
  Variant (468)..(472): xaa in position 468 to 472 is any amino acid
  Variant (476)..(478): xaa in position 476 to 478 is any amino acid
  Variant (482)..(484): xaa in position 482 to 484 is any amino acid
  Variant (486)..(487): xaa in position 486 to 487 is any amino acid
  Variant (488)..(518): xaa in position 488 to 518 is any or no amino acid
  Variant (521)..(521): xaa in position 521 is any amino acid
  Variant (523)..(528): xaa in position 523 to 528 is any amino acid
  Variant (529)..(530): xaa in position 529 to 530 is any or no amino acid
  Variant (533)..(534): xaa in position 533 to 534 is any amino acid
  Variant (536)..(554): xaa in position 536 to 554 is any amino acid
  Variant (555)..(579): xaa in position 555 to 579 is any or no amino acid

SEQ ID NO: 58217 - protein, 26 aa, Artificial sequence
  Variant (2)..(3): xaa in position 2 to 3 is any amino acid
  Variant (4)..(4): xaa in position 4 is Leu, Pro or Val
  Variant (5)..(5): xaa in position 5 is Phe, Ile, Leu, Met or Val
  Variant (6)..(18): xaa in position 6 to 18 is any amino acid
  Variant (19)..(19): xaa in position 19 is Ile, Leu or Val
  Variant (20)..(20): xaa in position 20 is any amino acid
  Variant (21)..(21): xaa in position 21 is Ala, Ser, Thr or Val
  Variant (24)..(24): xaa in position 24 is any amino acid
  Variant (25)..(25): xaa in position 25 is Phe, Trp or Tyr
  Variant (26)..(26): xaa in position 26 is Ser or Thr
YXXXXXXXXXXXXXXXXXXXXNSXXX

SEQ ID NO: 58218 - protein, 15 aa, Artificial sequence
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (9)..(10): xaa in position 9 to 10 is any or no amino acid
  Variant (12)..(12): xaa in position 12 is Asp or Asn
  Variant (13)..(14): xaa in position 13 to 14 is any amino acid
  Variant (15)..(15): xaa in position 15 is Leu or Val
SXXXXRXEXXKXXXX

SEQ ID NO: 58219 - protein, 31 aa, Artificial sequence; identical to SEQ ID NO: 45509
  Variant (2)..(2): xaa in position 2 is any amino acid
  Variant (3)..(4): xaa in position 3 to 4 is any or no amino acid
  Variant (6)..(7): xaa in position 6 to 7 is any or no amino acid
  Variant (12)..(12): xaa in position 12 is Cys, Gly, Thr or Val
  Variant (13)..(13): xaa in position 13 is Ile, Pro or Val
  Variant (14)..(14): xaa in position 14 is any amino acid
  Variant (16)..(21): xaa in position 16 to 21 is any amino acid
  Variant (22)..(22): xaa in position 22 is Ala, Ile, Leu, Pro or Val
  Variant (23)..(23): xaa in position 23 is any amino acid
  Variant (24)..(24): xaa in position 24 is Phe, Ile, Leu or Val
  Variant (25)..(25): xaa in position 25 is Ala, Ser or Val
  Variant (26)..(28): xaa in position 26 to 28 is any amino acid

SEQ ID NO: 58220 - DNA, 1440 bp, Saccharomyces cerevisiae; identical to SEQ ID NO: 1
  CDS (1)..(1440)

SEQ ID NO: 58221 - protein, 479 aa, Saccharomyces cerevisiae; identical to SEQ ID NO: 2

SEQ ID NO: 58222 - DNA, 1260 bp, Nostoc sp. PCC 7120; identical to SEQ ID NO: 3
  CDS (1)..(1260)

SEQ ID NO: 58223 - protein, 419 aa, Nostoc sp. PCC 7120; identical to SEQ ID NO: 4

SEQ ID NO: 58224 - DNA, 1359 bp, Brucella melitensis; identical to SEQ ID NO: 5
  CDS (1)..(1359)

SEQ ID NO: 58225 - protein, 452 aa, Brucella melitensis; identical to SEQ ID NO: 6

SEQ ID NO: 58226 - DNA, 1179 bp, Yersinia pestis; identical to SEQ ID NO: 7
  CDS (1)..(1179)

SEQ ID NO: 58227 - protein, 392 aa, Yersinia pestis; identical to SEQ ID NO: 8

SEQ ID NO: 58228 - DNA, 1203 bp, Salmonella enterica subsp. enterica serovar Typhi; identical to SEQ ID NO: 9
  CDS (1)..(1203)

SEQ ID NO: 58229 - protein, 400 aa, Salmonella enterica subsp. enterica serovar Typhi; identical to SEQ ID NO: 10

SEQ ID NO: 58230 - DNA, 1179 bp, Salmonella enterica subsp. enterica serovar Typhi; identical to SEQ ID NO: 11
  CDS (1)..(1179)

SEQ ID NO: 58231 - protein, 392 aa, Salmonella enterica subsp. enterica serovar Typhi; identical to SEQ ID NO: 12

SEQ ID NO: 58232 - DNA, 1203 bp, Escherichia coli; identical to SEQ ID NO: 13
  CDS (1)..(1203)

SEQ ID NO: 58233 - protein, 400 aa, Escherichia coli [sequence omitted]

SEQ ID NO: 58234 - DNA, 1230 bp, Caulobacter crescentus; identical to SEQ ID NO: 15
  CDS (1)..(1230)

SEQ ID NO: 58235 - protein, 409 aa, Caulobacter crescentus; identical to SEQ ID NO: 16

SEQ ID NO: 58236 - DNA, 1179 bp, Escherichia coli; identical to SEQ ID NO: 17
  CDS (1)..(1179)

SEQ ID NO: 58237 - protein, 392 aa, Escherichia coli [sequence omitted]

SEQ ID NO: 58238 - DNA, 1230 bp, Vibrio cholerae; identical to SEQ ID NO: 19
  CDS (1)..(1230)

SEQ ID NO: 58239 - protein, 409 aa, Vibrio cholerae; identical to SEQ ID NO: 20

SEQ ID NO: 58240 - DNA, 1209 bp, Vibrio cholerae; identical to SEQ ID NO: 21
  CDS (1)..(1209)

SEQ ID NO: 58241 - protein, 402 aa, Vibrio cholerae; identical to SEQ ID NO: 22

SEQ ID NO: 58242 - DNA, 1218 bp, Pseudomonas aeruginosa; identical to SEQ ID NO: 23
  CDS (1)..(1218)

SEQ ID NO: 58243 - protein, 405 aa, Pseudomonas aeruginosa; identical to SEQ ID NO: 24

SEQ ID NO: 58244 - DNA, 1185 bp, Neisseria meningitidis; identical to SEQ ID NO: 25
  CDS (1)..(1185)

SEQ ID NO: 58245 - protein, 394 aa, Neisseria meningitidis; identical to SEQ ID NO: 26

SEQ ID NO: 58246 - DNA, 909 bp, Rickettsia prowazekii; identical to SEQ ID NO: 27
  CDS (1)..(909)

SEQ ID NO: 58247 - protein, 302 aa, Rickettsia prowazekii; identical to SEQ ID NO: 28

SEQ ID NO: 58248 - DNA, 1197 bp, Xylella fastidiosa; identical to SEQ ID NO: 29
  CDS (1)..(1197)

SEQ ID NO: 58249 - protein, 398 aa, Xylella fastidiosa; identical to SEQ ID NO: 30

SEQ ID NO: 58250 - DNA, 1245 bp, Synechocystis sp; identical to SEQ ID NO: 31
  CDS (1)..(1245)

SEQ ID NO: 58251 - protein, 414 aa, Synechocystis sp; identical to SEQ ID NO: 32

SEQ ID NO: 58252 - DNA, 1401 bp, Schizosaccharomyces pombe; identical to SEQ ID NO: 33
  CDS (1)..(1401)

SEQ ID NO: 58253 - protein, 466 aa, Schizosaccharomyces pombe; identical to SEQ ID NO: 34

SEQ ID NO: 58254 - DNA, 1479 bp, Debaryomyces hansenii; identical to SEQ ID NO: 35
  CDS (1)..(1479)

SEQ ID NO: 58255 - protein, 492 aa, Debaryomyces hansenii; identical to SEQ ID NO: 36

SEQ ID NO: 58256 - DNA, 1419 bp, Kluyveromyces lactis; identical to SEQ ID NO: 37
  CDS (1)..(1419)

SEQ ID NO: 58257 - protein, 472 aa, Kluyveromyces lactis; identical to SEQ ID NO: 38

SEQ ID NO: 58258 - DNA, 1179 bp, Erwinia carotovora subsp; identical to SEQ ID NO: 39
  CDS (1)..(1179)

SEQ ID NO: 58259 - protein, 392 aa, Erwinia carotovora subsp; identical to SEQ ID NO: 40

SEQ ID NO: 58260 - DNA, 1212 bp, Erwinia carotovora subsp; identical to SEQ ID NO: 41
  CDS (1)..(1212)

SEQ ID NO: 58261 - protein, 403 aa, Erwinia carotovora subsp; identical to SEQ ID NO: 42

SEQ ID NO: 58262 - DNA, 1233 bp, Acinetobacter sp; identical to SEQ ID NO: 43
  CDS (1)..(1233)

SEQ ID NO: 58263 - protein, 410 aa, Acinetobacter sp; identical to SEQ ID NO: 44

SEQ ID NO: 58264 - DNA, 1209 bp, Acinetobacter sp; identical to SEQ ID NO: 45
  CDS (1)..(1209)

SEQ ID NO: 58265 - protein, 402 aa, Acinetobacter sp; identical to SEQ ID NO: 46

SEQ ID NO: 58266 - DNA, 1434 bp, Candida glabrata; identical to SEQ ID NO: 47
  CDS (1)..(1434)

SEQ ID NO: 58267 - protein, 477 aa, Candida glabrata; identical to SEQ ID NO: 48

SEQ ID NO: 58268 - DNA, 1281 bp, Bartonella quintana; identical to SEQ ID NO: 49
  CDS (1)..(1281)

SEQ ID NO: 58269 - protein, 426 aa, Bartonella quintana; identical to SEQ ID NO: 50

SEQ ID NO: 58270 - DNA, 1281 bp, Bartonella henselae; identical to SEQ ID NO: 51
  CDS (1)..(1281)

SEQ ID NO: 58271 - protein, 426 aa, Bartonella henselae; identical to SEQ ID NO: 52

SEQ ID NO: 58272 - DNA, 1398 bp, Yarrowia lipolytica; identical to SEQ ID NO: 53
  CDS (1)..(1398)

SEQ ID NO: 58273 - protein, 465 aa, Yarrowia lipolytica; identical to SEQ ID NO: 54

SEQ ID NO: 58274 - DNA, 1209 bp, Photobacterium profundum; identical to SEQ ID NO: 55
  CDS (1)..(1209)

SEQ ID NO: 58275 - protein, 402 aa, Photobacterium profundum; identical to SEQ ID NO: 56

SEQ ID NO: 58276 - DNA, 1209 bp, Photobacterium profundum; identical to SEQ ID NO: 57
  CDS (1)..(1209)

SEQ ID NO: 58277 - protein, 402 aa, Photobacterium profundum; identical to SEQ ID NO: 58

SEQ ID NO: 58278 - DNA, 1197 bp, Rhodopseudomonas palustris; identical to SEQ ID NO: 59
  CDS (1)..(1197)

SEQ ID NO: 58279 - protein, 398 aa, Rhodopseudomonas palustris; identical to SEQ ID NO: 60

SEQ ID NO: 58280 - DNA, 1167 bp, uncultured bacterium 578; identical to SEQ ID NO: 61
  CDS (1)..(1167)

SEQ ID NO: 58281 - protein, 388 aa, uncultured bacterium 578; identical to SEQ ID NO: 62

SEQ ID NO: 58282 - DNA, 1182 bp, uncultured bacterium 311; identical to SEQ ID NO: 63
  CDS (1)..(1182)

SEQ ID NO: 58283 - protein, 393 aa, uncultured bacterium 311; identical to SEQ ID NO: 64

SEQ ID NO: 58284 - DNA, 1416 bp, Ashbya gossypii; identical to SEQ ID NO: 65
  CDS (1)..(1416)

SEQ ID NO: 58285 - protein, 471 aa, Ashbya gossypii; identical to SEQ ID NO: 66

SEQ ID NO: 58286 - DNA, 1179 bp, Shigella flexneri; identical to SEQ ID NO: 67
  CDS (1)..(1179)

SEQ ID NO: 58287 - protein, 392 aa, Shigella flexneri; identical to SEQ ID NO: 68

SEQ ID NO: 58288 - DNA, 1176 bp, Vibrio vulnificus; identical to SEQ ID NO: 69
  CDS (1)..(1176)

SEQ ID NO: 58289 - protein, 391 aa, Vibrio vulnificus; identical to SEQ ID NO: 70

SEQ ID NO: 58290 - DNA, 1233 bp, Vibrio vulnificus; identical to SEQ ID NO: 71
  CDS (1)..(1233)

SEQ ID NO: 58291 - protein, 410 aa, Vibrio vulnificus; identical to SEQ ID NO: 72

SEQ ID NO: 58292 - DNA, 1179 bp, Photorhabdus luminescens; identical to SEQ ID NO: 73
  CDS (1)..(1179)

SEQ ID NO: 58293 - protein, 392 aa, Photorhabdus luminescens; identical to SEQ ID NO: 74

SEQ ID NO: 58294 - DNA, 1221 bp, Photorhabdus luminescens; identical to SEQ ID NO: 75
  CDS (1)..(1221)

SEQ ID NO: 58295 - protein, 406 aa, Photorhabdus luminescens; identical to SEQ ID NO: 76

SEQ ID NO: 58296 - DNA, 1170 bp, Chromobacterium violaceum; identical to SEQ ID NO: 77
  CDS (1)..(1170)

SEQ ID NO: 58297 - protein, 389 aa, Chromobacterium violaceum; identical to SEQ ID NO: 78

SEQ ID NO: 58298 - DNA, 1152 bp, Chromobacterium violaceum; identical to SEQ ID NO: 79
  CDS (1)..(1152)

SEQ ID NO: 58299 - protein, 383 aa, Chromobacterium violaceum; identical to SEQ ID NO: 80

SEQ ID NO: 58300 - DNA, 1182 bp, Chromobacterium violaceum; identical to SEQ ID NO: 81
  CDS (1)..(1182)

SEQ ID NO: 58301 - protein, 393 aa, Chromobacterium violaceum; identical to SEQ ID NO: 82

SEQ ID NO: 58302 - DNA, 1473 bp, Neurospora crassa; identical to SEQ ID NO: 83
  CDS (1)..(1473)

SEQ ID NO: 58303 - protein, 490 aa, Neurospora crassa; identical to SEQ ID NO: 84

SEQ ID NO: 58304 - DNA, 1206 bp, Haemophilus ducreyi; identical to SEQ ID NO: 85
  CDS (1)..(1206)

SEQ ID NO: 58305 - protein, 401 aa, Haemophilus ducreyi; identical to SEQ ID NO: 86

SEQ ID NO: 58306 - DNA, 1194 bp, Candidatus Blochmannia floridanus; identical to SEQ ID NO: 87
  CDS (1)..(1194)

SEQ ID NO: 58307 - protein, 397 aa, Candidatus Blochmannia floridanus; identical to SEQ ID NO: 88

SEQ ID NO: 58308 - DNA, 1278 bp, Bartonella tribocorum; identical to SEQ ID NO: 89
  CDS (1)..(1278)

SEQ ID NO: 58309 - protein, 425 aa, Bartonella tribocorum; identical to SEQ ID NO: 90

SEQ ID NO: 58310 - DNA, 1167 bp, Nitrosomonas europaea; identical to SEQ ID NO: 91
  CDS (1)..(1167)

SEQ ID NO: 58311 - protein, 388 aa, Nitrosomonas europaea; identical to SEQ ID NO: 92

SEQ ID NO: 58312 - DNA, 1236 bp, Coxiella burnetii; identical to SEQ ID NO: 93
  CDS (1)..(1236)

SEQ ID NO: 58313 - protein, 411 aa, Coxiella burnetii; identical to SEQ ID NO: 94

SEQ ID NO: 58314 - DNA, 1182 bp, Shigella flexneri; identical to SEQ ID NO: 95
  CDS (1)..(1182)

SEQ ID NO: 58315 - protein, 393 aa, Shigella flexneri; identical to SEQ ID NO: 96

SEQ ID NO: 58316 - DNA, 1551 bp, Oryza sativa; identical to SEQ ID NO: 97
  CDS (1)..(1551)

SEQ ID NO: 58317 - protein, 516 aa, Oryza sativa; identical to SEQ ID NO: 98

SEQ ID NO: 58318 - DNA, 1998 bp, Neurospora crassa; identical to SEQ ID NO: 99
  CDS (1)..(1998)

SEQ ID NO: 58319 - protein, 665 aa, Neurospora crassa; identical to SEQ ID NO: 100

SEQ ID NO: 58320 - DNA, 1182 bp, Xylella fastidiosa; identical to SEQ ID NO: 101
  CDS (1)..(1182)

SEQ ID NO: 58321 - protein, 393 aa, Xylella fastidiosa; identical to SEQ ID NO: 102

SEQ ID NO: 58322 - DNA, 1179 bp, Vibrio parahaemolyticus; identical to SEQ ID NO: 103
  CDS (1)..(1179)

SEQ ID NO: 58323 - protein, 392 aa, Vibrio parahaemolyticus; identical to SEQ ID NO: 104

SEQ ID NO: 58324 - DNA, 1209 bp, Vibrio parahaemolyticus; identical to SEQ ID NO: 105
  CDS (1)..(1209)

SEQ ID NO: 58325 - protein, 402 aa, Vibrio parahaemolyticus; identical to SEQ ID NO: 106

SEQ ID NO: 58326 - DNA, 1176 bp, Vibrio parahaemolyticus; identical to SEQ ID NO: 107
  CDS (1)..(1176)

SEQ ID NO: 58327 - protein, 391 aa, Vibrio parahaemolyticus; identical to SEQ ID NO: 108

SEQ ID NO: 58328 - DNA, 1230 bp, Pseudomonas syringae; identical to SEQ ID NO: 109
  CDS (1)..(1230)

SEQ ID NO: 58329 - protein, 409 aa, Pseudomonas syringae; identical to SEQ ID NO: 110

SEQ ID NO: 58330 - DNA, 1224 bp, Pseudomonas putida; identical to SEQ ID NO: 111
  CDS (1)..(1224)

SEQ ID NO: 58331 - protein, 407 aa, Pseudomonas putida; identical to SEQ ID NO: 112

SEQ ID NO: 58332 - DNA, 1185 bp, Bradyrhizobium japonicum; identical to SEQ ID NO: 113
  CDS (1)..(1185)

SEQ ID NO: 58333 - protein, 394 aa, Bradyrhizobium japonicum; identical to SEQ ID NO: 114

SEQ ID NO: 58334 - DNA, 1437 bp, Yersinia pestis; identical to SEQ ID NO: 115
  CDS (1)..(1437)

SEQ ID NO: 58335 - protein, 478 aa, Yersinia pestis; identical to SEQ ID NO: 116

SEQ ID NO: 58336 - DNA, 1182 bp, Wigglesworthia glossinidia brevipalpis; identical to SEQ ID NO: 117
  CDS (1)..(1182)

SEQ ID NO: 58337 - protein, 393 aa, Wigglesworthia glossinidia brevipalpis; identical to SEQ ID NO: 118

SEQ ID NO: 58338 - DNA, 1188 bp, Wigglesworthia glossinidia brevipalpis; identical to SEQ ID NO: 119
  CDS (1)..(1188)

SEQ ID NO: 58339 - protein, 395 aa, Wigglesworthia glossinidia brevipalpis; identical to SEQ ID NO: 120

SEQ ID NO: 58340 - DNA, 1221 bp, Vibrio vulnificus; identical to SEQ ID NO: 121
  CDS (1)..(1221)

SEQ ID NO: 58341 - protein, 406 aa, Vibrio vulnificus; identical to SEQ ID NO: 122

SEQ ID NO: 58342 - DNA, 1275 bp, Synechococcus elongatus; identical to SEQ ID NO: 123
  CDS (1)..(1275)

SEQ ID NO: 58343 - protein, 424 aa, Synechococcus elongatus; identical to SEQ ID NO: 124

SEQ ID NO: 58344 - DNA, 1215 bp, Shewanella oneidensis; identical to SEQ ID NO: 125
  CDS (1)..(1215)

SEQ ID NO: 58345 - protein, 404 aa, Shewanella oneidensis; identical to SEQ ID NO: 126

SEQ ID NO: 58346 - DNA, 1224 bp, Shewanella oneidensis; identical to SEQ ID NO: 127
  CDS (1)..(1224)

SEQ ID NO: 58347 - protein, 407 aa, Shewanella oneidensis; identical to SEQ ID NO: 128

SEQ ID NO: 58348 - DNA, 1224 bp, Shewanella oneidensis; identical to SEQ ID NO: 129
  CDS (1)..(1224)

SEQ ID NO: 58349 - protein, 407 aa, Shewanella oneidensis; identical to SEQ ID NO: 130

SEQ ID NO: 58350 - DNA, 1179 bp, Escherichia coli O6; identical to SEQ ID NO: 131
  CDS (1)..(1179)

SEQ ID NO: 58351 - protein, 392 aa, Escherichia coli O6; identical to SEQ ID NO: 132

SEQ ID NO: 58352 - DNA, 1203 bp, Escherichia coli O6; identical to SEQ ID NO: 133
  CDS (1)..(1203)

SEQ ID NO: 58353 - protein, 400 aa, Escherichia coli O6; identical to SEQ ID NO: 134

SEQ ID NO: 58354 - DNA, 1197 bp, Escherichia coli O6; identical to SEQ ID NO: 135
  CDS (1)..(1197)

SEQ ID NO: 58355 - protein, 398 aa, Escherichia coli O6; identical to SEQ ID NO: 136

SEQ ID NO: 58356 - DNA, 1245 bp, Brucella suis; identical to SEQ ID NO: 137
  CDS (1)..(1245)

SEQ ID NO: 58357 - protein, 414 aa, Brucella suis; identical to SEQ ID NO: 138

SEQ ID NO: 58358 - DNA, 1179 bp, Xanthomonas campestris; identical to SEQ ID NO: 139
  CDS (1)..(1179)

SEQ ID NO: 58359 - protein, 392 aa, Xanthomonas campestris; identical to SEQ ID NO: 140

SEQ ID NO: 58360 - DNA, 1170 bp, Pasteurella multocida; identical to SEQ ID NO: 141
  CDS (1)..(1170)

SEQ ID NO: 58361 - protein, 389 aa, Pasteurella multocida; identical to SEQ ID NO: 142

SEQ ID NO: 58362 - DNA, 1176 bp, Pasteurella multocida; identical to SEQ ID NO: 143
  CDS (1)..(1176)

SEQ ID NO: 58363 - protein, 391 aa, Pasteurella multocida; identical to SEQ ID NO: 144

SEQ ID NO: 58364 - DNA, 1161 bp, Gamma; identical to SEQ ID NO: 145
  CDS (1)..(1161)

SEQ ID NO: 58365 - protein, 386 aa, Gamma; identical to SEQ ID NO: 146

SEQ ID NO: 58366 - DNA, 1149 bp, Haemophilus ducreyi; identical to SEQ ID NO: 147
  CDS (1)..(1149)

SEQ ID NO: 58367 - protein, 382 aa, Haemophilus ducreyi; identical to SEQ ID NO: 148

SEQ ID NO: 58368 - DNA, 1461 bp, Arabidopsis thaliana; identical to SEQ ID NO: 149
  CDS (1)..(1461)

SEQ ID NO: 58369 - protein, 486 aa, Arabidopsis thaliana; identical to SEQ ID NO: 150

SEQ ID NO: 58370 - DNA, 1356 bp, Caenorhabditis elegans; identical to SEQ ID NO: 151
  CDS (1)..(1356)

SEQ ID NO: 58371 - protein, 451 aa, Caenorhabditis elegans; identical to SEQ ID NO: 152

SEQ ID NO: 58372 - DNA, 1579 bp, Drosophila melanogaster; identical to SEQ ID NO: 153
  CDS (49)..(1482)

SEQ ID NO: 58373 - protein, 477 aa, Drosophila melanogaster; identical to SEQ ID NO: 154

SEQ ID NO: 58374 - DNA, 1609 bp, Homo sapiens; identical to SEQ ID NO: 155
  CDS (81)..(1487)

SEQ ID NO: 58375 - protein, 468 aa, Homo sapiens; identical to SEQ ID NO: 156

SEQ ID NO: 58376 - DNA, 1512 bp, Mus musculus; identical to SEQ ID NO: 157
  CDS (6)..(1415)

SEQ ID NO: 58377 - protein, 469 aa, Mus musculus; identical to SEQ ID NO: 158

SEQ ID NO: 58378 - DNA, 27 bp, Artificial sequence
  (1)..(27): primer
atgttcttttcaaaagttatgcttact

SEQ ID NO: 58379 - DNA, 25 bp, Artificial sequence
  (1)..(25): primer
tcatttctcatttcctcctaatgtg

SEQ ID NO: 58380 - protein, 538 aa, Artificial sequence
  Variant (4)..(5): xaa in position 4 to 5 is any amino acid
  Variant (7)..(9): xaa in position 7 to 9 is any amino acid
  Variant (11)..(53): xaa in position 11 to 53 is any amino acid
  Variant (55)..(56): xaa in position 55 to 56 is any amino acid
  Variant (58)..(72): xaa in position 58 to 72 is any amino acid
  Variant (74)..(129): xaa in position 74 to 129 is any amino acid
  Variant (131)..(137): xaa in position 131 to 137 is any amino acid
  Variant (139)..(202): xaa in position 139 to 202 is any amino acid
  Variant (204)..(219): xaa in position 204 to 219 is any amino acid
  Variant (221)..(223): xaa in position 221 to 223 is any amino acid
  Variant (227)..(228): xaa in position 227 to 228 is any amino acid
  Variant (230)..(231): xaa in position 230 to 231 is any amino acid
  Variant (233)..(244): xaa in position 233 to 244 is any amino acid
  Variant (246)..(272): xaa in position 246 to 272 is any amino acid
  Variant (274)..(276): xaa in position 274 to 276 is any amino acid
  Variant (278)..(279): xaa in position 278 to 279 is any amino acid
  Variant (281)..(281): xaa in position 281 is any amino acid
  Variant (284)..(321): xaa in position 284 to 321 is any amino acid
  Variant (324)..(413): xaa in position 324 to 413 is any amino acid
  Variant (416)..(429): xaa in position 416 to 429 is any amino acid
  Variant (431)..(431): xaa in position 431 is any amino acid
  Variant (433)..(433): xaa in position 433 is any amino acid
  Variant (436)..(438): xaa in position 436 to 438 is any amino acid
  Variant (441)..(441): xaa in position 441 is any amino acid
  Variant (446)..(446): xaa in position 446 is any amino acid
  Variant (450)..(451): xaa in position 450 to 451 is any amino acid
  Variant (453)..(455): xaa in position 453 to 455 is any amino acid
  Variant (457)..(478): xaa in position 457 to 478 is any amino acid
  Variant (480)..(481): xaa in position 480 to 481 is any amino acid
  Variant (483)..(485): xaa in position 483 to 485 is any amino acid
  Variant (487)..(514): xaa in position 487 to 514 is any amino acid
  Variant (516)..(518): xaa in position 516 to 518 is any amino acid
  Variant (520)..(537): xaa in position 520 to 537 is any amino acid
GGGXXGXXXAXXXXXXXXXXXXXXXXXXXXXXXXXXXXXXXXXXXXXXXXXXXRXXAXXXXXXXXXXXXXXXWXXXXXXXXXXXXXXXXXXXXXXXXXXXXXXXXXXXXXXXXXXXXXXXXXXXXXXXXEXXXXXXXLXXXXXXXXXXXXXXXXXXXXXXXXXXXXXXXXXXXXXXXXXXXXXXXXXXXXXXXXXXXXXXXXLXXXXXXXXXXXXXXXXLXXXADGXXSXXRXXXXXXXXXXXXYXXXXXXXXXXXXXXXXXXXXXXXXXXXFXXXGXXAXLPXXXXXXXXXXXXXXXXXXXXXXXXXXXXXXXXXXXXXXVWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLXXXXXXXXXXXXXXLXGXAAXXXHPXAGQGXNLGXXDXXXLXXXXXXXXXXXXXXXXXXXXXXLXXYXXXRXXXXXXXXXXXXXXXXXXXXXXXXXXXXRXXXLXXXXXXXXXXXXXXXXXXG

SEQ ID NO: 58381 - protein, 66 aa, Artificial sequence; identical to SEQ ID NO: 1299
  Variant (1)..(1): xaa in position 1 is Val, Leu, Ile, Met or Ala
  Variant (2)..(2): xaa in position 2 is any amino acid
  Variant (3)..(3): xaa in position 3 is Ile, Val or Leu
  Variant (4)..(4): xaa in position 4 is any amino acid
  Variant (6)..(7): xaa in position 6 to 7 is Gly or Ala
  Variant (8)..(8): xaa in position 8 is any amino acid
  Variant (9)..(9): xaa in position 9 is Val, Ala or Ile
  Variant (11)..(13): xaa in position 11 to 13 is any amino acid
  Variant (14)..(14): xaa in position 14 is Ala, Ser, Leu or Gly
  Variant (15)..(16): xaa in position 15 to 16 is any amino acid
  Variant (17)..(17): xaa in position 17 is Leu, Ile or Phe
  Variant (18)..(25): xaa in position 18 to 25 is any amino acid
  Variant (26)..(33): xaa in position 26 to 33 is any or no amino acid
  Variant (34)..(34): xaa in position 34 is Leu, Val or Ile
  Variant (35)..(35): xaa in position 35 is Ile, Val or Leu
  Variant (36)..(36): xaa in position 36 is Glu, Asp or Ala
  Variant (37)..(44): xaa in position 37 to 44 is any amino acid
  Variant (45)..(57): xaa in position 45 to 57 is any or no amino acid
  Variant (58)..(58): xaa in position 58 is Arg, Gln or Lys
  Variant (59)..(60): xaa in position 59 to 60 is any amino acid
  Variant (61)..(61): xaa in position 61 is Ala, Ser or Thr
  Variant (62)..(62): xaa in position 62 is Leu, Ile, Val or Phe
  Variant (63)..(65): xaa in position 63 to 65 is any amino acid
  Variant (66)..(66): xaa in position 66 is Ser, Thr or Ala

SEQ ID NO: 58382 - protein, 65 aa, Artificial sequence; identical to SEQ ID NO: 1300
  Variant (1)..(1): xaa in position 1 is Leu, Val or Trp
  Variant (2)..(2): xaa in position 2 is Leu, Val, Ile or Ala
  Variant (3)..(3): xaa in position 3 is Val, Ile, Ala or Leu
  Variant (4)..(4): xaa in position 4 is Gly or Ala
  Variant (8)..(9): xaa in position 8 to 9 is any amino acid
  Variant (11)..(17): xaa in position 11 to 17 is any amino acid
  Variant (18)..(18): xaa in position 18 is any or no amino acid
  Variant (19)..(19): xaa in position 19 is Ile, Val, Leu or Met
  Variant (20)..(25): xaa in position 20 to 25 is any amino acid
  Variant (26)..(26): xaa in position 26 is Tyr or Phe
  Variant (27)..(30): xaa in position 27 to 30 is any amino acid
  Variant (31)..(31): xaa in position 31 is Ile, Val, Leu or Met
  Variant (32)..(32): xaa in position 32 is Val, Leu, Ile or Thr
  Variant (33)..(34): xaa in position 33 to 34 is any amino acid
  Variant (35)..(35): xaa in position 35 is Val, Leu, Ile, Met or Phe
  Variant (36)..(45): xaa in position 36 to 45 is any amino acid
  Variant (46)..(51): xaa in position 46 to 51 is any or no amino acid
  Variant (52)..(52): xaa in position 52 is Gln or Glu
  Variant (53)..(53): xaa in position 53 is any amino acid
  Variant (54)..(54): xaa in position 54 is Phe, His or Ile
  Variant (55)..(57): xaa in position 55 to 57 is any amino acid
  Variant (58)..(58): xaa in position 58 is Gly, Ser or Ala
  Variant (59)..(60): xaa in position 59 to 60 is any amino acid
  Variant (61)..(61): xaa in position 61 is Ala, Ser, Gly or Val
  Variant (62)..(62): xaa in position 62 is any amino acid
  Variant (63)..(63): xaa in position 63 is Leu or Val
  Variant (65)..(65): xaa in position 65 is Leu, Met, Phe or Ile

SEQ ID NO: 58383 - protein, 105 aa, Artificial sequence; identical to SEQ ID NO: 1301
  Variant (1)..(1): xaa in position 1 is Leu or Val
  Variant (2)..(12): xaa in position 2 to 12 is any amino acid
  Variant (13)..(13): xaa in position 13 is Arg, Gly or Asn
  Variant (14)..(14): xaa in position 14 is any amino acid
  Variant (15)..(15): xaa in position 15 is Ala, Val or Leu
  Variant (16)..(16): xaa in position 16 is Leu, Val, Ile, Thr or Phe
  Variant (17)..(17): xaa in position 17 is Val, Ile, Leu or Ala
  Variant (19)..(19): xaa in position 19 is Asp, Asn or Glu
  Variant (20)..(20): xaa in position 20 is Ala or Ser
  Variant (22)..(22): xaa in position 22 is His, Gln or Val
  Variant (23)..(24): xaa in position 23 to 24 is any amino acid
  Variant (25)..(25): xaa in position 25 is His, Asn or Pro
  Variant (27)..(27): xaa in position 27 is Leu, Ile or Val
  Variant (28)..(28): xaa in position 28 is Ala, Gly or Thr
  Variant (29)..(29): xaa in position 29 is Gly or Ala
  Variant (30)..(30): xaa in position 30 is Gln, His or Leu
  Variant (32)..(32): xaa in position 32 is any amino acid
  Variant (34)..(34): xaa in position 34 is any amino acid
  Variant (35)..(35): xaa in position 35 is Gly or Cys
  Variant (36)..(37): xaa in position 36 to 37 is any amino acid
  Variant (38)..(38): xaa in position 38 is Asp or Ser
  Variant (39)..(41): xaa in position 39 to 41 is any amino acid
  Variant (42)..(42): xaa in position 42 is Leu, Ile or Phe
  Variant (43)..(45): xaa in position 43 to 45 is any amino acid
  Variant (46)..(46): xaa in position 46 is Leu, Met, Ile or Val
  Variant (47)..(52): xaa in position 47 to 52 is any amino acid
  Variant (53)..(59): xaa in position 53 to 59 is any or no amino acid
  Variant (60)..(60): xaa in position 60 is Gly, Ala or Asn
  Variant (61)..(64): xaa in position 61 to 64 is any amino acid
  Variant (65)..(65): xaa in position 65 is Leu or Met
  Variant (66)..(67): xaa in position 66 to 67 is any amino acid
  Variant (68)..(68): xaa in position 68 is Tyr, Phe or Trp
  Variant (69)..(71): xaa in position 69 to 71 is any amino acid
  Variant (72)..(72): xaa in position 72 is Arg, His, Ala or Cys
  Variant (73)..(89): xaa in position 73 to 89 is any amino acid
  Variant (90)..(90): xaa in position 90 is Phe, Tyr or Leu
  Variant (91)..(100): xaa in position 91 to 100 is any amino acid
  Variant (102)..(103): xaa in position 102 to 103 is any amino acid
  Variant (104)..(104): xaa in position 104 is Gly, Ala or Val
  Variant (105)..(105): xaa in position 105 is Leu, Met or Phe

SEQ ID NO: 58384 - DNA, 1216 bp, Saccharomyces cerevisiae
  CDS (208)..(993)
atttgtcataatgacaattacataaccccttttatatacataaatatttgggtcagcacaaatttattttgattttccattattttagcagcaacaaggttgaaaaaatcgccggcgcatcaccaacttgaaggacaaagataaccttacttgaaatcaaataagtgatgaatacgacagcggaaaaggttatacgctttgctcattatgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggataatataaatgctagcgtactgcctgtatatcgctgcacataatatgtatctataatttatattaacgtacataacttttaggtatgttaccatcaaagcgtgtccgagttattgagattttgacaaattcagacaaatcatttttgaagaaccatatatataaatatataaagaaaagaaaggtaaaccaaagacagcaaacaatcgaaaagtggacaaccagca

SEQ ID NO: 58385 - protein, 261 aa, Saccharomyces cerevisiae
MTQEFIDKVSSYLTPDVDIAPISQGAEAIVFTTTTHPYLPRAKDSHQKYIIKYRPPKRYRHPQIDQALTKHRTLNESRLLAKLYLIPGLCVPQLIACDPYNGFIWLEFLGEDLPGGHGFSNLKNFLWMHDQDPYSDLVATTLRKVGRQIGLLHWNDYCHGDLTSSNIVLVRDGARWTPHLIDFGLGSVSNLVEDKGVDLYVLERAILSTHSKHAEKYNAWIMEGFEEVYREQGAKGAKKLKEVTKRFEEVRLRGRKRSMLG

SEQ ID NO: 58386 - DNA, 735 bp, Mus musculus
  CDS (1)..(735)
atggctggcacgtcctcggaggcggaggccgaggcgctggccgctgcgcgcgagcggagccgcctcttcctgagcggcctagagctggtgcagcagggcgccgaggcgcgcgtcttccgtggccgcttccagggccgcgcggccgtggtgaagcaccgcttcccgaagagctaccggcacccggagctggaggcgcggctcggccggcggcggacagtgcaggaggcgcgcgcgctgctccgctgccgccgtgcggggatagctgccccagtcgtcttctttgtggactatgcgtctaactgcttatatatggaagaaatcgaagactcggtgactgttcgggattatatccaatccactatggagactgaaaaggacccccagtgcctcttggacctggccaggaggatggggcaggttctggccggaatgcacgaccaagacctcattcacggggacctcaccacctccaacatgctcctgaggcggcccctggcgcagctgcacatcgtgctcatcgactttgggctgagctttgtctcaggactgccggaagataaaggcgtcgacctctatgtcctggagaaggccttcctcagcacgcacccccacaccgagaccgtgtttgaagcctttctgaagagttacggggcctcgacccagaagtccagtccagtgctgaagaagttagatgaggtgcgcctgagagggcgaaagcggtccatggtcgggtag

SEQ ID NO: 58387 - protein, 244 aa, Mus musculus
MAGTSSEAEAEALAAARERSRLFLSGLELVQQGAEARVFRGRFQGRAAVVKHRFPKSYRHPELEARLGRRRTVQEARALLRCRRAGIAAPVVFFVDYASNCLYMEEIEDSVTVRDYIQSTMETEKDPQCLLDLARRMGQVLAGMHDQDLIHGDLTTSNMLLRRPLAQLHIVLIDFGLSFVSGLPEDKGVDLYVLEKAFLSTHPHTETVFEAFLKSYGASTQKSSPVLKKLDEVRLRGRKRSMVG

SEQ ID NO: 58388 - DNA, 696 bp, Danio rerio
  CDS (1)..(696)
atggctcaaacagactcagcaaaagcggctgtcccgtcctatttaaaagaggcgcagatgattaaacagggcgctgaggctcgggtctatcgaagcacgtttttggggcgctctgtgattattaaggagagatttcccaagttataccgccatccggaagtggatgagaaactgacgcgccgcagaacaacacaggaggtgcgctccatactgcgctgcaggagagccggcatcagcgcaccggttgtgtattttgtggactacgccacacactgcatcttcctgcaagacgtggtgaactctgtgtcagtgcgagaccacatcagatcgcagccggacggtctgcagactctggcggagcgcatcggtgaagttctggctcagatgcacgatgaagacgtcattcacggagatctgaccacctccaacatgctgctgaccagcggaggacaacagcaagacttcaacctggtgctcatcgacttcggcttgagctacatctccgctcttcctgaggataaaggagtggatctgtacgtcttggaggaagcttttcttagcactcatccaaaaactgaggccttgttcgagaggcttctgaagagctacagcagtgcctcaaaaaagtcctccgcggtcattaagaaactggacgaagttcggctgagaggacgcaagaggtcaatggtgggatag

SEQ ID NO: 58389 - protein, 231 aa, Danio rerio
MAQTDSAKAAVPSYLKEAQMIKQGAEARVYRSTFLGRSVIIKERFPKLYRHPEVDEKLTRRRTTQEVRSILRCRRAGISAPVVYFVDYATHCIFLQDVVNSVSVRDHIRSQPDGLQTLAERIGEVLAQMHDEDVIHGDLTTSNMLLTSGGQQQDFNLVLIDFGLSYISALPEDKGVDLYVLEEAFLSTHPKTEALFERLLKSYSSASKKSSAVIKKLDEVRLRGRKRSMVG

SEQ ID NO: 58390 - DNA, 735 bp, Mus musculus
  CDS (1)..(735)
atggctggtgtgtcctcggaggcggaggccgaggcgctggccgcggcgcgcgagcggagccgcctcttcctgagcggcctagagctggtgcagcagggcgccgaggcgcgcgttttccgtggccgcttccagggccgcgcggccgtggtgaagcaccgcttcccgaagagttaccggcacccggagctggaggcgcggctcggccgtcggcggacggtgcaggaggcgcgcgcgctgctccgctgccgccgtgcggggatagctgccccagtcgtcttctttgtggactatgcgtctaactgcttatatatggaagaaatcgaagactcggtgactgttcgggattatatccaatccactatggagactgaaaaggacccccagtgcctcttggacctggccaggaggatggggcaggttctggccggaatgcacgaccaagacctcattcacggggacctcaccacctccaacatgctcctgaggcggcccctggcgcagctgcacatcgtgctcatcgactttgggctgagctttgtctcaggactgccggaagataaaggcgtcgacctctatgtcctggagaaggccttcctcagcacgcacccccacaccgagaccgcgtttgaagcctttctgaagagttacggggcctcgtccaagaagtccagtccagtgctgaagaagttagatgaggtgcgcctgagagggcgaaagcggtccatggtcgggtag

SEQ ID NO: 58391 - protein, 244 aa, Mus musculus
MAGVSSEAEAEALAAARERSRLFLSGLELVQQGAEARVFRGRFQGRAAVVKHRFPKSYRHPELEARLGRRRTVQEARALLRCRRAGIAAPVVFFVDYASNCLYMEEIEDSVTVRDYIQSTMETEKDPQCLLDLARRMGQVLAGMHDQDLIHGDLTTSNMLLRRPLAQLHIVLIDFGLSFVSGLPEDKGVDLYVLEKAFLSTHPHTETAFEAFLKSYGASSKKSSPVLKKLDEVRLRGRKRSMVG

SEQ ID NO: 58392 - DNA, 663 bp, Pyrococcus abyssi GE5
  CDS (1)..(663): transl_table=11
atgaagctaatcaagcaaggagcggaggccaagatttatcttgcagagttctcggagctttactttgattatccaattaaggttatagtgaaggagaggattaagaagaggtacagaattccagagatagatctgaagctcaggaaagagagaactatcagggaggcaaggatacttcgaagggccaaggaattcggagtcaatgttccctacgtgtttgaggttgacactaaaaatatgataatagtgatggagtacatagagggggaaaggctcaaagagctcctggaaaagctccccatggaagaaagacttaaagtatgcagggaagtcggaaggcagattggaaagttacatgaggcggggatagttcacggggacttaacgacctcaaatatgatacttagggaaggcaaggtttacttcatagatttcgggcttgcggagtttgacgatacgattgaagctcagggtgtagatttacacctgcttaagagagccatggagagtactcattataagtggtttgaaaggggctttgaggaagttttgaagggatacatagaaatcagaggagaagataagggaagggaaattagggagaagataagggaaatagaattgaggggtaggtacagggagagaagctggattacgcagtaa

SEQ ID NO: 58393 - protein, 220 aa, Pyrococcus abyssi GE5
MKLIKQGAEAKIYLAEFSELYFDYPIKVIVKERIKKRYRIPEIDLKLRKERTIREARILRRAKEFGVNVPYVFEVDTKNMIIVMEYIEGERLKELLEKLPMEERLKVCREVGRQIGKLHEAGIVHGDLTTSNMILREGKVYFIDFGLAEFDDTIEAQGVDLHLLKRAMESTHYKWFERGFEEVLKGYIEIRGEDKGREIREKIREIELRGRYRERSWITQ

SEQ ID NO: 58394 - DNA, 660 bp, Pyrococcus horikoshii OT3
  CDS (1)..(660): transl_table=11
atgaagctcataaagcagggtgcagaggcaaagatctatctagcggatttttccgagctttactttgattacccccttaaggttatcgtgaaggagaggattaagaagaggtacaggattcctgagatagatatcaagctgaggagggagaggacgattagggaagcaaggattttgcataaagccaaggaactcggagttaacgttccctacgtttttgaggttgacactaagaacatgataatagtcatggagtacatagaaggggagaggctcaaggagctcctcgagagggtaagtatggaggagaggcttaagatatgcagggaggttggaaggctaataggaaggttacacgagggaggaatagttcacggggacttaacaacctctaacatgatcatgaggaatggaaaaatatacttcatagacttcggcctcgccgagttcgacgataccctagaggcccagggtgtagatctgcatttactaaagagggccatggagagcacacactacaaatggttcgaggagggattcaaggaagtgctaaatggatatgaggaggttaggggaagggagaagagggttgagattgaggagaaaataagggagatagagcttagaggaaggtacagggaaaggaaatggatcacttga

SEQ ID NO: 58395 - protein, 219 aa, Pyrococcus horikoshii OT3
MKLIKQGAEAKIYLADFSELYFDYPLKVIVKERIKKRYRIPEIDIKLRRERTIREARILHKAKELGVNVPYVFEVDTKNMIIVMEYIEGERLKELLERVSMEERLKICREVGRLIGRLHEGGIVHGDLTTSNMIMRNGKIYFIDFGLAEFDDTLEAQGVDLHLLKRAMESTHYKWFEEGFKEVLNGYEEVRGREKRVEIEEKIREIELRGRYRERKWIT

SEQ ID NO: 58396 - DNA, 723 bp, Aeropyrum pernix K1
  CDS (1)..(723): transl_table=11
gtggaggatagacgaggtggacataccatggtatccctggctccctggggacccgccgcccggctagaggagctccccctactgaagaggggggccgaggccgagatcaggctgggggagtttatggggctccaggccgtgtataaggctagggttaggaagccctacatgcaccccaggctcgccgagaggcttgtcaggctgaggactaggagggaggccagggttatagcggcagccagggccgcgggggtcagcgccccagccctcctcgccgtcttccccagcctcgggctgattgtgatggagtatgtggagggccccctcctcaaggacgtcatagaccggcggggcctcggggccggggggcttgtggaggaggctggctacaacctcggcctcctccacagggcgggcgtcgtacacggggaccccaccacctcgaactacatagtcaggggagggggtgtggtgctgatagactacgggctggcggagttcagctccagcgttgaggacagggcggtggacctccacctcttcaggagggctgtggagagcacccacgcccccctggcgggggagctctacagcctctacacccggggctacctgagggccgtgggggagtggggcggggaggtgttgcggagggctgaggagataaggctgagggggaggtatgtgagggagaggcggaggagcgtgtggggcgttggctag

SEQ ID NO: 58397 - protein, 240 aa, Aeropyrum pernix K1
MEDRRGGHTMVSLAPWGPAARLEELPLLKRGAEAEIRLGEFMGLQAVYKARVRKPYMHPRLAERLVRLRTRREARVIAAARAAGVSAPALLAVFPSLGLIVMEYVEGPLLKDVIDRRGLGAGGLVEEAGYNLGLLHRAGVVHGDPTTSNYIVRGGGVVLIDYGLAEFSSSVEDRAVDLHLFRRAVESTHAPLAGELYSLYTRGYLRAVGEWGGEVLRRAEEIRLRGRYVRERRRSVWGVG

SEQ ID NO: 58398 - DNA, 1452 bp, Halobacterium sp. NRC-1
  CDS (1)..(1452): transl_table=11
atgcgggaggcgatccccgcagtcatcgagacggtgctcggggcggccgacggcgacatcgacgcggtcgcgttctcccgcgggccgggcctggggccgtgtctgcgcatcgtcggatcggcggcgcgcgcgctcgcccaggctctcgacgtacccctcgtgggcgtcaaccacatggttgcgcacctcgaaatcggccgccaccagtctgggttccagcagcccgtctgcctgaacgcaagcggcgcgaacgcccacgtgttggcgtaccgcaacggccggtatcgcgtgctcggggagacgatggacaccggcgtcgggaacgccatcgacaagttcacgcgccacgtcggctggcagcaccccggcgggccgaaagtcgaaacgcacgcccgggacggcgagtacaccgcgttgccctacgtggtgaagggcatggacttctcgttttccgggatcatgagcgccgccaaagacgccgtcgacgacggcgtgccggtggccgacgtctgccgggggttggaggagaccatgttcgcgatgctgaccgaggtcgcggagcgcgcgctcgcgctcaccggccgggacgaactcgtgttgggcggcggcgtcggccagaacgaccggctgcgggggatgctcgaagcgatgtgtgcggcccgcggggcgtcgtttcacgcgcccgagccgcggttcctgcgggacaacgcgggcatgatcgcggtgctcggcgcgaagatggcggccgccggggcgacgatccccgtggccgactccgcgatcaactcccagttccgccccgacgaggtgtcggtgacgtggcgcgaccccgagtcgccggcacgcgacccgggggccgacgccgtgcgccagggcgccgaagccaccgtcacgttcgccgacgacgccgtgatcaaggagcgcgcgccgaaggcctaccgtcacgaccgcctcgacgaccgcctgcgccgagaccgcaccgtcctggaggccagactgaccagcgacgcccgccggcagggcgttccgacgccgctcgtccgcgacgtcgacgtgccggcggcgacgatcacgctccagcacgtcggggacgccgacctccgggacgcgctctcgcccgcccgcgttcgcgccgtcggccggcatctcgcgaccatccacgacggcgggttcgtgcacggcgacccgaccacgcgcaacgtgcgcgtcggcgccgagcgcacgttcctcatcgacttcgggctggggtattacaccgacgccgtcgaggactacgccatggactgccacgtcttcgagcagagcctcgtcggcaccgccgccgacgccgacgctctcgttgcggccttcgaggacgcctacgaggaggccgccgccagcgggcgcgtgctcgaccagctgcgcgccgtcgagggccgggggcgttaccaggacgaccccgagacggcgtag

SEQ ID NO: 58399 - protein, 483 aa, Halobacterium sp. NRC-1
MREAIPAVIETVLGAADGDIDAVAFSRGPGLGPCLRIVGSAARALAQALDVPLVGVNHMVAHLEIGRHQSGFQQPVCLNASGANAHVLAYRNGRYRVLGETMDTGVGNAIDKFTRHVGWQHPGGPKVETHARDGEYTALPYVVKGMDFSFSGIMSAAKDAVDDGVPVADVCRGLEETMFAMLTEVAERALALTGRDELVLGGGVGQNDRLRGMLEAMCAARGASFHAPEPRFLRDNAGMIAVLGAKMAAAGATIPVADSAINSQFRPDEVSVTWRDPESPARDPGADAVRQGAEATVTFADDAVIKERAPKAYRHDRLDDRLRRDRTVLEARLTSDARRQGVPTPLVRDVDVPAATITLQHVGDADLRDALSPARVRAVGRHLATIHDGGFVHGDPTTRNVRVGAERTFLIDFGLGYYTDAVEDYAMDCHVFEQSLVGTAADADALVAAFEDAYEEAAASGRVLDQLRAVEGRGRYQDDPETA

SEQ ID NO: 58400 - DNA, 672 bp, Sulfolobus solfataricus P2
  CDS (1)..(672): transl_table=11
ttggagaaattaaggttaattaagcgtggcgcagaatccaacatatatgaagggtattttttaggcatacatgcaatatttaagcaaaggatcaagaaaagttatagaaatccagaactagatcacaaaattaactatgagaggacaatactagaagcaaagataatttatactgcactgaaaaatgacgtgaacgtacccgcagtactttttatagatcctaataattatttattggtaattgaatatatagaaggagagatagtaaaagatattataaacacaaataatcctacacaattgttgcctaatattgggaagagaataggggaacttacgggaaagttgcataatattggaatagcacacggtgatttaactaccaataacctaattttaagctctacaaatgacgatatcttcataatagatttcggcttatcaagaagaactcaagatgaggaggatttcgcaacagatttgcatgtatttctgagatctttagaaagtgtacattctgattttaaagatataatatacgatgcatttatagagggttacagaaaaatcatgggaagaaagactgatgagatattagaactagtaaaggatattaggatgagaggtagatatgttgaggagaggcgtaaaaataggagtattaacgaataa

SEQ ID NO: 58401 - protein, 223 aa, Sulfolobus solfataricus P2
MEKLRLIKRGAESNIYEGYFLGIHAIFKQRIKKSYRNPELDHKINYERTILEAKIIYTALKNDVNVPAVLFIDPNNYLLVIEYIEGEIVKDIINTNNPTQLLPNIGKRIGELTGKLHNIGIAHGDLTTNNLILSSTNDDIFIIDFGLSRRTQDEEDFATDLHVFLRSLESVHSDFKDIIYDAFIEGYRKIMGRKTDEILELVKDIRMRGRYVEERRKNRSINE

SEQ ID NO: 58402 - DNA, 684 bp, Sulfolobus tokodaii str. 7
  CDS (1)..(684): transl_table=11
atggagagtagatcaagtagatgtgacatggagattatcagagaattaaagagaggagcagagtccataatttatgaaggatattttgcgggtattcacgctgtatttaagaaaagaatatctaaatcttatagagatcaaaaacttgattataaaattaatagtgaaaggactaaattggaagctagattaatgtattcagctttaaaaaatggtatcaatgttccagcattattacttgttgatccttatgaatacttaattgtcatggaatatatagacggatttcctgtgaaagaaatagttcctaagtataaagatgataatttaatccgaattggtgaaatgataggggaaattgctggaaaactgcataaatctggaatatcacatggagatttcactacaaataatcttatatacactactgataatgagatatttttaatagattttggactatctaagagaagcgatgatattgaagatttcgcaacagatgtgcatgtttttttaaggagtttagaaagtgttcattatgaatttaaagatataattttcaaaggttttgaaaaaggctattctaaatttatggattttaagagtattatgaatacagtgaaacaaataagaatgaggggaagatatgttgaagagcgtagaagtaaacgtaataacgtctaa

SEQ ID NO: 58403 - protein, 227 aa, Sulfolobus tokodaii str. 7
MESRSSRCDMEIIRELKRGAESIIYEGYFAGIHAVFKKRISKSYRDQKLDYKINSERTKLEARLMYSALKNGINVPALLLVDPYEYLIVMEYIDGFPVKEIVPKYKDDNLIRIGEMIGEIAGKLHKSGISHGDFTTNNLIYTTDNEIFLIDFGLSKRSDDIEDFATDVHVFLRSLESVHYEFKDIIFKGFEKGYSKFMDFKSIMNTVKQIRMRGRYVEERRSKRNNV

SEQ ID NO: 58404 - DNA, 636 bp, Pyrobaculum aerophilum str. IM2
  CDS (1)..(636): transl_table=11
gtggagttgatagctaagggcgccgaggccgaaatttatctagtagactggttcgggctgaaggcggtgttaaagtggagaaagccaaagatgtatagagatccaaacttggactaccacatcaggcggaggaggactataaatgaagtgagaaatatgtacatagcttatagtctcgggctaagagttcccgacgtgtatttttttgatcccggagaggccaaaatactaatggagtacgtcgagggaaaaaatctgcgcgatttgctaaatgagggaaattacagttacttacgagaagtaggcgtatatgtaggcagaatgcacaaggccgggctaatacacggcgatttagcccccactaatataattctgacaggggggcaactctgttttatagacttcggtttgggcgagcagagaatggggtggacgaggaaaaccgccgtattactagccagagatatcaacgtcttgttcagaactcttgatctatacggcgaaaaggcagaggagctcaaggcgttattctggagcggctacagagaggaagtaggaggaagagctgcggcagtggagagagaattgttacggataagggcctcggggcgctatgtcgagcgcaagacggaataa

SEQ ID NO: 58405 - protein, 211 aa, Pyrobaculum aerophilum str. IM2
MELIAKGAEAEIYLVDWFGLKAVLKWRKPKMYRDPNLDYHIRRRRTINEVRNMYIAYSLGLRVPDVYFFDPGEAKILMEYVEGKNLRDLLNEGNYSYLREVGVYVGRMHKAGLIHGDLAPTNIILTGGQLCFIDFGLGEQRMGWTRKTAVLLARDINVLFRTLDLYGEKAEELKALFWSGYREEVGGRAAAVERELLRIRASGRYVERKTE

SEQ ID NO: 58406 - DNA, 681 bp, Arabidopsis thaliana
  CDS (1)..(681)
atggattgtgaggaaaacgttagggatgaatcactcgttttgattaaacaaggagcagaagctagggtgttcgagtctacatttgctggaagaagatccatcgtgaaagaacgtttctcgaagaaatatagacatccgattttggatgcaaaactcacacttaaacgcttgaatgcggaagctaggtgtatgacaaaggcaagaaagctcggggtttgtactccagtcctatatgctgtggatactctgcttcactctttaacacttgagtacattgagggggtctctgttaaggatattttccttgagtttgggaccaatggggttgttgaggaacgtttagatgatgttgctgctcagattggggctgcaattgctaagctccatgatggtggcttggctcatggtgatttgaccacatcaaatatgttagtcagaagtggaacaaatcagctggtactaattgattttggcttgagcgtcacatcgaccttgcctgaagacaaagctgttgatttatatgtacttgaaagagccttactctcaatgcattcgtcatgcgggaatgtgatggatcgtatactgacggcgtataggaagtcctcaaagcaatggtcagccacgtttaacaagctcgcacaagtgagacagcgagggagaaagcggactatgattggatga

SEQ ID NO: 58407 - protein, 226 aa, Arabidopsis thaliana
MDCEENVRDESLVLIKQGAEARVFESTFAGRRSIVKERFSKKYRHPILDAKLTLKRLNAEARCMTKARKLGVCTPVLYAVDTLLHSLTLEYIEGVSVKDIFLEFGTNGVVEERLDDVAAQIGAAIAKLHDGGLAHGDLTTSNMLVRSGTNQLVLIDFGLSVTSTLPEDKAVDLYVLERALLSMHSSCGNVMDRILTAYRKSSKQWSATFNKLAQVRQRGRKRTMIG

SEQ ID NO: 58408 - DNA, 681 bp, Pyrococcus furiosus DSM 3638
  CDS (1)..(681): transl_table=11
gtgagaggggagttaaagatgaagctcataaagcagggggctgaagcaaagatatatcttgcagacttttccgaattatactatgatcttcccatcaaggtgatcgttaaggaaagggtctcgaaaagatataggattcctgaaatcgacataaaactcagaaaagagagaacaataagagaagctagaatactccatagagctaagaaagctggtgtaaatgttccctacgtgtttgaagttgataccaagaacatgataatagttatggagttcatagagggggagaggctcaaggagcttttggaaaaacttcccatagaagaaaggttggagatatgtaaggaaattggcagggtcataggaaagttacatgaggcaggtattgtccatggggatttgacgacctccaatatgataatgagagatggaaaaatttacctcatagacttcgggttagctgagtttgacgatactttagaagcccagggtgttgatcttcacttgctgaggagagcaatggagagtactcactacagctgggttgaagagggatttaaagctgttctaagaggatatgaagaggtaagggggaaagagaagaggcgtgagattgaggaaaaaatcaaggaaattgaattgagagggagatatagggagagaagctggattacttcctaa

SEQ ID NO: 58409 - protein, 226 aa, Pyrococcus furiosus DSM 3638
MRGELKMKLIKQGAEAKIYLADFSELYYDLPIKVIVKERVSKRYRIPEIDIKLRKERTIREARILHRAKKAGVNVPYVFEVDTKNMIIVMEFIEGERLKELLEKLPIEERLEICKEIGRVIGKLHEAGIVHGDLTTSNMIMRDGKIYLIDFGLAEFDDTLEAQGVDLHLLRRAMESTHYSWVEEGFKAVLRGYEEVRGKEKRREIEEKIKEIELRGRYRERSWITS

SEQ ID NO: 58410 - DNA, 594 bp, Encephalitozoon cuniculi GB-M1
  CDS (1)..(594)
atggggtttcatttccaaggtgcagagtccatcatctcggctgacggagagactgttgtaaagaagcgtgcaagaaaggcctacaggatagaggcgcttgacctaaagataataaacggcagaacaaagcgggaggcgaaaatcctgaggaagcttgaggcgctaggaataccagctccgagactgataagcacatatggagacactattgtgatggagaaggtcgaagggactgttctaaaggaaatgattgacagctccgacaaccccggggctctctttcgtgacctaggggcccttgtctcaaggctccatattgcggacatcatccacggagatctaacaacatcgaactttatacacggaagcaaaatatatgcaatcgactttggtctgtcatacatatctcgaaaagacgaggacaaggctgttgatttgtatgtttttgaaaaggctgttggatgtgcacatgatgccaagttcctggaggacttctactgcgggtatatgggggagggaagcgagagcgtactgaagaagctggggactgtccgcctgaggggtaggaaaagagaagccatggcatttggatga

SEQ ID NO: 58411 - protein, 197 aa, Encephalitozoon cuniculi GB-M1
MGFHFQGAESIISADGETVVKKRARKAYRIEALDLKIINGRTKREAKILRKLEALGIPAPRLISTYGDTIVMEKVEGTVLKEMIDSSDNPGALFRDLGALVSRLHIADIIHGDLTTSNFIHGSKIYAIDFGLSYISRKDEDKAVDLYVFEKAVGCAHDAKFLEDFYCGYMGEGSESVLKKLGTVRLRGRKREAMAFG

SEQ ID NO: 58412 - DNA, 717 bp, Schizosaccharomyces pombe 972h-
  CDS (1)..(717)
atgtcagaaaaacctgaccttaggcaaagatgttctgatatatatcgtgaaataaaggaaaagaaattaactgtggtaaagcaaggtgcagaagcaatcacgataaaaaccgagttttatccaggtgaggtttgtcttttgaagtgccgacctgcgaaacgatggagacatcctattttagatcagaaattatcaagaaaacgctgcttagtggaagcaagacttttagcaaaatgtcattacgttggaataaaatgtcccatgctgtactttatagatgccaatcgtggtcaaatatatatggaatggattgatggaccttgtgtacgagattatattcgagagatctgcgaatgtgagattgaaaaaaaacttattcctttaatgaagcgaataggatcagaagttgcgaagatgcataagaatgatatcgttcatggagatttgacaactagtaatatgatgctggagtctcacaacaatccggtcccaatttttattgatttcggtttaggaagcgtttccgaatctgaggaagataaagctgtggatatttacgtcctagagagagctttatcaagtactttaccagaaagcgaatctttgtttcatcatgttttagactcttatgcccaaagttggaaacaatctaaggcaacacttcgaagatttgaagaagtacgaatgcgtggccgtaaacgtaccatgataggatga

SEQ ID NO: 58413 - protein, 238 aa, Schizosaccharomyces pombe 972h-
MSEKPDLRQRCSDIYREIKEKKLTVVKQGAEAITIKTEFYPGEVCLLKCRPAKRWRHPILDQKLSRKRCLVEARLLAKCHYVGIKCPMLYFIDANRGQIYMEWIDGPCVRDYIREICECEIEKKLIPLMKRIGSEVAKMHKNDIVHGDLTTSNMMLESHNNPVPIFIDFGLGSVSESEEDKAVDIYVLERALSSTLPESESLFHHVLDSYAQSWKQSKATLRRFEEVRMRGRKRTMIG

SEQ ID NO: 58414 - DNA, 621 bp, Methanopyrus kandleri AV19
  CDS (1)..(621): transl_table=11
gtggaagccggtgacgtcatcgccctcggcgccgagtcgctcctggttcgacacgactggctcgggctcctcgccgtctacaagatccgtcttcccaaaccctaccgtcacccgtccttggacgagcgcctccgtcgcctcaggactcgacgagaagcccgagcactgatcagattacccgagatgggtgtgccgactcctaccctgtacgaggtcgacttggatcttagcctgctgatcaccgagtacattcccgggagaaccctcaagcaggccaccgagagttccttcgatccggaccattaccggaagttgggtaagctcgtcgggcggatgcacgagcacggattcgtccactacgatttgaccacatcgaacatcctcgtgtccggtgacgacctctacatcatcgacttgggactgagcgaggactccgacgaccccgaagaccacgccgtcgacctgcgcgtgttcgaacggtgtctcgagagctcccaccccgaggttaaggaggaggcgtggagagccttcctacgaggctacagggaagagagggaagaagccaccgacacggtgctccgggccttggaggacctcaagtccagggtccggtacatctaa

SEQ ID NO: 58415 - protein, 206 aa, Methanopyrus kandleri AV19
MEAGDVIALGAESLLVRHDWLGLLAVYKIRLPKPYRHPSLDERLRRLRTRREARALIRLPEMGVPTPTLYEVDLDLSLLITEYIPGRTLKQATESSFDPDHYRKLGKLVGRMHEHGFVHYDLTTSNILVSGDDLYIIDLGLSEDSDDPEDHAVDLRVFERCLESSHPEVKEEAWRAFLRGYREEREEATDTVLRALEDLKSRVRYI

SEQ ID NO: 58416 - DNA, 1644 bp, Methanosarcina acetivorans C2A
  CDS (1)..(1644): transl_table=11
ttgaaaaacacattcatccttggaatcgaaggcactgcctggaacctgagtgccgcaatcgtgaccgagaccgagatcattgcagaggtcacggagacctataaacccgaagtaggcggaatccaccccagagaagccgcccagcaccatgcaaagtatgcagcaagtgttatcaaaagactccttgcagaagcaaaagaaaaaggagtggaaccttcagatcttgacggcatagctttttcacagggacccgggctcgggccctgcctgaggaccattgcaaccgcagccaggatgctttccctgtccctggacattcctcttataggggtcaaccactgcatcgcccatatagaaatagggatctggcgaaccccggcaagagatcctgtagttctctatgtaagcggggcaaattcccaggtcatctcatttatggaagggcgctacagggtctttggcgaaacccttgatatcgggcttgggaacgcccttgacaagtttgcgcggagagcaggtctgcctcaccccggggggcctaaaatcgaagcctgcgcaaaagacgcaaaacgatatatccctcttccttatgtgattaaggggatggacctctctttttccgggctttccacggcttcaagcgaagccctgaaaaaagcctcccttgaagatgtctgctactcctatcaggaaaccgcttttgcaatggttgtggaggttgcggaacgcgcccttgcccacaccggaaaaaatgaagtgctgctggcaggcggggttggagcaaacacaaggcttcgcgagatgttaaatgagatgtgtgaagccagaggggcaaagttctatgtgcccgaaaaacgcttcatgggcgacaacgggacgatgatcgcatacaccgggctcctgatgtataagtcaggaaataccctgacccttgaggattcgcgggtgaacccgaatttcaggaccgatgacgtgaacgttacctggataaaagaagaagagatgaaaaaagtcccggaaatctctcccgaggctttcctcagggcgcccccaggagaaaggctggacaacggagctgaagctgttatttaccttgacgaggggccggaagggaaaaaagtgcttgttaaggaaagggtcccgaagctttacagacacaaagagatagatgaaaggatcaggagggaaaggaaccggacagaagcccgtttgatatctgaagccaggcgggcaggagtgcccacgccgatcatctatgacattgaggaattcaagctcaaaatgcagttcatcgaaggagtccccataaagtacctcataacccccgagctttcggaaaaagtcggagagcttgtaggcaggctgcacagttcggggatagtccacggcgaccttaccacctcaaacctcctgcttgcaggggaacgactttacctcatcgacttcgggcttgcctactttgacaaaagcctggaagccagaggagtggacgtccatgtacttttccagacctttgaaagtacgcaccgcggccacgaaacccttgtcaaagcctttgaaaaagggtatggaagtacttttatagattcaaaggatgtactcaagcgagttgaagagataaaaaagagggctcgctatgcataa

SEQ ID NO: 58417 - protein, 547 aa, Methanosarcina acetivorans C2A
MKNTFILGIEGTAWNLSAAIVTETEIIAEVTETYKPEVGGIHPREAAQHHAKYAASVIKRLLAEAKEKGVEPSDLDGIAFSQGPGLGPCLRTIATAARMLSLSLDIPLIGVNHCIAHIEIGIWRTPARDPVVLYVSGANSQVISFMEGRYRVFGETLDIGLGNALDKFARRAGLPHPGGPKIEACAKDAKRYIPLPYVIKGMDLSFSGLSTASSEALKKASLEDVCYSYQETAFAMVVEVAERALAHTGKNEVLLAGGVGANTRLREMLNEMCEARGAKFYVPEKRFMGDNGTMIAYTGLLMYKSGNTLTLEDSRVNPNFRTDDVNVTWIKEEEMKKVPEISPEAFLRAPPGERLDNGAEAVIYLDEGPEGKKVLVKERVPKLYRHKEIDERIRRERNRTEARLISEARRAGVPTPIIYDIEEFKLKMQFIEGVPIKYLITPELSEKVGELVGRLHSSGIVHGDLTTSNLLLAGERLYLIDFGLAYFDKSLEARGVDVHVLFQTFESTHRGHETLVKAFEKGYGSTFIDSKDVLKRVEEIKKRARYA

SEQ ID NO: 58418 - DNA, 1689 bp, Methanosarcina mazei Go1
  CDS (1)..(1689): transl_table=11
gtgacagtaagcagaggaaaaggaacggaaaggagacctgaagccttgaaaaaaacattcatccttggaatcgaaggcactgcctggaacctgagtgccgcaatcgtgaccgagaccgagatcattgccgaggttacagagacatataaacctgaaaaaggcggaatccaccccagggaagccgcccagcaccatgcaaaatatgcggcaggcgttatcaaaaaactccttgcagaagcaaagcaaaacgggatagagccgtcagacctcgacggcatagctttttcacaggggcctggacttgggccgtgcttaaggaccgttgcaacggcagccaggatgctcggcctttcccttggcatcccgcttataggagtcaaccactgtattgcacatattgagatagggatctggaaaactcctgcaaaggaccctgttgtgctctatgtgagcggggcaaattcccaggtaatctcttatatggaagggaggtacagggtttttggagaaacccttgatataggacttggaaatgcccttgataaattcgctcgcggagcaggcttgcctcacccgggtgggcccaaaatcgaggcatatgcaaaagaagcaaagagatatatccctctcccgtacgtgattaaaggtatggacctctcattttccgggctttcaacagctgcaagtgaagccctgagaaaagcctcccttgaagatgtctgttattcttatcaggagactgcctttgcaatggttgtggaggttgcagaacgcgcccttgcccatacaggaaaaaaagaagtgctgcttgcaggcggggtgggagcaaacaccaggcttcgtgagatgttaaatgaaatgtgtgaagccagaggtgcaaagttctatgttcccgaaaaacgctttatgggcgacaacgggacaatgatcgcatacacagggctcctgatgtataagtccggaaataccatttcccttgaagattcgcgcgtaaaccccagtttcaggacagatgatgtcaaagtgacatggataaaggaagaagagatgaaaaaggtccctgaaatctcccctgaaactttcttcaggatgcctcccggggaaattctcgacaacggggctgaagctgttgtctaccttcaagagggacctgaaggtaagagggcgctggtcaaggaaagggtcccaaaggcttacaggcataaagagatagacgagaggataagaagagagaggaacaggacagaagcccgccttatgtctgaagccaggcgcgcaggcgtgcccactccaatcatctatgacgttgaggaattcaagcttaaaatgcagttcatcgaaggggtccccataaagtaccttataacccccccactttcggaaaaggttggagagctcgtgggcaaactgcacagttcaggcatcgtacatggagaccttacaacctcaaacctcctgcttgcaggtgagaggctttatcttatcgacttcgggcttgcgtattttgacaaaagccttgaagccagaggtgtggacgtccatgtgcttttccagacttttgagagcactcaccgcaactatgaagcccttgtcaaagctttcgagaaagggtatgcaagtacttttatagattcagaggatgtactcaggcgagttgaagagataaaaaagagggctcgctatgcataa

SEQ ID NO: 58419 - protein, 562 aa, Methanosarcina mazei Go1
MTVSRGKGTERRPEALKKTFILGIEGTAWNLSAAIVTETEIIAEVTETYKPEKGGIHPREAAQHHAKYAAGVIKKLLAEAKQNGIEPSDLDGIAFSQGPGLGPCLRTVATAARMLGLSLGIPLIGVNHCIAHIEIGIWKTPAKDPVVLYVSGANSQVISYMEGRYRVFGETLDIGLGNALDKFARGAGLPHPGGPKIEAYAKEAKRYIPLPYVIKGMDLSFSGLSTAASEALRKASLEDVCYSYQETAFAMVVEVAERALAHTGKKEVLLAGGVGANTRLREMLNEMCEARGAKFYVPEKRFMGDNGTMIAYTGLLMYKSGNTISLEDSRVNPSFRTDDVKVTWIKEEEMKKVPEISPETFFRMPPGEILDNGAEAVVYLQEGPEGKRALVKERVPKAYRHKEIDERIRRERNRTEARLMSEARRAGVPTPIIYDVEEFKLKMQFIEGVPIKYLITPPLSEKVGELVGKLHSSGIVHGDLTTSNLLLAGERLYLIDFGLAYFDKSLEARGVDVHVLFQTFESTHRNYEALVKAFEKGYASTFIDSEDVLRRVEEIKKRARYA

SEQ ID NO: 58420 - DNA, 675 bp, Drosophila melanogaster
  CDS (1)..(675)
atgtccctagaaatcctgaaacaaggcgctgaaggacgcctatatttgggcgatttcaaaggagaagcctgcctgatcaaggagcggttcgtaaagaagtaccgccacccggaactgaacacccagatcacgcggcagcgcatgaaagcggaggccaaggcatcgggaagatgtctagccgctggaatcctggcaccaaagatcctccactcggacctcaacacccacaagctgtatatggaatatttcgatgcagccaagactgccaagcagttcatccaggaaacagtgtccactcagacggaggatgaagccaagaaatgtctgctggagttctgcacgcggatcggtgaaatcattgggaaaatgcactccaatcacattatacatggcgatctcaccacatctaacatcctcatcaatccgaagggtggcgactacgatgtcattctgattgacttcggcttgagccactacaatcaggccaccgaggacaagggtgtggatctgtacgtcctggagcgggcgctactcagtacgcacagcgaacagccgtatatcttcgagcacgtcctggccgcctatcgcacagcgtgcggtaaggacgaacaggcagtgctcaccaagttcgaggaggtgcgagcacgcggacgcaaaagaaccatgattggttaa

SEQ ID NO: 58421 - protein, 224 aa, Drosophila melanogaster
MSLEILKQGAEGRLYLGDFKGEACLIKERFVKKYRHPELNTQITRQRMKAEAKASGRCLAAGILAPKILHSDLNTHKLYMEYFDAAKTAKQFIQETVSTQTEDEAKKCLLEFCTRIGEIIGKMHSNHIIHGDLTTSNILINPKGGDYDVILIDFGLSHYNQATEDKGVDLYVLERALLSTHSEQPYIFEHVLAAYRTACGKDEQAVLTKFEEVRARGRKRTMIG

SEQ ID NO: 58422 - DNA, 690 bp, Plasmodium falciparum 3D7
  CDS (1)..(690)
atgtctgcaggatctgatgctaggatctatcgatgcacgtttattaaaaaggaagcagtgaaaaaagttatttacagaaaatattacagacataaaaaaattgatacgaaaataaggaaattaagagtatctaatgaaattaagtttacaaaaaaattagctagtttaaatattgatgttccatatatttattttgtcgatgctaaagaaaaaagtttatatttcgagtatgtgaaaggatgtaccataaattttatattaaaaaatttaaaagaatatgaacctaaaatacctatttgtgtaggtatggtgttagcaaaaatacataatggtaatataatacatggagattatactacgtcaaatttaattttaagaaattcttttattcaacaaaataatctattagacctaaagaataataattctccatataattttagtgacttggaaaatgtcaaattgtgtgttatagatttcggattatcctttttatcctcatcaatagaagataaagctgtcgatttgtttgttctcctaaaaaccatcaaaagttttcatagtgaatttccctccttggaggaggatattcttgaaggatacaaaatgaagtctgacaatgttaacgacatatttacaaaattagaaatagttaaacaaaggggaagaaaaagacctatggttggatga

SEQ ID NO: 58423 - protein, 229 aa, Plasmodium falciparum 3D7
MSAGSDARIYRCTFIKKEAVKKVIYRKYYRHKKIDTKIRKLRVSNEIKFTKKLASLNIDVPYIYFVDAKEKSLYFEYVKGCTINFILKNLKEYEPKIPICVGMVLAKIHNGNIIHGDYTTSNLILRNSFIQQNNLLDLKNNNSPYNFSDLENVKLCVIDFGLSFLSSSIEDKAVDLFVLLKTIKSFHSEFPSLEEDILEGYKMKSDNVNDIFTKLEIVKQRGRKRPMVG

SEQ ID NO: 58424 - DNA, 2040 bp, Oryza sativa (japonica cultivar-group)
  CDS (1)..(2040)
atggccacgctcgcgaggagatcgatggtggccttgggccgtcgcgctctgtgctcgggcagcgacctggaggcggcggcgcgcgaagtcgtgtgctccggggcggggagcctcgacgaggtgggcggcgcgctggaccgcctgggcgtggccgtgtcgccggccatggtggcgagggtgatcgatgcgtgtagcgagaggatgggttcagggaggaggctgctgcggttcctgtcctggtgccggtccaaggacgccggtggaattggggacgaggcgttggatagcgcgatcgcggcgctcgcccggatgggggacctcaccgcgatgaggatcgccgtcgccgacgcggagaaggatggccggaggatgtccccggagacgttcaccgttgtcgtcgaggcactcgtgaaattggggaaggaggatgaggctgttcggttgtttagaggcttggagaggcagaggttgctgcctcggcgcgacgcgggtgatggaggggaaggcgtgtggtcgagcagccttgcaatggtgcaggcattgtgcatgaagggccatgctcgcgaggcgcagggcgtcgtgtggcaccacaagagcgagctctcggtagaacccatggttagcatcgttcagcgtagcctgctccacgggtggtgcgtccatgggaatgcgaaggaagctcggagagtccttgatgatatcaagtcttcgtgtaccccactgggtttgccatcattcaatgattatctgcactgcctgtgccataggaacctcaagtttaacccttctgcgcttgtcactgaggctatggacgtcttatcggagatgaggtcctatggtgtcaccccggatgcatctagcctcaacatcttgctttcttgtttgggacgagcaagaagagtgaaagaatcatacagaatcctctacttgatgagagaaggaaaggcagggtgctcccctgactgggttagttactatcttgtggtcagggtcctgtatttaacagggagaattattagagggaaaaggcttgtagatgacatgcttgaaagtggggtgcttccgactgcaaagtttttccatggtctcataggcgttctatgcgggactgagaaagttgaccatgggcttgatatgttcagacttatgaagaggtgtcagttagtggacacacatacctatgatcttcttatagaaaagctttgtaggaatgggagatttgagaatggaaaggagttgtgggatgatgctaaaaagaatggctttatgttaggatgttcagaggatcttttggatcccctgaaaacagaggaacaacaacaggattttggtgtgctactgaagcagggggcggagggaagggtatttgtttcaacatttgtgggacggaagtgtgtaatcaaagagcggttttcaaagaagtaccgacacccattgttggactcaaagttgactcttaaacgcttaaatgctgaagctcgatgcatgacaaaagcaagaaagcttggtgttcccactccagttctttatgccgtggacccacttctgcatacattaacctttgagtatgtggatggcttatctgtgaaagatatactccttggatttgggtcaaacgggatcaatgaagaacaactcattgacatcgccacacaaataggaaatgcagttggcaaactacatgatggaggccttgttcacggtgatttgaccacttcaaatatgataatcaagaacaacacaaatcaactcgttcttattgattttggtctgagtttcatatcaactattcctgaggacaaagcagtggacttatatgtgcttgagagagcattgatttctatgcattcatcatgtggtgatgtgatggagaagattctcacggcgtacagaaaagcttcaaagcaatggtgcgctactacgaacaagctagctcaagcttgtgctagtataggcaagtgcgacctaacgttgaccctgacagcggtcaacgggacccgtccgacctgtgtttgggccgttcttgggcctgctggatag

SEQ ID NO: 58425 - protein, 679 aa, Oryza sativa (japonica cultivar-group)
MATLARRSMVALGRRALCSGSDLEAAAREVVCSGAGSLDEVGGALDRLGVAVSPAMVARVIDACSERMGSGRRLLRFLSWCRSKDAGGIGDEALDSAIAALARMGDLTAMRIAVADAEKDGRRMSPETFTVVVEALVKLGKEDEAVRLFRGLERQRLLPRRDAGDGGEGVWSSSLAMVQALCMKGHAREAQGVVWHHKSELSVEPMVSIVQRSLLHGWCVHGNAKEARRVLDDIKSSCTPLGLPSFNDYLHCLCHRNLKFNPSALVTEAMDVLSEMRSYGVTPDASSLNILLSCLGRARRVKESYRILYLMREGKAGCSPDWVSYYLVVRVLYLTGRIIRGKRLVDDMLESGVLPTAKFFHGLIGVLCGTEKVDHGLDMFRLMKRCQLVDTHTYDLLIEKLCRNGRFENGKELWDDAKKNGFMLGCSEDLLDPLKTEEQQQDFGVLLKQGAEGRVFVSTFVGRKCVIKERFSKKYRHPLLDSKLTLKRLNAEARCMTKARKLGVPTPVLYAVDPLLHTLTFEYVDGLSVKDILLGFGSNGINEEQLIDIATQIGNAVGKLHDGGLVHGDLTTSNMIIKNNTNQLVLIDFGLSFISTIPEDKAVDLYVLERALISMHSSCGDVMEKILTAYRKASKQWCATTNKLAQACASIGKCDLTLTLTAVNGTRPTCVWAVLGPAG

SEQ ID NO: 58426 - DNA, 783 bp, Eremothecium gossypii
  CDS (1)..(783)
atgtctgcagaggttatctcgcgggtttcgcagatctatggcgagggtatcacgttaacgcctatttcacaaggcgctgaggccgttatttttactacgactactcatccgtacctgccctcgacagaaggcagctctaagtacgtcgtgaaatacaggccgcccaagacgtacaggcatccatcgatcgacgtggcactgaccaagcagcggactttgggcgaggcgcggctcctcggtaagctacagcagatcaaggggctccgggttcccaagctactcgcgtgcgacgtctacaatggaagcatctggatggagttcctgggagaagacctgccggaaagccgcgggttcagcaatttgaagaacttcctgtggatgtgtgcctcggaaccctacagcccggtcgtggaggccaccgtgcgcgatgtggggtgccagataggtctgctgcactggaacgactactgccacggtgatctcactacctccaacatcgtgctggtaaggagcggggctgagtgggcgccacacctgattgactttggtcttgggagcaattcgaacctcgtggaggacaagggggtggatttatatgtgctagaacgtgctcttgcgagcacgcactcggcgtttgcggaaaagtacttcgaatggttaatggagggctttacctctgtctaccagtcacatggagagaagggagagcaaaaactgaaggagctactccgcaggttcgaagaagtacgcctgcgcgggaggaagagaagcatgttgggctaa

SEQ ID NO: 58427 - protein, 260 aa, Eremothecium gossypii
MSAEVISRVSQIYGEGITLTPISQGAEAVIFTTTTHPYLPSTEGSSKYVVKYRPPKTYRHPSIDVALTKQRTLGEARLLGKLQQIKGLRVPKLLACDVYNGSIWMEFLGEDLPESRGFSNLKNFLWMCASEPYSPVVEATVRDVGCQIGLLHWNDYCHGDLTTSNIVLVRSGAEWAPHLIDFGLGSNSNLVEDKGVDLYVLERALASTHSAFAEKYFEWLMEGFTSVYQSHGEKGEQKLKELLRRFEEVRLRGRKRSMLG

SEQ ID NO: 58428 - DNA, 1647 bp, Methanococcus maripaludis S2
  CDS (1)..(1647): transl_table=11
atggataattctaaagacgacttaatatgtattggatttgagggaactgctgaaaaatcaggtgttggaataattacctcaaagggcgaagttttgtttaacaaaacaataatttatactccgcctgtacagggaatacaccctagagaagccgcagatcaccacgcagaaacttttgtgaaacttttaaaagaagcattaaacgaagttccgcttgaaaaaattgatcttgtttcattttcactcggtcctggactcggtccaagtttgagggttactgcaacaactgcaagagcactttctctttcaataaataaacccataatcggggtaaatcactgtatcggccacgtggaaattggaaaattaacaactgatgcagtggacccgcttacattatatgtaagtggtggaaatactcaagttttggcatacactggaaaaaaataccgggtaattggtgaaactctcgatattgcgataggaaactgtctcgaccagtttgcaaggcactgtaatttaccgcatccgggtggggtatacgttgagaaatttgcaaaagatggaaataagtttataaaactcccatacaccgttaaaggaatggatctttctctttcagggttattaacgtctgcaatgaaaaaatacgattcaaaagaaagaattgaagatgtatgctactcattgcaggaaacttcattttcaatgctaacagaaatcaccgaaagagcgcttgcacatactaataaagccgaagtaatgcttgttgggggagttgctgcaaataatcggttaaaagaaatgcttaaggtaatgtgtgaagagcagaatgttgatttctacgttccagaaaaacagttttgtggcgataacggtgcaatgattgcatggcttgggatattgcagtatttaaatggaaaaagaatggatttgaaggatacaaaaccgatttcaaactacagaagtgacatggtcgaagttaactggattcatgacgaaagcaaaaacttgaatgatggaaatattaaatctcgaaaaattccaaaacatttgattggaaaaggcgctgaagccgatatatcaaaaggaaggtatttagaatttgaatctattacaaaagagcgagttaaaaaaggataccgtattttaaaactggatgaattgataaggacaagaagaacagtaaaagaagcaagatttttggcagcagttaaagaatgtggaattcatgctccaagcatttatgacatcgataaagagaataaaaaaattataatgggctacattcacggaaaaattgcaaaagacgaaattgaagaaggaaatatcgaattttgtaaaagtttaggggaaactattggaaaaatgcatggcagtggaattgtgcacaatgatttaacaacttcaaactttataatttcaaaaaatccatatataatagattttgggcttggaaaatacagcgatttaattgaagacaaagcaattgatttgatagtcttaaaaaaatcgataatgagcatccactatgataaatttgatttggtctggaataaaataatagacggatacaaaacgtatgaactggctgaatcggttttggaatgcataaaagaggttgaaaaacgggcaagatatctttaa

SEQ ID NO: 58429 - protein, 548 aa, Methanococcus maripaludis S2
MDNSKDDLICIGFEGTAEKSGVGIITSKGEVLFNKTIIYTPPVQGIHPREAADHHAETFVKLLKEALNEVPLEKIDLVSFSLGPGLGPSLRVTATTARALSLSINKPIIGVNHCIGHVEIGKLTTDAVDPLTLYVSGGNTQVLAYTGKKYRVIGETLDIAIGNCLDQFARHCNLPHPGGVYVEKFAKDGNKFIKLPYTVKGMDLSLSGLLTSAMKKYDSKERIEDVCYSLQETSFSMLTEITERALAHTNKAEVMLVGGVAANNRLKEMLKVMCEEQNVDFYVPEKQFCGDNGAMIAWLGILQYLNGKRMDLKDTKPISNYRSDMVEVNWIHDESKNLNDGNIKSRKIPKHLIGKGAEADISKGRYLEFESITKERVKKGYRILKLDELIRTRRTVKEARFLAAVKECGIHAPSIYDIDKENKKIIMGYIHGKIAKDEIEEGNIEFCKSLGETIGKMHGSGIVHNDLTTSNFIISKNPYIIDFGLGKYSDLIEDKAIDLIVLKKSIMSIHYDKFDLVWNKIIDGYKTYELAESVLECIKEVEKRARYL

SEQ ID NO: 58430 - DNA, 702 bp, Anopheles gambiae str. PEST
  CDS (1)..(702)
atggtacagcagctcctaaagcagggagcagaagggaaactgtacatcggcacctacaaaggcaaccggtgtttggtgaaggaacgcttcgagaagaaataccgccatccggcactcgatcggcagctcacccggcaacgcatcaaagcggaacagaaagccttccaacgatgtgctgccgccggtctgtccaccccagccctttacggcgtcgatttagagcagcgcaagatctacatggaatatctggagcgtagtcgtacggcaaaagagtttatcgacgagctgacggcaaccacggcagcggatgctttgcaggaatcagcccagctgaagcagcttgctgaacagatcggccacatggtgggtgtgctgcatcgaaacaatctagtgcacggtgatctgaccacctccaacatgctgctcgatccggtggaaaagggtgcggaagagtccgtcttcccgtaccgtctcgtgacgatcgactttgggctgtcccactttagtgataaccacgaaaacaagggtgtcgatttatacgtgctcgagcgagcgattctaagcgctcacagtcaactgccgggcttgttcggtatgatactggaggcgtaccgtgagcacaatacgaaccattgcaaggaaacaatcgccaagtacgaagaggtacgggcccggggacgaaagcgaacgatggtgggataa

SEQ ID NO: 58431 - protein, 233 aa, Anopheles gambiae str. PEST
MVQQLLKQGAEGKLYIGTYKGNRCLVKERFEKKYRHPALDRQLTRQRIKAEQKAFQRCAAAGLSTPALYGVDLEQRKIYMEYLERSRTAKEFIDELTATTAADALQESAQLKQLAEQIGHMVGVLHRNNLVHGDLTTSNMLLDPVEKGAEESVFPYRLVTIDFGLSHFSDNHENKGVDLYVLERAILSAHSQLPGLFGMILEAYREHNTNHCKETIAKYEEVRARGRKRTMVG

SEQ ID NO: 58432 - DNA, 735 bp, Rattus norvegicus
  CDS (1)..(735)
atggctggcgcgtcttcggaggcggaggcggaggcgctggccgcggcgcgcgagcggagccgcctcttcctgagcggcctggagctggtgcagcagggcgccgaggctcgagtgttccgtggccgcttccagggccgagcggccgtggtgaagcaccgcttccctaagggctaccggcacccggagctggaggcgcggctcggccggcggcggacggttcaggaggctcgcgcgctgttgcgctgccgccgtgcgggaatagctgcccccgtcgtcttctttgtggactatgcttctaactgcctatatatggaagaaatcgaagactcggtgactgttcgagattatattcaatccactatggagactaaacaagacccccaatgcctcttggacttggccaggaagatcgggcaggttctggccagactgcatgacgaggacctcattcacggggacctcaccacctccaacatgctcctgacacggcccctggagcagctgcacatcgtgctcatcgacttcgggctgagttttgtctcaggactgccagaagacaaaggcgtagacctctatgtcctggagaaagccttcctcagcacgcacccccacactgagactgtgtttgaagcctttctgaagagttacggtgcctcatccaagaagtccgatccagtgctgaagaagttagatgaggtgcgcctgagagggcgaaagcggtccatggttgggtag

SEQ ID NO: 58433 - protein, 244 aa, Rattus norvegicus
MAGASSEAEAEALAAARERSRLFLSGLELVQQGAEARVFRGRFQGRAAVVKHRFPKGYRHPELEARLGRRRTVQEARALLRCRRAGIAAPVVFFVDYASNCLYMEEIEDSVTVRDYIQSTMETKQDPQCLLDLARKIGQVLARLHDEDLIHGDLTTSNMLLTRPLEQLHIVLIDFGLSFVSGLPEDKGVDLYVLEKAFLSTHPHTETVFEAFLKSYGASSKKSDPVLKKLDEVRLRGRKRSMVG

SEQ ID NO: 58434 - DNA, 741 bp, Rattus norvegicus
  CDS (1)..(741)
atggctgccgggtcttcggaggcagagacggaggcggaggcgctggccgcggcgcaggagcggagccgcctcttcctgagcggcctggagctggtgcagcagggcgccgaggctcgagtgttccgtggccgcttccagggccgagcggccgtggtgaagcaccgcttccctaagggctaccggcacccggagctggaggcgcggcttggccggcggcggacggtgcaggaggctcgcgcgctgttgcgctgccgccgtgctggaatagctgcccccatcgtcttctttgtggactatgcttctaactgcctatatatggaagaaatcgaagactcggtgactgttcgagattatattcaatccactatggagactaaacaagacccccaatgcctcttggacttggccaggaagatcgggcaggttctggccagactgcatgacaaggacctcattcacggggacctcaccacctccaacatgctcctgacacggcccctggagcagctgcacatcgtgctcatcgactttgggctgagttttgtctcaggactgccagaagacaaaggcgtcgacctctatgtcctggagaaggccttcctcagcacgcacccccacaccgagactgtgtttgaagcctttctgaagagttacggtgcctcgtccaagaagtccagtccagtgctgaagaagttagatgaggtgcgcctgagagggcgaaagcggtccatggtcggatag

SEQ ID NO: 58435 - protein, 246 aa, Rattus norvegicus
MAAGSSEAETEAEALAAAQERSRLFLSGLELVQQGAEARVFRGRFQGRAAVVKHRFPKGYRHPELEARLGRRRTVQEARALLRCRRAGIAAPIVFFVDYASNCLYMEEIEDSVTVRDYIQSTMETKQDPQCLLDLARKIGQVLARLHDKDLIHGDLTTSNMLLTRPLEQLHIVLIDFGLSFVSGLPEDKGVDLYVLEKAFLSTHPHTETVFEAFLKSYGASSKKSSPVLKKLDEVRLRGRKRSMVG

SEQ ID NO: 58436 - DNA, 810 bp, Magnaporthe grisea 70-15
  CDS (1)..(810)
atggcggggtcgcaaaccacttgtcctgacccctcatcctaccccttccccttgccagcgatccttacccaccctgccagtgcgccaccgacactcatcacacaaggcgccgagggccgcctgtacaaaacaacatacttgcggccggatttgccgtgcgccctcaagcacaggccatcgaagccatatcgacatccgatcctggatgcccgcctaacgcgccagcgcatcctcgccgaggcgcgcatcctatccaagtgcaggcgcgatggcaccgccgctggcgtgccggctgtgtacgcgctggacgaggcggcgggatggttgatgctggagtggatagagggggtgccggtgcgcgtgagcatcaacgagtggcttaagcggaggacaaggttgggggcctcgtccgccatacaggaagacgagcagctcgtcaagctcatgaggaagatgggtgccgcagtggcggctatacatcgcgttggcgtagttcacggtgacctgaccacgagcaacatgatgctccgtcctccacagaaccagggcgaggtagccgaggataggcttctcgatggcgacgtggttgtgatcgattttggcctggcgagccagagcgtttccgatgaggatagagccgtggacctctatgtattggagagagcatttggaagcacgcaccccagagccgaggctgtctttgagcaagtcctcaagggataccaggagggattcaaacaagcaacgccagtgctgaggaaactggaagatgtgcggatgagggggcgcaaaagaagcatgatcggatga

SEQ ID NO: 58437 - protein, 269 aa, Magnaporthe grisea 70-15
MAGSQTTCPDPSSYPFPLPAILTHPASAPPTLITQGAEGRLYKTTYLRPDLPCALKHRPSKPYRHPILDARLTRQRILAEARILSKCRRDGTAAGVPAVYALDEAAGWLMLEWIEGVPVRVSINEWLKRRTRLGASSAIQEDEQLVKLMRKMGAAVAAIHRVGVVHGDLTTSNMMLRPPQNQGEVAEDRLLDGDVVVIDFGLASQSVSDEDRAVDLYVLERAFGSTHPRAEAVFEQVLKGYQEGFKQATPVLRKLEDVRMRGRKRSMIG

SEQ ID NO: 58438 - DNA, 789 bp, Gibberella zeae PH-1
  CDS (1)..(789)
atgacgacaaccacggctacggcgaccgccgaccccgcggagcaagcgcaccagtttcccctccctaaaatcctcgagtaccccgcgtcaaccccgccaatcctcatcacacaaggggccgagggtcgtctctacaaaaccacttatctgttgccggatattccctgcgctctaaagtaccgtcctccgaagccctggcgacacccgattcttgaccagcgccttacgaaacaccgcatcctttcagaggctcgcattcttgcaaagtgccgccgcgatggtgtccgtgtaccggcggtctatgctgtagatgaatctgccggttggctgatgctggaatgggtatctggaggacctgtccgtaagagcatcaacgagagactgggaaacaggacagagggtatcgagaacgacgcggagttgaaggatctcatgcgcagaatcggtaccgctattggtaacatgcacaaggtcggcattgttcacggcgacttgactacaagcaatatgatgttggaacctctggccaacccgcaagacgacaatcctttgcacggagagttggttatcattgacctgggtctttcaagtggaagcatatcagacgaggatcgtgcagtagatctctatgttttggagagagcttttggtagtacacatcctcgggcagaatgcgtcttctcagaggtgctcgatgcttacggtcaaacctttaaacaagccaaggttgtacttaaaaagttggaagatgtgcgaatgagaggtcgcaaacgaagcatgcttggatga

SEQ ID NO: 58439 - protein, 262 aa, Gibberella zeae PH-1
MTTTTATATADPAEQAHQFPLPKILEYPASTPPILITQGAEGRLYKTTYLLPDIPCALKYRPPKPWRHPILDQRLTKHRILSEARILAKCRRDGVRVPAVYAVDESAGWLMLEWVSGGPVRKSINERLGNRTEGIENDAELKDLMRRIGTAIGNMHKVGIVHGDLTTSNMMLEPLANPQDDNPLHGELVIIDLGLSSGSISDEDRAVDLYVLERAFGSTHPRAECVFSEVLDAYGQTFKQAKVVLKKLEDVRMRGRKRSMLG

SEQ ID NO: 58440 - DNA, 711 bp, Apis mellifera
  CDS (1)..(711)
atgttgaataatataaaagattttgaattaatagcacaaggcgctgaagcacgtatatataagggcacttatctgggaaagttaacattaatcaaggaaagattcgaaaagaaatatagacatccagacttagatatacgtctcacaaaagatcgaataaaagccgaatgtcgtgctatactccgtgctaaaactgcaggaatcgcaacaccagctatatatttgataaatttagaacgacgatgtatttatatggaatatatacaagatgcaataatattaaaagattttcttgataaaaatgttttgaaagaagcaaatattgatcatttgttaaattttatagcacaaggacttggagtacttattgctaaattacatttgaaaaatataattcatggggatttaactacttccaatattcttttgaaaaatattgacaattatattgaaaaatatgatgttgcgaataattttgttataatagattttggattagctcatatagaatcgaacatagaagataaagcagtcgatttatacgttcttgaacgatcattattaagtgcacattcagaaataccttcattattctcaaaaatatttgatatttatcaaatacattatgcaaataaaaatcaatgtaaagaaattgtttctaaatataaggaagtacaattacgaggacgaaaacgattaatgatcggttaa

SEQ ID NO: 58441 - protein, 236 aa, Apis mellifera
MLNNIKDFELIAQGAEARIYKGTYLGKLTLIKERFEKKYRHPDLDIRLTKDRIKAECRAILRAKTAGIATPAIYLINLERRCIYMEYIQDAIILKDFLDKNVLKEANIDHLLNFIAQGLGVLIAKLHLKNIIHGDLTTSNILLKNIDNYIEKYDVANNFVIIDFGLAHIESNIEDKAVDLYVLERSLLSAHSEIPSLFSKIFDIYQIHYANKNQCKEIVSKYKEVQLRGRKRLMIG

SEQ ID NO: 58442 - DNA, 966 bp, Gallus gallus
  CDS (1)..(966)
atgtgctgcccggtgttggtgacggcagcctgcagcgggtgccacagccaggtgtctgcagcagctctgcgtggctctgaccgctgcaaacgctccctgtgcctgagggcaggagcggctgagaaagccctcgcgagcacaaagaaaacagcaatgcaagaggagagagaaccccgactcggtgcagaacctctccttaaccccagctggcggcgagggctggccggccttcacccacgtggagctgtgggcctggggacacccaaggaacaggagacacccacggtaccgaagcgggagctccggcggtgcccgctggtgcagcagggcgccgaggcgcgcgtctaccgggggagcttcctggggcgcgcggccgtggccaagctccgcttccccaagctgtaccggcacccggcgctggaggagcggctcagccggcggcgcacggcgcaggaggcgcgatccctgctgcgctgccggcgggcagggatcccggctcccgtggtctacttcgtggattacgcgtccaactgcatttatctggaagatatcgttggcgcgatcgctgttcaggatcacatctactccgtgcagcggagcggcagcgatgccagcagcctcctcggcttggcggagaagatgggccagctgctggccaggatgcacgacgaggacctcatccacggggacctcacgacgtccaacgtgctgctgcggccgcccgcggagcggctggacttggtgctgattgactttgggctcagctttatttcgggtcttcccgaggataaaggagtcgatctgtacgtgctggaaaaagccttccttagtacccatcccgatacggaaactgtgtttcaggctctgctgcagagctacgcggccgcctctaagaaatccggcccggtgatcaaacgtctggatgaggtgcggctcagggggaggaagaggtccatgattgggtaa

SEQ ID NO: 58443 - protein, 321 aa, Gallus gallus
MCCPVLVTAACSGCHSQVSAAALRGSDRCKRSLCLRAGAAEKALASTKKTAMQEEREPRLGAEPLLNPSWRRGLAGLHPRGAVGLGTPKEQETPTVPKRELRRCPLVQQGAEARVYRGSFLGRAAVAKLRFPKLYRHPALEERLSRRRTAQEARSLLRCRRAGIPAPVVYFVDYASNCIYLEDIVGAIAVQDHIYSVQRSGSDASSLLGLAEKMGQLLARMHDEDLIHGDLTTSNVLLRPPAERLDLVLIDFGLSFISGLPEDKGVDLYVLEKAFLSTHPDTETVFQALLQSYAAASKKSGPVIKRLDEVRLRGRKRSMIG

SEQ ID NO: 58444 - DNA, 801 bp, Candida glabrata CBS138
  CDS (1)..(801)
atgtctcaagaaattgtcgatagggtgcggaactatctgtctcctaatattccagttacaccaatttcgcaaggtgctgaggcggtggtatttactacatctgtgcatccataccttcccgaaaattgcaactctaatgagaagtatattatcaagtacagatctcctaaaaggtatagacatccagttattgataagtcattaacaaaacacaggacactcggtgaagcaagacttttatctaaactctataccattgaaggtttacatgtaccgaagctaatagcatgtgatgcttacaatggttatttatggcttgaattcctgggagaagatcttcctgaaaattttggatatagcaatcttaagaatttcctatggatgtacgatgcaaagaatgatccgtattgcgaagtggtcaagagggcattgattgaagttggagaacaaattggtaaactacattggaacgactactgtcatggtgacctaacgagctcgaatatagtaatggttcactctgatactgattcacaccattgggtaccccatttaattgattttggcttagggtctaccacaactatggtagaagataaaggtgtggatatatatgtgcttgaaagagctattttgagtacacattcacaacatgccgaacagtatattgaatggatgcttgatggtttcaaatcggtatacgagaagaatggcaagttaggtaaaaagaaactcgatgagttactgaagaggtttgcagaggtgagacttcgcggaagaaagagaagtatgataggctaa

SEQ ID NO: 58445 - protein, 266 aa, Candida glabrata CBS138
MSQEIVDRVRNYLSPNIPVTPISQGAEAVVFTTSVHPYLPENCNSNEKYIIKYRSPKRYRHPVIDKSLTKHRTLGEARLLSKLYTIEGLHVPKLIACDAYNGYLWLEFLGEDLPENFGYSNLKNFLWMYDAKNDPYCEVVKRALIEVGEQIGKLHWNDYCHGDLTSSNIVMVHSDTDSHHWVPHLIDFGLGSTTTMVEDKGVDIYVLERAILSTHSQHAEQYIEWMLDGFKSVYEKNGKLGKKKLDELLKRFAEVRLRGRKRSMIG

SEQ ID NO: 58446 - DNA, 792 bp, Kluyveromyces lactis NRRL Y-1140
  CDS (1)..(792)
atgtctgccgaaataattgctagcatagccgatgtgttaactgataacatccctttaacaccaatctctcagggcgctgaggcagttgtatttacatcaccggtacatccatatttgcccaagaacagaacagatggtgacgataagttatacatcttgaaatatagacctgagaagaaatacagacaccctgtgatagacaagacattaactaaacataggacactaggggaatcgaggcttttagctaaattaaggctaattgatgggctgaacgttccaaaattaataggatgtgatccatatcacgggtgtatctggctagagttcttgggagaagacttacctaatggacatggtttcagcaacttaaagaattttctatggatgaatgcctctgatccctattccgatcttgttagggatactatgatcaatgtcggcaaacagatcgggttaatgcattggaacgattattgtcatggagatttaacaacctcgaacattgttttagtcagagcaggagaggattggcagccatatctgatcgactttggtctaggatccatatcaacattagtggaagacaaaggcgttgatttgtacgtgttagagagagccatcataagtactcattcatcatttgctaatagatataacttatgggttcttgaaggtttcaaaagcgtatttgaatctcatggtaaagcagggcttgggaagtataaagatttaattagaaggtttgaagaggttaggttacgtggtagaaagagaagtatgatcggataa

SEQ ID NO: 58447 - protein, 263 aa, Kluyveromyces lactis NRRL Y-1140
MSAEIIASIADVLTDNIPLTPISQGAEAVVFTSPVHPYLPKNRTDGDDKLYILKYRPEKKYRHPVIDKTLTKHRTLGESRLLAKLRLIDGLNVPKLIGCDPYHGCIWLEFLGEDLPNGHGFSNLKNFLWMNASDPYSDLVRDTMINVGKQIGLMHWNDYCHGDLTTSNIVLVRAGEDWQPYLIDFGLGSISTLVEDKGVDLYVLERAIISTHSSFANRYNLWVLEGFKSVFESHGKAGLGKYKDLIRRFEEVRLRGRKRSMIG

SEQ ID NO: 58448 - DNA, 783 bp, Debaryomyces hansenii CBS767
  CDS (1)..(783)
atgacggatcatatagtgaagaaagcacaagagtgcttaccaaatatcccattaacagttatatcccaaggagcagaagcgttagtgttctatactgatgtccatccatatgctaatgaaccatatttacaaaaccgtggaaaatacgtcatcaaatatagaccatccaaaccatatagacaccctaaggtagacagcagtattaccaaatctcgtactgtgggggaagtaaagttcatgtataagttaaacaagttgaatataaattccccaagaataattctggcagattacaataacggcataatttggatggaatacataggatacagcttacctaatggagacgtgagctctttcaagaactggttatggtatcttgaaaggaacaaccaagattgtacaagcgagtctgttgagaagatgtgcttcaaggtggggcaacttattggaaaactacacttacacgaaatgatacacggagatttgacttcgtcgaatatattattgaatgatgatgagccagtattaatcgactttggattgtcatcatactcgggattagcagaagatagagccgttgatctatatgttttagagagagcaataaccagtacgcattctgtatatgctaaggagtataaccaatggttgttacaaggatacgaggatgtccataagcataaagaatttggcaaacagggccaaaagaaattagtagaagtgttgaagaaattagacgacgtaagattaagaggaagaaagagaagcatgttaggttga

SEQ ID NO: 58449 - protein, 260 aa, Debaryomyces hansenii CBS767
MTDHIVKKAQECLPNIPLTVISQGAEALVFYTDVHPYANEPYLQNRGKYVIKYRPSKPYRHPKVDSSITKSRTVGEVKFMYKLNKLNINSPRIILADYNNGIIWMEYIGYSLPNGDVSSFKNWLWYLERNNQDCTSESVEKMCFKVGQLIGKLHLHEMIHGDLTSSNILLNDDEPVLIDFGLSSYSGLAEDRAVDLYVLERAITSTHSVYAKEYNQWLLQGYEDVHKHKEFGKQGQKKLVEVLKKLDDVRLRGRKRSMLG

SEQ ID NO: 58450 - DNA, 747 bp, Yarrowia lipolytica CLIB99
  CDS (1)..(747)
atgatcacacttccagagcagctggagaagctgtccaagcaggaaaatctcattgcacaaggcgctgagtcgttggtgtattccgcccagcacccctacctcccccaacaagaatgcatcgttaaatacagacccaagaagccatatcgtcttccggaacttgatgcccagctcagcaaacacagaacgctggccgaggcccgggtgttgcagaagctggctcttggagacgtggaagtgccccatctggtcttcatcgatgccaaaaacggactcatctacatggagaagatcgaaggtctgagtgtgaagcagtggatctggaacgaggagggagacaccgaaggaggggcccaggaggccggagataagagcagatcgttaccggatggtgacgtgtcttctctgaaggacaccctggttcttgtcggccaagaaatcggcaagttgcataaatctgacattgtccatggcgatctgaccacttcgaacgtcatgttgagagacggcaagcctgtcatcatcgactttggactcgcttccgtgtccactctggccgaagataaggctgtggatctatatgtcatggagcgagccgttctcagtactcatcctgtccacagtcaacagtactgcgactggttgtttgaaggatacctggctgttgtcggcaagagtcagaaagaggtgatgcgaaaactggaggatgttcgacagcgaggacgaaagcggtccatgctaggttga

SEQ ID NO: 58451 - protein, 248 aa, Yarrowia lipolytica CLIB99
MITLPEQLEKLSKQENLIAQGAESLVYSAQHPYLPQQECIVKYRPKKPYRLPELDAQLSKHRTLAEARVLQKLALGDVEVPHLVFIDAKNGLIYMEKIEGLSVKQWIWNEEGDTEGGAQEAGDKSRSLPDGDVSSLKDTLVLVGQEIGKLHKSDIVHGDLTTSNVMLRDGKPVIIDFGLASVSTLAEDKAVDLYVMERAVLSTHPVHSQQYCDWLFEGYLAVVGKSQKEVMRKLEDVRQRGRKRSMLG

SEQ ID NO: 58452 - DNA, 762 bp, Pan troglodytes
  CDS (1)..(762)
atggcggcggccagagctactacgccggccgatggcgaggatcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggccgacggcggacggtgcaggaggcccgggcgctcctccgctgccgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggcgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtag

SEQ ID NO: 58453 - protein, 253 aa, Pan troglodytes
MAAARATTPADGEDPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 58454 - DNA, 759 bp, Dictyostelium discoideum
  CDS (1)..(759)
atggatgccaatgaatgtagcaatagtgaaaattcagcgacaacaacaataccgaaatcagcatcaccatctacaactatatcaacaaaagttgtaaaattagatgaaattggtatacttatttcacaaggtgcagaagctaaaacatatgaaactgatttatatggattaaaatgtattgtaaaagaaagattttcaaaagcatatagacatccaatattagatcaaaagatatcatcaaagagaatattacaagaagttagatcattaaataaatgtaaaaaaaagggaattcaagtaccatcactttatttagttgatatcggtaataatagaatctatatggaatttataaaaggtgaaactgtaaaacattatttatacaaaaatcaagaatcaactcaacaccaaaatcaaatagaatcaataatgaaagaattgggtaaccaaattggtataatacatgaaatgaatgtaattcatggtgatttaaccacttcaaatatgttattaagagaatcaacaaatgagttggttttcattgattttggtcttagttatacttcaaattctgtagaagataaagctgttgatctttacgttttagagcgtgctttcattagtactcatccaaattctgaacaattatttcaaacaattttatcaaactatgaattaacttcatcaaattctaaaattgtaattcaaaaattaaatcaagttagattaagaggtagaaagaaaacttgttttggttaa

SEQ ID NO: 58455 - protein, 252 aa, Dictyostelium discoideum
MDANECSNSENSATTTIPKSASPSTTISTKVVKLDEIGILISQGAEAKTYETDLYGLKCIVKERFSKAYRHPILDQKISSKRILQEVRSLNKCKKKGIQVPSLYLVDIGNNRIYMEFIKGETVKHYLYKNQESTQHQNQIESIMKELGNQIGIIHEMNVIHGDLTTSNMLLRESTNELVFIDFGLSYTSNSVEDKAVDLYVLERAFISTHPNSEQLFQTILSNYELTSSNSKIVIQKLNQVRLRGRKKTCFG

SEQ ID NO: 58456 - DNA, 519 bp, Entamoeba histolytica HM-1:IMSS
  CDS (1)..(519)
atgaataaaaaacgagtaagtaatgaaaataaaacacttcaacgatttaatgaattaaatattccatgtcctaaagtattttattgtaataatttagatattgtaatggagtatattgatggaaaaacattaaagagttttgtgaatggtatgtacaaaaatgaaaaatacagtgatgaagctatttgtgtgatggggaaattaggaaaacttattggcacaattcataaaaaaggatttattcatggtgatttaactacttcaaacttcatgattaaacaaactggagatatcattattattgattttggattaacaacaatgtcagaaacaatagaaaatagagctgttgatttatatgtattagaacgagctcttttatgtacacactacaaagcagaagatttatttagatatattttagaaggatatcgtgaaacaggagataaagctaatgaagttattcaacatcttaatgaagttcgattaagaggaagaaagaaagatatgtcaggataa

SEQ ID NO: 58457 - protein, 172 aa, Entamoeba histolytica HM-1:IMSS
MNKKRVSNENKTLQRFNELNIPCPKVFYCNNLDIVMEYIDGKTLKSFVNGMYKNEKYSDEAICVMGKLGKLIGTIHKKGFIHGDLTTSNFMIKQTGDIIIIDFGLTTMSETIENRAVDLYVLERALLCTHYKAEDLFRYILEGYRETGDKANEVIQHLNEVRLRGRKKDMSG

SEQ ID NO: 58458 - DNA, 696 bp, Entamoeba histolytica HM-1:IMSS
  CDS (1)..(696)
atgacttataaaacctcttcatttgactttaaaagtcttcttcttcatttggatgaaaaagacaaagtaagtcaaggggcagaagcagttatatataaagtgagtacaccaaattgtatctttcttattaaacaccgatttgctaaatcatatagagaacctactttagacaaatcaatgaataaaaaacgagtaagtaatgaaaataaaacacttcaacgatttaatgaattaaatattccatgtcctaaagtattttattgtaataatttagatattgtaatggagtatattgatggaaaaacattaaagagttttgtgaatggtatgtacaaaaatgaaaaatacagtgatgaagctatttgtgtgatggggaaattaggaaaacttattggcacaattcataaaaaaggatttattcatggtgatttaactacttcaaacttcatgattaaacaaactggagatatcattattattgattttggattaacaacaatgtcagaaacaatagaaaatagagctgttgatttatatgtattagaacgagctcttttatgtacacactacaaagcagaagatttatttagatatattttagaaggatatcgtgaaacaggagataaagctaatgaagttattcaacatcttaatgaagttcgattaagaggaagaaagaaagatatgtcaggataa

SEQ ID NO: 58459 - protein, 231 aa, Entamoeba histolytica HM-1:IMSS
MTYKTSSFDFKSLLLHLDEKDKVSQGAEAVIYKVSTPNCIFLIKHRFAKSYREPTLDKSMNKKRVSNENKTLQRFNELNIPCPKVFYCNNLDIVMEYIDGKTLKSFVNGMYKNEKYSDEAICVMGKLGKLIGTIHKKGFIHGDLTTSNFMIKQTGDIIIIDFGLTTMSETIENRAVDLYVLERALLCTHYKAEDLFRYILEGYRETGDKANEVIQHLNEVRLRGRKKDMSG

SEQ ID NO: 58460 - DNA, 858 bp, Aspergillus nidulans FGSC A4
  CDS (1)..(858)
atgccaccaacgaaccgccccccaccattttccaccattctttcttccgcgtcccttccttcttactcttcaacagatgaattaacaccaatatatcaaggcgctgaagcgcacctctacaaaactacgttcctctcaccgtcccagcccgccgcgctcaaaatccgcccgtcaaaaccctaccggcacccgatcctcgatcgccgcctaacccgcgcccgcatattacaagaagcgcgttgtctccagaagttagtgaaagagggtgtatcggtccccgcattattgggtgtggattgggagccgagtgctggagatgggagctcttggcttgttatggaatggattgagggtgagcctgtcagggttattctggaggaatgggaggcatatttgaaaggcattgagagggaaaagaggctgggcttgggagagggtgtgcaagggagcgaggaggagaaggttcgcgggcttatgcggaggattgggagggctgttggggggttgcatagagcgggtgttatacatggggacttgacaacgagcaatcttatgctgcgccctttgggctctgcagatacgactgaaaccatagaggagagggatcagtcaccctctatggcaggtgaagttgtcatgattgacttcggactcgcgatgcagagctcccaggatgaggaccgcgcggtggatctctatgtcctagaacgggcttttgggagctcgcatccacgaacggaaaggtttttcgaggaagttcttgttgggtatagagaaagttataagggtgcggtctcggctctgaagagactggaagatgtgaggatgagaggaaggaagaggagcatgattgggtag

SEQ ID NO: 58461 - protein, 285 aa, Aspergillus nidulans FGSC A4
MPPTNRPPPFSTILSSASLPSYSSTDELTPIYQGAEAHLYKTTFLSPSQPAALKIRPSKPYRHPILDRRLTRARILQEARCLQKLVKEGVSVPALLGVDWEPSAGDGSSWLVMEWIEGEPVRVILEEWEAYLKGIEREKRLGLGEGVQGSEEEKVRGLMRRIGRAVGGLHRAGVIHGDLTTSNLMLRPLGSADTTETIEERDQSPSMAGEVVMIDFGLAMQSSQDEDRAVDLYVLERAFGSSHPRTERFFEEVLVGYRESYKGAVSALKRLEDVRMRGRKRSMIG

SEQ ID NO: 58462 - DNA, 648 bp, Plasmodium berghei
  CDS (1)..(648)
atgaaaatatataaatgcgatttcataggaaaggaagcaattaaaaaagtaatttacagaaaatattatagacacaaaaaaatcgattcaaaaatacgaaaattaagaatatcaaatgaaatcaaatttactaaaaaactagccagtttaaatattgacgtaccatatttatatttcgttgatacgaaagaaaaaagcttatattttgaatacgtcaatggatgcacaataaataatatattaaaaagtatctcacaatatcaaccgaacattcctaaattcattggtatcacattagcaaaaatacataatggaaatgtaatacatggagattttactacatcaaatttaattttaagatattcatatattaatgaaaatgaaatttttaataatttaaataatgccccttatgaattgaatgatatcaaggaaatcaagctttgcgttatcgattttggtctatcctttttatcagcttcggttgaggataaggctgtggatttgtttgttctcttgaaagccattaaaagtttccatagtgaatttcctaaattggaagaagacattttattggggtatgaaacccaatcgaataattttgatttaatcagaaaaaaactagaaacaggtttgctcataaattaa

SEQ ID NO: 58463 - protein, 215 aa, Plasmodium berghei
MKIYKCDFIGKEAIKKVIYRKYYRHKKIDSKIRKLRISNEIKFTKKLASLNIDVPYLYFVDTKEKSLYFEYVNGCTINNILKSISQYQPNIPKFIGITLAKIHNGNVIHGDFTTSNLILRYSYINENEIFNNLNNAPYELNDIKEIKLCVIDFGLSFLSASVEDKAVDLFVLLKAIKSFHSEFPKLEEDILLGYETQSNNFDLIRKKLETGLLIN

SEQ ID NO: 58464 - DNA, 891 bp, Candida albicans SC5314
  CDS (1)..(891): transl_table=12
atgacagatcacctaattgctaaagtacaagaacatgtacctaacattccattgaaaataatatcacaaggtgcagaagcactagtttttgaaacatcagttcacccgtactacaactacaattcgagtgaaaaacaccatgagtcaccttctttgcacaatcatacaacatttataataaaatatcgtcccacgaaaccctatcgtcaccctaaaatagatttgcaaattaataaatcacgaactattggcgaagttaagtttatgtataaactctcaaaattaaacattgcctgtcctaatatcattctgacagattttaataacggtatcatatggatggaatgtcttggatcaaaattgcccaatggcacaataagttcatttaagaattggttatggtatttagaaagtcaagagaaagaggatcccagtataaacctccatgacgatgaccaagtcgaattggtttgtcaaaaagttggacaattgataggtcgattacatttaaacgatatgattcatggcgatttaacttcatcaaacataattttaacagaggtggatactaagaaaaatgaagatacagatgccaataatagttcagtttattttgaaccggcgttgattgattttggtttatcttcattttcaggattagcagaagataaggctgttgatctatatgttttggagagagcaattctaagtacccattcaaactatgccgataaacttaatggctggctattagaaggataccaacaaatccatgattctattgaattcaataaaaccaaacaacaattaggtaaactgaaattaaaagatacgattaaaagactagaagatgtccgtttaagaggaagaaaaagaagtatgttgggttga

SEQ ID NO: 58465 - protein, 296 aa, Candida albicans SC5314
MTDHLIAKVQEHVPNIPLKIISQGAEALVFETSVHPYYNYNSSEKHHESPSLHNHTTFIIKYRPTKPYRHPKIDLQINKSRTIGEVKFMYKLSKLNIACPNIISTDFNNGIIWMECLGSKLPNGTISSFKNWLWYLESQEKEDPSINLHDDDQVELVCQKVGQLIGRLHLNDMIHGDLTSSNIILTEVDTKKNEDTDANNSSVYFEPALIDFGLSSFSGLAEDKAVDLYVLERAILSTHSNYADKLNGWLLEGYQQIHDSIEFNKTKQQLGKSKLKDTIKRLEDVRLRGRKRSMLG

SEQ ID NO: 58466 - DNA, 648 bp, Plasmodium chabaudi
  CDS (1)..(648)
atgaaaatatataaatgtgatttcattggaaaggaagcaattaaaaaagtaatttacagaaaacattatagacacaaaaagattgattcaaaaatacgaaaattaagagtatcaaatgaaatcaaatttactaaaaaactagccagtttaaatattgatgtcccatatttatattttgttgatacaaaagaaaaaagcatatattttgaatatgtcaatggctgtacaataaataatatattaaaaagtatcaaacaatatcaaccaaatattcctaaattcattggtatcacattagcaaaaatacataatggaaatgtaatacatggagattttaccacatcaaatttaattttaagacattcatatattaatgaaaatgaaatttttaataatttaaataatgccccttatgaattggctgatatcacggagataaaactttgtgttatcgattttggtctatcctttttatcagcttcggttgaggataaggctgtggatttgtttgttctcttgaaagccatcaaaagtttccatagtgaatttcctaaattggaagaagacattttattggggtatgaaacccaatcgaataattttgatttaatcagcaaaaaactagaaacaggttcgcttataaattaa

SEQ ID NO: 58467 - protein, 215 aa, Plasmodium chabaudi
MKIYKCDFIGKEAIKKVIYRKHYRHKKIDSKIRKLRVSNEIKFTKKLASLNIDVPYLYFVDTKEKSIYFEYVNGCTINNILKSIKQYQPNIPKFIGITLAKIHNGNVIHGDFTTSNLILRHSYINENEIFNNLNNAPYELADITEIKLCVIDFGLSFLSASVEDKAVDLFVLLKAIKSFHSEFPKLEEDILLGYETQSNNFDLISKKLETGSLIN

SEQ ID NO: 58468 - DNA, 834 bp, Aspergillus fumigatus Af293
  CDS (1)..(834)
atggcttcaacggacccatacacaccgcctcccctcccttctcccttcacgaacacaacccctccaccgcaattgctcacccaaggcgccgaagcgcacctctacaagaccgtcttcctctcaccctccgccccagctgctctgaaggtccgcccgtcaaagccctaccggcacccgattctcgaccgacggctcacgcgccagcgcatactgcaggaagctcggtgcctggtaaaactcgtccgggaaggcgtcaatgtccccgcggtgctggcgctggattgggagggccaatctggcgaaaaggggttcggcggggcctggttgatgatggagtggattgagggaatggtggtgcgcgtcgtactggagcggtgggagaaatacatgaagcggaaccaggcgggcctgggcgcggaggaatttgaaaaggaagaagcgcgggtccgagatttgatgaagagaattgggcacgcagttggagcgctgcacaaagccggcgttatccacggggatctgacaacgagcaatcttatcctgcgaccgcctactcgtgcggagcagcaacccgccgctgacgagacaaatccgtctatggagggggatgttgttctgatcgattttggcttggccagtcagagtctgcaagacgaagaccgcgccgtcgatctatacgtgcttgagagggcgtttggtagcacccatcctcgtactgagccgctcttcacagaggtcctcagcgggtataaggaaagctacaagggcgcaagctctgcattgaaacgattagaggaagtacggatgagaggccgtaagagaagtatgattggatga

SEQ ID NO: 58469 - protein, 277 aa, Aspergillus fumigatus Af293
MASTDPYTPPPLPSPFTNTTPPPQLLTQGAEAHLYKTVFLSPSAPAALKVRPSKPYRHPILDRRLTRQRILQEARCLVKLVREGVNVPAVLALDWEGQSGEKGFGGAWLMMEWIEGMVVRVVLERWEKYMKRNQAGLGAEEFEKEEARVRDLMKRIGHAVGALHKAGVIHGDLTTSNLILRPPTRAEQQPAADETNPSMEGDVVLIDFGLASQSLQDEDRAVDLYVLERAFGSTHPRTEPLFTEVLSGYKESYKGASSALKRLEEVRMRGRKRSMIG

SEQ ID NO: 58470 - DNA, 1476 bp, Ustilago maydis 521
  CDS (1)..(1476)
atgtctggaatcgatcatcgagcaggcagcggctcgttgtcgagctcaccatcggcacgtacaccgcggctggctttcccagtagcccgctctaggcctacatctattgttgactcagtcgaagcgaccagcgaagctatcctctctacttcgcccgcctcttctaccacctcggcgggcgcttcgccgcgcaagcacacgcaatcagccgcagatcgactcgcatctgcacaggcaaaggatgctgctgctgcggccaaatcgcatcgagcacgcaccacgtccagcacatcacgttctagcaccgagggaggtcgagctaagctcccatcactgctgcaggccaccactagctccagatcggcagcaacgccggtgaccagcacctatctcgacatctcttcgagtgcaccaggagaagaaagtgcgtcaaaaccaagcaacgcctcgaagcacgccactgatacgcatgtagtcgctctcgacggtcaatcaatgtcgaaacgtgcttcgcgtgatccgccttccatcatcagtgccaaagtagctggttcgagcatgcccaagaaggtgtccgcggcgcctaaatcaactccgaacgcacctccactggtggcgctgctctccgactcgaacctgtctgtgctcatcaaacagggcgctgaggccaaagtctacatctcgcgcatcgctaccaacaacattctcacatggccccgaccacgctcttccaagctagaatcgagcaaggtggagcctcctgctcctgtgctgctcaagtggcgctttccaaaaacgtaccgacatccgacgctgtcgagcaacattaccgcatcgcgcaccatcatggaggctagggcactgctgcgttgcgccaaggccggtgtagcagtgcctgccgttcgatgtgtggatgagaaggaaggtatcttaggtctcgagctcatcccgggcaaaagtgtccgagagtggctcggtggcggtgccgaaggcgacgatgaggctttggtggatgaggctgatacagcgagaactcaagaggaggaggtgctttccgagattgatcaagccaaattgatgaggttgataggtaaacagttggccattatgcacgaagccgacatcattcacggtgaccttacgacgtcgaatatgatgctgcgcccggcagcgccttgctcgtccacgtcgggctcagcaacggtcgatctggatcatgacgaggtggttctcattgatttcggtctgtcttcggtctcgacattcgccgaagacaaggcagtagacctgtacgtgctcgagagggcatttgcttcgacccaccctgcatccgaagcgctctaccgcaccatcctcgatagctatgcggaagaggttaccgctcgatccgctggcaagggccgagggaagggttccaaactgaacaaatgggaagagacgcgacgcaagctcgaagaaggtaagatgaaatattga

SEQ ID NO: 58471 - protein, 491 aa, Ustilago maydis 521
MSGIDHRAGSGSLSSSPSARTPRLAFPVARSRPTSIVDSVEATSEAILSTSPASSTTSAGASPRKHTQSAADRLASAQAKDAAAAAKSHRARTTSSTSRSSTEGGRAKLPSLLQATTSSRSAATPVTSTYLDISSSAPGEESASKPSNASKHATDTHVVALDGQSMSKRASRDPPSIISAKVAGSSMPKKVSAAPKSTPNAPPLVALLSDSNLSVLIKQGAEAKVYISRIATNNILTWPRPRSSKLESSKVEPPAPVLLKWRFPKTYRHPTLSSNITASRTIMEARALLRCAKAGVAVPAVRCVDEKEGILGLELIPGKSVREWLGGGAEGDDEALVDEADTARTQEEEVLSEIDQAKLMRLIGKQLAIMHEADIIHGDLTTSNMMLRPAAPCSSTSGSATVDLDHDEVVLIDFGLSSVSTFAEDKAVDLYVLERAFASTHPASEALYRTILDSYAEEVTARSAGKGRGKGSKLNKWEETRRKLEEGKMKY

SEQ ID NO: 58472 - DNA, 723 bp, Strongylocentrotus purpuratus
  CDS (1)..(723)
atggcatcggctgtgacttgcgaccaagcgacgctggaaggcgatacctctcagtcgaagctcactctcttgaaacagggagcagaagcccgtatttacctgagcactttcatgggtcgtagctccatcgtgaagcagagattcaagaagtcttacagacatcctaagctggacgctaagctttcacagaagcgcaccggacaagaagtcaggacaatcgtcaaatgcaggaaggctgggatcactacacctgtggtatactttgtcgacaatgacactcattccatccacatggaatacatagaagactccctcacagtccgagagtacattcaacagattcagaactccggggaatccaacgatgatgaaaggttggtgtcactcgcctcaaaggttggaacgaccctagcatccatgcacaatgtggacatcattcatggggatttgacgacctcaaacatgcttctgcgtcaaccttacgaggactcgcgcctgataatgatcgatttcggactcagtcagatatcgcatatgtcggaggataaaggggttgatctctatgtcttggagagggcgtttctaagctcacacccgaacacggaagagttgtttaagacagttcttgatgtgtatgcggagaactacaaaaagtctggagaagtgttgaagaagctggaggaagtaagacaacgagggagaaagagggtgatgttaggctag

SEQ ID NO: 58473 - protein, 240 aa, Strongylocentrotus purpuratus
MASAVTCDQATLEGDTSQSKLTLLKQGAEARIYLSTFMGRSSIVKQRFKKSYRHPKLDAKLSQKRTGQEVRTIVKCRKAGITTPVVYFVDNDTHSIHMEYIEDSLTVREYIQQIQNSGESNDDERLVSLASKVGTTLASMHNVDIIHGDLTTSNMLLRQPYEDSRLIMIDFGLSQISHMSEDKGVDLYVLERAFLSSHPNTEELFKTVLDVYAENYKKSGEVLKKLEEVRQRGRKRVMLG

SEQ ID NO: 58474 - DNA, 432 bp, Strongylocentrotus purpuratus
  CDS (1)..(432)
atggaatacatacaggactccctcacagtccgagagtacattcaacagattcagaactctggggcatccaacgatgatgaaaggttggtgtcactcgcctcaaaggtcggaacgaccctagcatccatgcacagtgttgacatcatccatggggatttgacgacctcaaacatgcttctgcgccaaccctacgaggactcgcgcctgataatgatcgatttcggactcagtcagatatcgcatatgtcggaggataaaggggttgatctctatgtcttggagagggcttttctaagctcacacccgaacacggaagacttgtttaagactgttcttgatgtatatgcggagaattacaagaagtctggagaagtgttgaagaagctggaggaagtaagacaacgagggagaaagagggtgatgttaggctag

SEQ ID NO: 58475 - protein, 143 aa, Strongylocentrotus purpuratus
MEYIQDSLTVREYIQQIQNSGASNDDERLVSLASKVGTTLASMHSVDIIHGDLTTSNMLLRQPYEDSRLIMIDFGLSQISHMSEDKGVDLYVLERAFLSSHPNTEDLFKTVLDVYAENYKKSGEVLKKLEEVRQRGRKRVMLG

SEQ ID NO: 58476 - DNA, 774 bp, Trypanosoma cruzi
  CDS (1)..(774)
atggggaaaaacgagactgacacggatgttctgacaagtaacgttgaagttggatccgtcttgtcgcaatgcgcggagtcacgagtgcatgagtgtaacttttacggttatcgcgccgtctgcaagcaccgttttcccaaagcgtaccgtcatcctgctttagatcaacgcctccgggagcagcggactgtccgggagggtcgagcacttgcacgctgcctcaaaaacggagtcttggccccaaccgtttttgctgttgaccgtgaacggtgcgcaattgtcatggagcgcattgacggtctcaccgtacgcgagatattcaatcacgagcaaggaaatgttgcacaagggaagacggacgtgtcttttcttgtctcgttcctcttaaggggaatgggggaggtggttggcctcctgcataacgcagacatcattcacggcgatctcacaacatcgaatttcatgtgcaaacgaaattttttggagcgacgactgtctacggaaaatttggcgtcaaacacctcttctcgcgatagcattgttgttttagattttggacttgtgatggacaagaatagtgcggaggagcgtgccgtcgacctgtacgttcttgagcgtgcgctgaagtcctcgcatccatttctggagcacgtggccactagactggtcctggagggctaccaccgcaccgtggatccgcagaagggttccgtcaccatggcgcgtctggaagcagtgcgggcacgtggccgtaaacggagcatgattggctag

SEQ ID NO: 58477 - protein, 257 aa, Trypanosoma cruzi
MGKNETDTDVLTSNVEVGSVLSQCAESRVHECNFYGYRAVCKHRFPKAYRHPALDQRLREQRTVREGRALARCLKNGVLAPTVFAVDRERCAIVMERIDGLTVREIFNHEQGNVAQGKTDVSFLVSFLLRGMGEVVGLLHNADIIHGDLTTSNFMCKRNFLERRLSTENLASNTSSRDSIVVLDFGLVMDKNSAEERAVDLYVLERALKSSHPFLEHVATRLVLEGYHRTVDPQKGSVTMARLEAVRARGRKRSMIG

SEQ ID NO: 58478 - DNA, 741 bp, Trypanosoma brucei
  CDS (1)..(741)
atgaatacgcacgcggccgctgttacggttgggtcggtgctgtttcaatgcgccgagtcacgtgtgtatgaatgcgatttctacagtcaccctgccgtatgcaaatatcggcttccaaagccttacaggcaccctacattggataaaaggcttcgtgagcagcgctctgtgcgtgaggcaagggcattggtgagatgtcaaaagcaagggatcgcggtgccagcggtgtatgccatcgaccgtgagagttgcgccatcgtaatggaacgaattattgggatgagtgtacgggacgtgcttaatgaggcgcagcggccgttggagggcgcagtgtcaccggtggccgcccgcctgttggaagggatgggtgaagtggtggggcttctgcacaatgctcatataatccacggggatcttacaacctcaaacttcatgtaccgaacagcaactgtggcggaggggaaggctgatagtgcagcatgtggagccgctccacgtgatcgtctcgtcgtgttggactttggtttagtgatggacaaaaatagtgcggaagagcgtgcagtcgacttgtatgttcttgagcgggccattaaatcgtcgcacccgtcgctcgaaggcgtggcttcagcgtttatcttaaacggctaccgtcgtactgcagatccacatcaagtggaagcgactatcacacgtcttggggctgtgcgggcgcgtggtcgcaagcgtagtatggtgggatag

SEQ ID NO: 58479 - protein, 246 aa, Trypanosoma brucei
MNTHAAAVTVGSVLFQCAESRVYECDFYSHPAVCKYRLPKPYRHPTLDKRLREQRSVREARALVRCQKQGIAVPAVYAIDRESCAIVMERIIGMSVRDVLNEAQRPLEGAVSPVAARLLEGMGEVVGLLHNAHIIHGDLTTSNFMYRTATVAEGKADSAACGAAPRDRLVVLDFGLVMDKNSAEERAVDLYVLERAIKSSHPSLEGVASAFILNGYRRTADPHQVEATITRLGAVRARGRKRSMVG

SEQ ID NO: 58480 - DNA, 909 bp, Canis familiaris
  CDS (1)..(909)
atgtgggaggcggggccactgccacaggcggaagcgtcggcctcggagtggccgaagaggcccgaagactcacggggcgagccgaacatcgccggcagtttccggagagaggcgacgggctccgagaggcggcgccgaggcgcagtcatggcggcccccgacgccgctgccggcgccgagagcgaggagccgccgcgggaggccgaggcgctggccgcggcccgggagcggaacggccgcttcttgagcggcctggaactggtgaagcagggcgccgaggcgcgcgtgttccgcggccgcttccagggccgcgcggcggtggtgaagcaccgcttccccaagggctaccggcacccggcgctggaggcgcggctcggccggcggcggacggtgcaggaggcccgggcgctgctccgctgccgccgcgcagggatatctgctccagttgtcttttttgtagactatgcatccaactgcttatacatggaagaaatcgaaggctcagtgactgttcgagattatattcagtctaccatggagactgaaaaaactcctcaaagtctcctcagcctagccaagacagttgggcaggttttggctcgaatgcacgatgaagacctcattcatggtgatctcaccacctcgaacatgctcctgaaaccccccgtggaacagctgaacattgtgctcatagactttgggctgagtttcatttcagcacttccagaagataagggagttgacctctacgtgctagagaaagccttcctcagtacccaccccaaaactgagactgtgtttgaagccttcctgaaaagctactccaccttctccaaaaagtccaggccagtgttaaaaaaattagatgaagttcgcctaagaggaagaaagaggtccatggttgggtag

SEQ ID NO: 58481 - protein, 302 aa, Canis familiaris
MWEAGPLPQAEASASEWPKRPEDSRGEPNIAGSFRREATGSERRRRGAVMAAPDAAAGAESEEPPREAEALAAARERNGRFLSGLELVKQGAEARVFRGRFQGRAAVVKHRFPKGYRHPALEARLGRRRTVQEARALLRCRRAGISAPVVFFVDYASNCLYMEEIEGSVTVRDYIQSTMETEKTPQSLLSLAKTVGQVLARMHDEDLIHGDLTTSNMLLKPPVEQLNIVLIDFGLSFISALPEDKGVDLYVLEKAFLSTHPKTETVFEAFLKSYSTFSKKSRPVLKKLDEVRLRGRKRSMVG

SEQ ID NO: 58482 - DNA, 666 bp, Thermococcus kodakarensis KOD1
  CDS (1)..(666): transl_table=11
gtgaagctaatagcccagggggccgaggcgaagatatacgaggcggactttgaggaggtctttggtgttcctctgctcaaagagagggtcatcgtaaagcacaggattccaaagaggtacaggatcaaggagatagacgtgaagctgaggaaggagagaaccgtaagggaagcgagaattctccacagggcaaaggagttcggcgtcaactgtccccacgtttatgaggttgacctgagggacatgaagctcgtgatggagtacatagagggacagaggctcaaggagctccttgagagcgtcccgatggaagagaggcttgagctgtgccgcgaggtcgggagacagattggaaagctacacaaggctgggatagtccacggggatttaacgacctcgaacatgatattcagggacggcaaggtctacctgatagactttggcttggccgacttcgactcgacgcttgaagcaaggggcgttgacctgcacctcctcaggagggcgatggagagcacccactacacctggttcgagaggggcttcgaggccgtccttgaaggctatgctgaagttctcggcgaagaagcgaggaaagaagtcgaggagaagatgagggagatagagagcaggggcaggtacagggagaggagctggcttagttag

SEQ ID NO: 58483 - protein, 221 aa, Thermococcus kodakarensis KOD1
MKLIAQGAEAKIYEADFEEVFGVPLLKERVIVKHRIPKRYRIKEIDVKLRKERTVREARILHRAKEFGVNCPHVYEVDLRDMKLVMEYIEGQRLKELLESVPMEERLELCREVGRQIGKLHKAGIVHGDLTTSNMIFRDGKVYLIDFGLADFDSTLEARGVDLHLLRRAMESTHYTWFERGFEAVLEGYAEVLGEEARKEVEEKMREIESRGRYRERSWLS

SEQ ID NO: 58484 - DNA, 660 bp, Sulfolobus acidocaldarius DSM 639
  CDS (1)..(660): transl_table=11
atggagatagtcagagagataaaaagaggagcggaagctataatatacgaggggtattttgcaggcatacatgctgtgtttaaaaaaaggataaaaaagagttatagaaacgatattgttgatagagccattaatgagagcagaaccaaattggaagctagaatgatatactcagctctaaaatctggggtaaatgtaccagcaatacttttggttgatcctatacaattcctgatagtaatggaatatatagagggtactacactaagggatatatttaaccaaggaagaaacttaagggagttaggaaaagaaatgggcttaatgatatcccttcttcataaggctaatataatccacggagatctaactacgacaaatatgatatacacagatgaaggattatttctaattgatttcggacttgctaagaaaagtaatgatattgaggattttgcaacagatattcatgttttattgagatccctagaaagtattcacagtcattttaaagacgaaatatttgaaggattcaaggaaggatactctaccatgatggactcagacaaagttatagaaaaaatgaaggagattagaatgaggggaagatacgttgaagaaagaagaaaaaagagagataatactagtcacgtccaatga

SEQ ID NO: 58485 - protein, 219 aa, Sulfolobus acidocaldarius DSM 639
MEIVREIKRGAEAIIYEGYFAGIHAVFKKRIKKSYRNDIVDRAINESRTKLEARMIYSALKSGVNVPAILLVDPIQFLIVMEYIEGTTLRDIFNQGRNLRELGKEMGLMISLLHKANIIHGDLTTTNMIYTDEGLFLIDFGLAKKSNDIEDFATDIHVLLRSLESIHSHFKDEIFEGFKEGYSTMMDSDKVIEKMKEIRMRGRYVEERRKKRDNTSHVQ

SEQ ID NO: 58486 - DNA, 1638 bp, Methanosarcina barkeri str. fusaro
  CDS (1)..(1638): transl_table=11
ttgaaaaacacgttcatccttggaatcgagggcactgcctggaacctgagtgccgcaatcgtgaccgaaaccgagattattgccgaggtcacagagacctacaaacccacggccggtgggattcaccccagggaagcagcccagcatcatgcaaagtacgcagccagcgttataaaaaggcttcttgcagaggcaaaagagaagggagtcaagccttcagatattgacgggatagctttttcccagggacctgggcttgggccgtgcctgaggacggttgcaacggcagccagaatgctttccatatcccttggcattccacttataggtgtcaaccactgcattgctcatattgagattgggatctggagaactcctgcaatggaccctgtcgttctttacgtaagtggggccaattctcaggttatttcctatatgggagggcggtatagagtctttggggaaaccctggatatagggcttggaaatgcccttgataaatttgcgcgaggggctaacctaccgcatcccggagggccaaagattgaggcatacgcaaaaaacgcaacgaaatatatccatcttccttatgtgataaaaggcatggacctttccttttccggactttccacggcagccagtgaagccttgaaaaaagctcctcttgaagatgtctgctattcttaccaggaaacagcttttgcaatggttgttgaggttgcagagcgagcacttgctcacaccggaaaaaaagaagtcttgctggcaggaggagttggggcgaacacaaggctccgggaaatgttaaatgatatgtgcgaggccagaggcgcgaagttctatgtgcccgaaaaacgctttatgggagataacgggacaatgatcgcatatactgggcttctaatgtataagtccggaaacactctttcccttgaagattctcgcgtaaatcccagttaccggactgatgatgtgaaagtgacctggatccaggaagaaaagatgaaaagagttcctgaaatttcccccggaacttccctcaagcttggggaactgctggacaatggagccgaggctattgtttacctggaagaagggcctgaagggaagaaaatacttgttaaggaaagagtcccgaaggcttacaggtataaagagattgatgagaggatcaggactgaaagaaaccggacagaagcccgcttgatgtctgaatctcgacgccatggggtttctacgccgattatctatgatgtggaagatttcaagcttaagatgcagtatattgatggtgtccccataaaatacctggttactcctgagctttcagaaaaagtaggagaacttgtaggaaaactacacagtgcgggtatagtacatggggaccttacgacctcaaatatcctgcttgcaggcgagagactttatctccttgacttcgggcttgcttattacgacaaaggacttgaggccagaggggtagacgtccatgtacttttccagacttttgagagtacccaccgcaatcatgaggcccttatcgaagctttcaaaaaagggtaccggagaacttttatagattcagaggatgtactcacgcgtgttgaagagataaaaaagagggctcgttatgcataa

SEQ ID NO: 58487 - protein, 545 aa, Methanosarcina barkeri str. fusaro
MKNTFILGIEGTAWNLSAAIVTETEIIAEVTETYKPTAGGIHPREAAQHHAKYAASVIKRLLAEAKEKGVKPSDIDGIAFSQGPGLGPCLRTVATAARMLSISLGIPLIGVNHCIAHIEIGIWRTPAMDPVVLYVSGANSQVISYMGGRYRVFGETLDIGLGNALDKFARGANLPHPGGPKIEAYAKNATKYIHLPYVIKGMDLSFSGLSTAASEALKKAPLEDVCYSYQETAFAMVVEVAERALAHTGKKEVLLAGGVGANTRLREMLNDMCEARGAKFYVPEKRFMGDNGTMIAYTGLLMYKSGNTLSLEDSRVNPSYRTDDVKVTWIQEEKMKRVPEISPGTSLKLGELLDNGAEAIVYLEEGPEGKKILVKERVPKAYRYKEIDERIRTERNRTEARLMSESRRHGVSTPIIYDVEDFKLKMQYIDGVPIKYLVTPELSEKVGELVGKLHSAGIVHGDLTTSNILLAGERLYLLDFGLAYYDKGLEARGVDVHVLFQTFESTHRNHEALIEAFKKGYRRTFIDSEDVLTRVEEIKKRARYA

SEQ ID NO: 58488 - DNA, 1596 bp, Ferroplasma acidarmanus Fer1
  CDS (1)..(1596): transl_table=11
atgaaagtcctgcggcttgagggcacagctcatacaataagtgccggtatcgtagacgataatagaatcatttcaaatttctcatcaacttacataccaaaaaatggtggcatacatccaagggaagcagcaatccaccacgccgataacatattgcctgttatgaagaaagcatttgaagaaagtggcctatcacctggccagataaacctggtggctttttccatgggccccggcctagggccgtgtttgagggttgtagctacagctgccagggcattttcaattaaatacgggattccattaataggtgttaaccacccgctcgggcatgtggaaataggaaggaaactttccggggcaaaggatcctataatgttatatatttccggggggaatacacagattatagcacatgaagaaaattcctataaagttcttggggagaccatggatattgggctgggaaatctgctggacaaactggcaagggatgtaggcataccatttccaggaggaccaaaaatagaggaatttgctttaaaaggtgataaattgctggatttgccatactctgtaaagggaatggatacatcattttcaggaatttatacagcagccaggaattatataggaagggaatccatagaaaatatatgctatagcgtccaggaaacaaccttttccatgctggtagaggttttagaacgggcattatattatacagataaaagggagattttacttgcaggaggggtagccagaaacgatcggctccgttcaatggtttcacatatggcaaagtcatctggatatgttgcctatcttacagataaaaaatactgtatggataatggtgccatgatcgcacaggcaggcatgttaatgtatctttctgggcagaggcagcatataatggatacaaaggtaaatcaaagtttcaggatcgatgaagtcaaggttccctggattaactcaaaaaagcctgttataagcaataacaggggggcagaagcattgatttcagaatcgcagttttatggtaggaaaactattacaaaacagcgcgtagaaaaagaatacagaaatcaggaactggatcgcaaaataagaacagaaagaatgaaaaatgagtttaaccttatattcaggctaaaaagcaatggaataaattctcctattctgtatgattttgataagtataatttcacattagttatgcaaaaacttgatggtataacactcaataaactaatcaggtctggggataactatatggcggttataaataaacttggccagataataggagaaatgcataacctattaatctcacatggcgatctgaaccccaacaatatcatggttgttgggccagatatatatctaatagaccccagcatgggaaaatttaattgtgaaatagaagatatggcagatgacattttcctcctcacagaatcatttaaaaatctgtattcaaactatgatgtgcttgaaaatcattttataagttcttataaggaaaaatccaccaattatgtagaaattataaaaacgctggatgaaataaagcaaagaaggagatatgtttga

SEQ ID NO: 58489 - protein, 531 aa, Ferroplasma acidarmanus Fer1
MKVLRLEGTAHTISAGIVDDNRIISNFSSTYIPKNGGIHPREAAIHHADNILPVMKKAFEESGLSPGQINLVAFSMGPGLGPCLRVVATAARAFSIKYGIPLIGVNHPLGHVEIGRKLSGAKDPIMLYISGGNTQIIAHEENSYKVLGETMDIGLGNLLDKLARDVGIPFPGGPKIEEFALKGDKLLDLPYSVKGMDTSFSGIYTAARNYIGRESIENICYSVQETTFSMLVEVLERALYYTDKREILLAGGVARNDRLRSMVSHMAKSSGYVAYLTDKKYCMDNGAMIAQAGMLMYLSGQRQHIMDTKVNQSFRIDEVKVPWINSKKPVISNNRGAEALISESQFYGRKTITKQRVEKEYRNQELDRKIRTERMKNEFNLIFRLKSNGINSPILYDFDKYNFTLVMQKLDGITLNKLIRSGDNYMAVINKLGQIIGEMHNLLISHGDLNPNNIMVVGPDIYLIDPSMGKFNCEIEDMADDIFLLTESFKNLYSNYDVLENHFISSYKEKSTNYVEIIKTLDEIKQRRRYV

SEQ ID NO: 58490 - DNA, 879 bp, Leishmania major
  CDS (1)..(879)
atgtcatcgagcaacgcacaggcagagctagggcccggcgggagcacgcactccatcgagttgggccgccttatctttcaaggtgcggagtcgaaggtgtattgctgcagcttctacggcgcactggctttatgcaagcatcgttttgtgaagcggtaccgcgacccaagcctcgatgagcgtctgcgtacgcaacgtacgcgtcgcgaggcacgcgccttggaacgttgcgtgaagaagggcatccgtgcaccgcgtctgttaggtgcggactacatcaacacttttcttgtcatgtcctatgaggctggcccaaccgtgaaggaggcgctcgacatcgagcacgccgcctatatgcagcaagtgtcgaagggtaaaagtacgtctgcgcagcagcagcaaccgcagaccacaccgtcgccctcggcgttgggcaacgctgcaccgtcgccggtgactgctgcccttctgcagagtattggtgtcgtggtggcgcggttgcacaacgcgaacatcgtccacggcgacctcacaacctccaactttatttgcacgtgcgacgggctcgaggcggcggcacccggtgcagatggcgcagatgccctcgcgtcgagttcgccggtgctgccaacagcggaggacattgttgttctcgactttgggctcatctccgagaagtacagcacagaggagcgcgcggtggacctctatgtgctggagcgcgccatcgcttcgacccacccgtatctctcctcttttgccagcgacattattcttgaaggctatcgcagcgccgctgacccgaagaagggagaggaggcgctgcggcgactggaggcggtgcgcgcgcgtgggcgcaagcgcaccatgatcggctag

SEQ ID NO: 58491 - protein, 292 aa, Leishmania major
MSSSNAQAELGPGGSTHSIELGRLIFQGAESKVYCCSFYGALALCKHRFVKRYRDPSLDERLRTQRTRREARALERCVKKGIRAPRLLGADYINTFLVMSYEAGPTVKEALDIEHAAYMQQVSKGKSTSAQQQQPQTTPSPSALGNAAPSPVTAALLQSIGVVVARLHNANIVHGDLTTSNFICTCDGLEAAAPGADGADALASSSPVLPTAEDIVVLDFGLISEKYSTEERAVDLYVLERAIASTHPYLSSFASDIILEGYRSAADPKKGEEALRRLEAVRARGRKRTMIG

SEQ ID NO: 58492 - DNA, 627 bp, Theileria annulata
  CDS (1)..(627)
atgtacaaggatactgaccatataatagctcagggagcagaagctgtttgtttattcgttgtcaagaaggttcagtttttgggcaaggaatgtgtattgaagagacgactgcctaagttattccgacacactgatcttgatcagagtttaactcgaagccgtatggtcgctgagtgtcggagtacatacaaattaagaaaagaaggagtttacgtacccgtgatatatcttgtagatttcttaaaaagagaaactatttatgaatacgttcaaggggatactgtaaacttttccatttctaactcaacctttaattcttaccatctcattggtgaaaatattgctttgatgcataacgccaacattatacacggagatttaaccaccaagaatatgattatgacaaacgatggactactttgtatcatagattttggcttgagctttttttctacaatatcggaggacaaagctgttgatttatacgtcttggaacgatgcttgaccccctcagagtttgagaaggttttaaactcatacaagtcagttgtttttgagtctgacgagataatacgtaaactcgaggaagttaggcttcgaggtcgtaaaagggacctcacaggataa

SEQ ID NO: 58493 - protein, 208 aa, Theileria annulata
MYKDTDHIIAQGAEAVCLFVVKKVQFLGKECVLKRRLPKLFRHTDLDQSLTRSRMVAECRSTYKLRKEGVYVPVIYLVDFLKRETIYEYVQGDTVNFSISNSTFNSYHLIGENIALMHNANIIHGDLTTKNMIMTNDGLLCIIDFGLSFFSTISEDKAVDLYVLERCLTPSEFEKVLNSYKSVVFESDEIIRKLEEVRLRGRKRDLTG

SEQ ID NO: 58494 - DNA, 714 bp, Xenopus laevis
  CDS (1)..(714)
atggaaggcgatgcagaaagcaagagcaggctgcggactcgctcgtatctggagggcttgtcgctgatgaagcagggtgccgaggccagagtttaccgggggcggtttctagggaaaaatgcggtgataaaggagaggttccccaaggcctacagacacccgactctggatgggaaactcacccataaacgcacggcccaggaggtccgctctatattaaggtgtaggagagcaggtatttcagcaccagtggtttatttcgttgactatgtttccaactgtatttaccttgaagacattgaggaatcgactactgtgagagactacatattatcgatgcagcagagtgggaaggagacaagtagcctgaatgctttggcagagaagattgggcaggtgttgggccgaatgcacgatgaggacgttgtccatggagacctcaccacgtccaacatgctcctgcgccccccgtgtgatgatctcaacctggttctgattgattttggcctcagtttcatctctgctcttccagaagataaaggggtggatctgtacgtgctggagaaggctttcctcagcacccaccccaacacagaggagaccttcaggctcctgttacaaagctactcctctacctccaaaaaatccggccccgtaataaagaaactggatgaggtgcgcctgcgcggacggaaacgctcaatggtgggatag

SEQ ID NO: 58495 - protein, 237 aa, Xenopus laevis
MEGDAESKSRLRTRSYLEGLSLMKQGAEARVYRGRFLGKNAVIKERFPKAYRHPTLDGKLTHKRTAQEVRSILRCRRAGISAPVVYFVDYVSNCIYLEDIEESTTVRDYILSMQQSGKETSSLNALAEKIGQVLGRMHDEDVVHGDLTTSNMLLRPPCDDLNLVLIDFGLSFISALPEDKGVDLYVLEKAFLSTHPNTEETFRLLLQSYSSTSKKSGPVIKKLDEVRLRGRKRSMVG

SEQ ID NO: 58496 - DNA, 1671 bp, Caenorhabditis briggsae
  CDS (1)..(1671)
atgggaaaaagcaaaaatcgcgttgtaaaaccgaaacgacgggacaagcctccaaggcagaaagatgtagaagaagaaaaggaagaagaagaagtagaagattcagaagacgctgacgacgaatccacatcagaaccaggatcagacgaagatgccacgtcatctgaagaagaagaatacgatttccccttccgtctagctatgtacgatttcaatcagtgtgatcccaaacgatgctccggaaggaaactcctgcgtgccgatttgattacagaagtgaaactgggtcaaagatttcctggattagtgttaagtcccactggaaagtacacgctggcaccgagggaccgtccgtttgtcgaacaacatggactgtgtgtagtagattgttcatggaaggaggtggagagaacaccgttgcataaagtaaaagccccggaacaccgtctcctgccttatttggtcgctgctaattcagtaaactatggaaaaccgtgccacttgacatgcgcagaagccatggccgctggtttatacattttgggattccgagaagcggctcatcgtcttatgaagcctttcacttggggggagcactttattgagctgaacaaggagttgttggagctgtatgcggcttgtaacacgccggaagaagtgatcaaggcgcagaatgagtatttggagaggattgataaggagcgggaggagcactcgagggatattgatctaccgccgagtagtagtgaggaagaggaaaccgaggaggaagctgaatttttgtttgttcttgttcttgttattcatctcgttgattctcttataaactctgtttttttttgttctttaaattcaaaaatttcagattttaagcgtttttccgctattgaatatatatttttaccatcttttgttcaattcgctagctactggctttttagatccttaaaaatgccagaaatcgaggaagaaatggatttcgagacgacaacggaggagggatttggatacgagctgaacgatattctgtatcaaggcgccgaggcaaaagtcacgaaatgtgtctggttgggacgagaggcggttatcaaagagagattctccaaagggtatcgacacccgacactcgacactcgcctcaacaaagcccgaacgaaacaggagattcgcggaatgtggaaagctcgacagctcggtgtcctggtgcccactgtctacttcatcgacgcggaaaagaaccaactgattctggagtatattaaaggaccgacagcgaaatattggatttcccaactctccagcgatgaatacgacgaaaaaatgcgcgaattcggcgcagttttgggagcgaatctggcgaaattacatctaggaggactggttcatggagatctaacgacgtcgaatatgattcttaaaaacggagaattgagtcgcttgacgttcattgattttggattatcgtcacagggaaaggtaactccagaagaaaaaggcgtggatttatacgtcttggagagagcagtcgtgagcacacatgagaatagcaaggcgctgttggaagggctcatggaaggatacaaaaaggtcaacgagaagcagttcactgccgtcgaaaagaagctggaagagatccgacttcgtggccgaaaacgggagatgatcggataa

SEQ ID NO: 58497 - protein, 556 aa, Caenorhabditis briggsae
MGKSKNRVVKPKRRDKPPRQKDVEEEKEEEEVEDSEDADDESTSEPGSDEDATSSEEEEYDFPFRLAMYDFNQCDPKRCSGRKLLRADLITEVKLGQRFPGLVLSPTGKYTLAPRDRPFVEQHGLCVVDCSWKEVERTPLHKVKAPEHRLLPYLVAANSVNYGKPCHLTCAEAMAAGLYILGFREAAHRLMKPFTWGEHFIELNKELLELYAACNTPEEVIKAQNEYLERIDKEREEHSRDIDLPPSSSEEEETEEEAEFLFVLVLVIHLVDSLINSVFFCSLNSKISDFKRFSAIEYIFLPSFVQFASYWLFRSLKMPEIEEEMDFETTTEEGFGYELNDILYQGAEAKVTKCVWLGREAVIKERFSKGYRHPTLDTRLNKARTKQEIRGMWKARQLGVLVPTVYFIDAEKNQLILEYIKGPTAKYWISQLSSDEYDEKMREFGAVLGANLAKLHLGGLVHGDLTTSNMILKNGELSRLTFIDFGLSSQGKVTPEEKGVDLYVLERAVVSTHENSKALLEGLMEGYKKVNEKQFTAVEKKLEEIRLRGRKREMIG

SEQ ID NO: 58498 - DNA, 762 bp, Homo sapiens
  CDS (1)..(762)
atggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccacttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtag

SEQ ID NO: 58499 - protein, 253 aa, Homo sapiens [sequence omitted]

SEQ ID NO: 58500 - DNA, 762 bp, Homo sapiens
  CDS (1)..(762)
atggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtag

SEQ ID NO: 58501 - protein, 253 aa, Homo sapiens
MAAARATTPADGEEPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 58502 - DNA, 735 bp, Mus musculus
  CDS (1)..(735)
atggctggcacgtcctcggaggcggaggccgaggcgctggccgctgcgcgcgagcggagccgcctcttcctgagcggcctagagctggtgcagcagggcgccgaggcgcgcgtcttccgtggccgcttccagggccgcgcggccgtggtgaagcaccgcttcccgaagagctaccggcacccggagctggaggcgcggctcggccggcggcggacagtgcaggaggcgcgcgcgctgctccgctgccgccgtgcggggatagctgccccagtcgtcttctttgtggactatgcgtctaactgcttatatatggaagaaatcgaagactcggtgactgttcgggattatatccaatccactatggagactgaaaaggacccccagtgcctcttggacctggccaggaggatggggcaggttctggccggaatgcacgaccaagacctcattcacggggacctcaccacctccaacatgctcctgaggcggcccctggcgcagctgcacatcgtgctcatcgactttgggctgagctttgtctcaggactgccggaagataaaggcgtcgacctctatgtcctggagaaggccttcctcagcacgcacccccacaccgagaccgcgtttgaagcctttctgaagagttacggggcctcgtccaagaagtccagtccagtgctgaagaagttagatgaggtgcgcctgagagggcgaaagcggtccatggtcgggtag

SEQ ID NO: 58503 - protein, 244 aa, Mus musculus
MAGTSSEAEAEALAAARERSRLFLSGLELVQQGAEARVFRGRFQGRAAVVKHRFPKSYRHPELEARLGRRRTVQEARALLRCRRAGIAAPVVFFVDYASNCLYMEEIEDSVTVRDYIQSTMETEKDPQCLLDLARRMGQVLAGMHDQDLIHGDLTTSNMLLRRPLAQLHIVLIDFGLSFVSGLPEDKGVDLYVLEKAFLSTHPHTETAFEAFLKSYGASSKKSSPVLKKLDEVRLRGRKRSMVG

SEQ ID NO: 58504 - DNA, 26 bp, Artificial sequence
  (1)..(26): primer
atgacgcaagaattcattgataaagt

SEQ ID NO: 58505 - DNA, 25 bp, Artificial sequence
  (1)..(25): primer
ttatcctagcatacttctcttacga

SEQ ID NO: 58506 - protein, 375 aa, Artificial sequence
  Variant (2)..(3): xaa in position 2 to 3 is any amino acid
  Variant (8)..(8): xaa in position 8 is any amino acid
  Variant (11)..(15): xaa in position 11 to 15 is any amino acid
  Variant (16)..(103): xaa in position 16 to 103 is any or no amino acid
  Variant (105)..(105): xaa in position 105 is any amino acid
  Variant (107)..(107): xaa in position 107 is any amino acid
  Variant (109)..(110): xaa in position 109 to 110 is any amino acid
  Variant (112)..(112): xaa in position 112 is any amino acid
  Variant (115)..(117): xaa in position 115 to 117 is any amino acid
  Variant (120)..(121): xaa in position 120 to 121 is any amino acid
  Variant (123)..(125): xaa in position 123 to 125 is any amino acid
  Variant (127)..(129): xaa in position 127 to 129 is any amino acid
  Variant (131)..(131): xaa in position 131 is any amino acid
  Variant (133)..(133): xaa in position 133 is any amino acid
  Variant (135)..(135): xaa in position 135 is any amino acid
  Variant (137)..(141): xaa in position 137 to 141 is any amino acid
  Variant (142)..(143): xaa in position 142 to 143 is any or no amino acid
  Variant (145)..(146): xaa in position 145 to 146 is any amino acid
  Variant (148)..(148): xaa in position 148 is any amino acid
  Variant (150)..(152): xaa in position 150 to 152 is any amino acid
  Variant (154)..(156): xaa in position 154 to 156 is any amino acid
  Variant (157)..(167): xaa in position 157 to 167 is any or no amino acid
  Variant (169)..(169): xaa in position 169 is any amino acid
  Variant (172)..(172): xaa in position 172 is any amino acid
  Variant (174)..(181): xaa in position 174 to 181 is any amino acid
  Variant (182)..(182): xaa in position 182 is any or no amino acid
  Variant (184)..(186): xaa in position 184 to 186 is any amino acid
  Variant (187)..(227): xaa in position 187 to 227 is any or no amino acid
  Variant (229)..(231): xaa in position 229 to 231 is any amino acid
  Variant (234)..(235): xaa in position 234 to 235 is any amino acid
  Variant (238)..(238): xaa in position 238 is any amino acid
  Variant (241)..(243): xaa in position 241 to 243 is any amino acid
  Variant (257)..(259): xaa in position 257 to 259 is any amino acid
  Variant (260)..(286): xaa in position 260 to 286 is any or no amino acid
  Variant (288)..(288): xaa in position 288 is any amino acid
  Variant (295)..(301): xaa in position 295 to 301 is any amino acid
  Variant (302)..(306): xaa in position 302 to 306 is any or no amino acid
  Variant (317)..(317): xaa in position 317 is any amino acid
  Variant (320)..(321): xaa in position 320 to 321 is any amino acid
  Variant (323)..(323): xaa in position 323 is any amino acid
  Variant (325)..(328): xaa in position 325 to 328 is any amino acid
  Variant (329)..(334): xaa in position 329 to 334 is any or no amino acid
  Variant (336)..(345): xaa in position 336 to 345 is any amino acid
  Variant (346)..(362): xaa in position 346 to 362 is any or no amino acid
  Variant (365)..(365): xaa in position 365 is any amino acid
  Variant (368)..(369): xaa in position 368 to 369 is any amino acid
  Variant (372)..(372): xaa in position 372 is any amino acid
IXXGAEAXVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXKXRXXKXYRXXXLDXXLXXXRXXXEXRXLXRXXXXXXXIXXPXVXXXDXXXXXXXXXXXXXXLXMEXIXXXXXXXXXIXXXXXXXXXXXXXXXXXXXXXXXXXXXXXXXXXXXXXXXXXXXXLXXXIGXXIGXLHXXXIIHGDLTTSNMLLXXXXXXXXXXXXXXXXXXXXXXXXXXXXXXLXLIDFGLXXXXXXXXXXXXEDKAVDLYVLXRAXXSXHXXXXXXXXXXLXXXXXXXXXXXXXXXXXXXXXXXXXXXVLXKLXXVRXRGR

SEQ ID NO: 58507 - protein, 40 aa, Artificial sequence
  Variant (2)..(3): xaa in position 2 to 3 is any or no amino acid
  Variant (5)..(5): xaa in position 5 is any amino acid
  Variant (8)..(10): xaa in position 8 to 10 is any amino acid
  Variant (11)..(11): xaa in position 11 is Ile, Leu or Val
  Variant (12)..(12): xaa in position 12 is Asp, Glu or Asn
  Variant (13)..(14): xaa in position 13 to 14 is any amino acid
  Variant (15)..(15): xaa in position 15 is Ile, Leu or Met
  Variant (16)..(18): xaa in position 16 to 18 is any amino acid
  Variant (20)..(22): xaa in position 20 to 22 is any amino acid
  Variant (24)..(33): xaa in position 24 to 33 is any amino acid
  Variant (34)..(34): xaa in position 34 is Asp, Gly or Asn
  Variant (35)..(35): xaa in position 35 is Ile, Leu or Val
  Variant (36)..(36): xaa in position 36 is any amino acid
  Variant (37)..(37): xaa in position 37 is Ala, Cys, Ser, Thr or Val
  Variant (39)..(39): xaa in position 39 is any amino acid
  Variant (40)..(40): xaa in position 40 is Ile, Leu or Val
RXXKXYRXXXXXXXXXXXRXXXEXXXXXXXXXXXXXXPXX

SEQ ID NO: 58508 - protein, 21 aa, Artificial sequence
  Variant (2)..(3): xaa in position 2 to 3 is any amino acid
  Variant (4)..(4): xaa in position 4 is Ile, Leu or Val
  Variant (5)..(5): xaa in position 5 is Ala, Gly or Ser
  Variant (6)..(6): xaa in position 6 is any amino acid
  Variant (7)..(7): xaa in position 7 is Ile, Leu or Met
  Variant (9)..(13): xaa in position 9 to 13 is any amino acid
  Variant (19)..(20): xaa in position 19 to 20 is Ser or Thr
GXXXXXXHXXXXXHGDLTXXN

SEQ ID NO: 58509 - protein, 5 aa, Artificial sequence
  (1)..(5): protein
IDFGL

SEQ ID NO: 58510 - protein, 18 aa, Artificial sequence
  Variant (2)..(2): xaa in position 2 is Ala, Asp, Glu or Asn
  Variant (3)..(3): xaa in position 3 is any amino acid
  Variant (4)..(4): xaa in position 4 is Ala or Gly
  Variant (8)..(8): xaa in position 8 is any amino acid
  Variant (9)..(9): xaa in position 9 is Leu or Val
  Variant (10)..(10): xaa in position 10 is Phe, Leu or Met
  Variant (11)..(11): xaa in position 11 is any amino acid
  Variant (12)..(12): xaa in position 12 is Glu, Lys or Arg
  Variant (13)..(13): xaa in position 13 is Ala, Cys, Ser or Thr
  Variant (14)..(14): xaa in position 14 is Phe, Ile, Leu, Met or Val
  Variant (15)..(17): xaa in position 15 to 17 is any amino acid
  Variant (18)..(18): xaa in position 18 is Glu or His
EXXXVDLXXXXXXXXXXX

SEQ ID NO: 58511 - DNA, 2391 bp, Saccharomyces cerevisiae
  CDS (1)..(2391)
atggtttgctgcttatgggtgcttctagcattgttgcttcatctcgatcatgtagcatgcgaagacgatgcgtactcattcacttctaaagaacttaaggcttacaagcaggaagtgaaggagctgttttatttcggcttcgacaattatttagagcatgggtatccatatgatgaggtaaaacccatttcatgcgttcctaagaagagaaactttgaagatcctactgatcaaggcaccaacgatatattgggcaattttacaatcactttaatagattctttaaccactattgctatactggaagaccggccgcagtttttgaaagctgttcgacttgttgaaaggacatttcctgatggcaatttcgatattgattccacaatacaagtttttgaaattactatacgtgttatcggatcactactatcatcacatctttatgctacggatcccacaaaggcagtgtatttaggggacgattatgatggctcactgttacgtctcgcccagaatatggcagataggctcttacctgcatatttaacgtctaccggattacctatgccacggagaaacatcaaacgaaaatgggatgtctctgaatttccagaatttttggagacagagaataatgtggccgctatggcgtctcccatgttcgaattcactattttatcttacttgacaggcgatcccaagtatgagaaagttaccagatacgcatttgataaaacatggtctcttagaactggtttggatttgctacccatgtcctttcaccccgaaaaactaacaccatatacgcccatgactggaatcggcgcctccatcgactcccttttcgaatacgctttgaaaggtgctattttatttgatgattcagaattaatggaagtttggaacgtagcatacgaggcattaaagactaactgtaaaaacgattggttttttgctaatgtaatggctgacacagggcatttgtttgttccctggattgattctttgagtgcttttttctccggtttacaggtgcttgctggtgatttggatgatgccatagcgaaccatttaatgtttttaaaaatgtggaacacctttggcggtattcctgaaaggtggaactttagtcctccggagtttcccccactatctccattagagcgatcgggagctgttgctttggataatatcctccccttagaatggtacccattaagaccggaattttttgagtcaacctatttcttatatagagctacaaaagacccgttttacttaaatattggggtacatctgctaaaagacctcaagcaacgatttaagtctaactgcggatttgcaggtttccaaaatgtaatcacgggcgaactgcaagatagaatggaaacatttgtgttgagtgaaactttgaaatacctgtatttattatttgatgaagagaacgaattacataacagcgctagtgacgtaattttcagtacagaagcccatccaatgtggttgccccaagaagtgaggtccaactataaacgtaacgctaaatttaacaactctgtctactcgtcgcacttggaaatttgccagaaaaaggacagggaacaagctggagagaacacattgagccaaagaattgtggggttcgccaaatcgatctttcataaaggtccaccagacgaagaggctactgatccaattatagactataccattgatactgaacttcccggtacatgctctataaagcctcatcatgtaattggtgacgaattttggtattctccaatgttgagcaattttgacagattattcgagattgactcccggttcgctgccacgctaattaaaccttcacacatgcataactataatgcaattgaactagaacctggattttataacaggtggtccaatccgcaatttagcacgtgcctgatcccacccaccaccgaaattttcgaactactattcgaccttcctggatatcatcagttgaatccattaatgttagaaaacaaaactattacatttgaaacctttggaggtaggtcaaggttgaagatcgaaaaattgcaaatctaccaaattgattactatggagacttaatcactgcatcgacattccaagacgtctcccgcaaggatattttctcgaatgcatgcgatgcagtggcaagcttgtattctcccacttatctttacagagtagtagccatcaacggacgcatattgcctcgccatggaagtgtacaaatcaagaaacatagtcctgtgctcacttccaatggcacaagagaggaagacgaattcaaaatggatggcatcgggattaatgaccattcccaactcatgttagaatgcacgcccatcatcaacttatttattgtatga

SEQ ID NO: 58512 - protein, 796 aa, Saccharomyces cerevisiae
MVCCLWVLLALLLHLDHVACEDDAYSFTSKELKAYKQEVKELFYFGFDNYLEHGYPYDEVKPISCVPKKRNFEDPTDQGTNDILGNFTITLIDSLTTIAILEDRPQFLKAVRLVERTFPDGNFDIDSTIQVFEITIRVIGSLLSSHLYATDPTKAVYLGDDYDGSLLRLAQNMADRLLPAYLTSTGLPMPRRNIKRKWDVSEFPEFLETENNVAAMASPMFEFTILSYLTGDPKYEKVTRYAFDKTWSLRTGLDLLPMSFHPEKLTPYTPMTGIGASIDSLFEYALKGAILFDDSELMEVWNVAYEALKTNCKNDWFFANVMADTGHLFVPWIDSLSAFFSGLQVLAGDLDDAIANHLMFLKMWNTFGGIPERWNFSPPEFPPLSPLERSGAVALDNILPLEWYPLRPEFFESTYFLYRATKDPFYLNIGVHLLKDLKQRFKSNCGFAGFQNVITGELQDRMETFVLSETLKYLYLLFDEENELHNSASDVIFSTEAHPMWLPQEVRSNYKRNAKFNNSVYSSHLEICQKKDREQAGENTLSQRIVGFAKSIFHKGPPDEEATDPIIDYTIDTELPGTCSIKPHHVIGDEFWYSPMLSNFDRLFEIDSRFAATLIKPSHMHNYNAIELEPGFYNRWSNPQFSTCLIPPTTEIFELLFDLPGYHQLNPLMLENKTITFETFGGRSRLKIEKLQIYQIDYYGDLITASTFQDVSRKDIFSNACDAVASLYSPTYLYRVVAINGRILPRHGSVQIKKHSPVLTSNGTREEDEFKMDGIGINDHSQLMLECTPIINLFIV

SEQ ID NO: 58513 - DNA, 1731 bp, Rattus norvegicus
  CDS (1)..(1731)
atgcctttccggctgcttatcccgctcggcctcgtgtgcgtgctgctgcccctgcaccatggtgcgccaggccccgaaggcaccgcgcccgaccccgcccactacagggagcgagtcaaggccatgttctaccacgcctacgacagttacctggaaaatgcctttccctacgatgagctgagacctctcacctgtgacgggcacgacacctggggcagtttttctctgacactgattgatgccctggacaccttgctgattttggggaatacctctgaattccaaagagtggtggaggttctccaggacaacgtggactttgatatcgacgtcaatgcctctgtgttcgaaaccaacatccgagtggtaggaggactcctttctgctcacctcttgtcaaagaaggctggtgtggaggtggaagctggatggccttgttctggacctctcctcaggatggcggaggaagcagcccgaaaactcctcccagcgtttcagacccccacgggcatgccctatggaactgtgaacctgcttcatggcgtgaaccctggagagactcctgttacctgtacagcagggattgggaccttcattgtggaatttgctaccctgagcagcctcaccggtgaccctgtgtttgaagatgtggccagagtggccctgatgcgcctctgggagagccggtcagatattgggctggtcggcaatcacatcgatgtgctcactggcaaatgggtggctcaggacgcaggcatcggggctggtgtggattcctattttgagtacctggtaaaaggagccatcctccttcaggataagaagctcatggccatgtttctagagtacaacaaagccatccggaattacacgcacttcgatgactggtacctctgggtgcagatgtacaaggggaccgtgtccatgcctgtcttccagtccttggaggcctactggcctggtcttcagagccttattggggatattgacaatgccatgagaaccttcctcaactactacactgtatggaagcagtttggggggctgccagaattctacaacattcctcagggatacacagtggagaagcgagaaggctacccactccgaccggagctcatcgagagcgcaatgtacctctaccgtgccacaggggatcccactctcttagaactggggagagatgctgtggagtccattgagaaaatcagcaaggtggagtgcgggttcgccacgatcaaggacctccgggatcacaaacttgacaaccgcatggagtctttcttcctggccgagactgtgaaatacctctaccttctgtttcacccaaacaacttcatccacaacaatggctccacttttgactctgtgatgaccccccatggggagtgcatcctgggagctgggggctacatcttcaacacggaagctcaccccatcgaccctgccgccttgcactgttgccggaggctgaaggaagagcagtgggaagtggaggacttgataaaggagttctactctctcagacagagcaggtcaagagctcagagaaagacagtgagttcggggccctgggagcccccagcagggccaggcacactctcctcacctgaaaaccagcccagggagaagcagcctgccaggcagagagccccgctcctcagctgccccagccagcccttcacttctaaactggccctgctaggccaggttttcctagactcctcataa

SEQ ID NO: 58514 - protein, 576 aa, Rattus norvegicus
MPFRLLIPLGLVCVLLPLHHGAPGPEGTAPDPAHYRERVKAMFYHAYDSYLENAFPYDELRPLTCDGHDTWGSFSLTLIDALDTLLILGNTSEFQRVVEVLQDNVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTHFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFHPNNFIHNNGSTFDSVMTPHGECILGAGGYIFNTEAHPIDPAALHCCRRLKEEQWEVEDLIKEFYSLRQSRSRAQRKTVSSGPWEPPAGPGTLSSPENQPREKQPARQRAPLLSCPSQPFTSKLALLGQVFLDSS

SEQ ID NO: 58515 - DNA, 1668 bp, Xenopus tropicalis
  CDS (1)..(1668)
atggttacgatattgtacccactttatctgggtatccttggtgccctgctgccaggctatcatgccagggaccgggggctcacggaggaggaaatggcccaatacagggatcgggtgaaatccatgttttatcacgcgtacaacaactacttggaccatgccttcccctacgatgaactgcgccccctcacctgtgatggacaagatacctggggaagtttctccctgactctaattgatgcgttagacaccttactgattattggaaacgtcaccgagttccagagagtagtaaatgtcctgcaggatactttggattttgacattgatgtcaatgcttcagtcttcgagaccaacatccgagttgtgggtggtctcttgtctgctcaccttttctccaaaagagccggcctggaactggaaccggggtggccttgcactggccccctacttcgcatggcagaagaggctgctcgcaaactccttccagcgtttgacacagccacagggatgccttacgggacagtcaacctgctgagaggtgttaaccctacagagacccccgtgacatgcacagccggcgtcggaacatttattgtggagtttgccactctgagtcgccttacaggagacccacagtttgagatggtggcaagaagagccctcagaggattgtgggagagcaggtctgatattgggctggtaggaaaccatgtagacgtcatgacctccaagtgggtagctcaggatgctggaatcggggccggcgttgattcctactttgaatatctggtgaaaggggcgatcctgctgcaggacgaggaattaatgtctatgtttcttgaatacaacaaggccctccagaacttcaccaaatacgacgactggtatgtgtgggttcagatgtataagggcacggtcactatgcccgttttccaatcactggaagccttttggccaggattacagagtttagtgggagatatcagaagtggaatgagatcattcctcaattactacacagtatggaggcagtttggtgggttaccggaattttacagcattcctcagggatttaccgtggagaaaagagagggctaccccctccggccggagctgattgagagcgcaatgtatctgtacaaggcgaccagagatccaattctgttagagctgggaagagatgccgtggagtccattgaaaggataagcaaagtggactgtggatttgcaacgatcaaagacgttcgagatcacaagctggataaccgcatggagtctttcttcctggccgaaaccatcaagtacctctatttgctgtttgacccagacaactttatccacaatgatggctccacctctgatctggtggtgactccatacggggagtgcgtcatgggggcaggcggctacgtcttcaacaccgaggcccaccctatagaccctgctgcgctgcactgctgtaagagggactctgctgagcagtgggaagtggaagacctggtgagggagtttttctccatcaagagcagcagtaatcctaaggcacaacaacataggccagactctcagaacagaaacaaaagcaaaagaacctctaagctcagctgcccaagccagccattcacttcgaaactttccatccttgggcaggtttttcttgattga

SEQ ID NO: 58516 - protein, 555 aa, Xenopus tropicalis
MVTILYPLYLGILGALLPGYHARDRGLTEEEMAQYRDRVKSMFYHAYNNYLDHAFPYDELRPLTCDGQDTWGSFSLTLIDALDTLLIIGNVTEFQRVVNVLQDTLDFDIDVNASVFETNIRVVGGLLSAHLFSKRAGLELEPGWPCTGPLLRMAEEAARKLLPAFDTATGMPYGTVNLLRGVNPTETPVTCTAGVGTFIVEFATLSRLTGDPQFEMVARRALRGLWESRSDIGLVGNHVDVMTSKWVAQDAGIGAGVDSYFEYLVKGAILLQDEELMSMFLEYNKALQNFTKYDDWYVWVQMYKGTVTMPVFQSLEAFWPGLQSLVGDIRSGMRSFLNYYTVWRQFGGLPEFYSIPQGFTVEKREGYPLRPELIESAMYLYKATRDPILLELGRDAVESIERISKVDCGFATIKDVRDHKLDNRMESFFLAETIKYLYLLFDPDNFIHNDGSTSDLVVTPYGECVMGAGGYVFNTEAHPIDPAALHCCKRDSAEQWEVEDLVREFFSIKSSSNPKAQQHRPDSQNRNKSKRTSKLSCPSQPFTSKLSILGQVFLD

SEQ ID NO: 58517 - DNA, 1851 bp, Gallus gallus
  CDS (1)..(1851)
atgcaatggcgctcgctggtgctggggctgctgctgctgaggctggggctgcacgcgctgctggcgctgctccccgcgctggcgcccggcctctgcctgcgcctccgcctcccgttccccttcccgccgcgttccgccgccctcggccctcccggcgccgcgcggccgctgcccggcgggggctcctcgcattggggttcgctgcggggcggcggcggcgcggcggggcgcgatgagtacgagacgcgctacagcgccgcgttccccccgcagctgcgggcccggctgcgcgacgccgcccgcggtatgttcgccttcggctacgacagctacatgcagcacgccttccccagcgacgagctcgaccccctgcactgctgcggccgcgggcccgaccgcgacgacccttcgaatctgaacatcaacgatgtcttagggaactactcgctgacgctgatagatgcactggataccctagcggtgatgggaaattcttccgagttccagaaggcggtgaagctggtgattgacacagtttcatttgacaaagactcaacagtccaagtttttgaggcaaccatcagggttttgggaagcctgctttctgcccacataataattacagatgccaaacagccttttggtgatatgaccattaaggattatgacaacgaactgctgcacatggctcatgacctagcagtgagactgctcccagcatttgagaacaccaaaactggaattccgtatcctcgggtcaacctgaagaagggagttcctccaaacagcaataatgaaacttgcactgcaggagccggttccttgttggtagagtttggtattctgagcaggctgctcggcgattccacatttgaatgggtggccaggagagcagtcaaagcactctggagtctcaggagtaacaacactggactgctaggaaatgttgtgaatattcaaactggccattgggttggaaagcagagtggcttgggggcaggatcagattcgttttatgaatacctcctgaagtcctacatcctctttggagagaaggaagacttagagatgttcatcgatgcttatcagaacattcagaaccacttacgaaggggtcgagaagcttgcaatgaaggtgaaggtgacccgcctttgtatgttaatgtaaacatgttcactggacagctgatgaacacatggattgactccttgcaagccttttttcctggactgcaggtgttgataggagacgtagaagatgctatttgcctccatgctttttattatgccatatggaaacgatatggagccctcccagaaaggtacaactggcaattgcaagcaccggatgttcccttttatccactgaggccggagttagtggaatccacatatcttctttaccaggccacaaagaacccattttaccttcatgtgggaatggatattctacagagtttggaaaaatacacaaaagcgaagtgtggctatgctacattacaccatgtggtggagaagacaaaagaagatcgaatggagagcttttttctcagtgaaacatgtaaatatttgtacctgttgtttgatgaagacaatccagtgcataagtctggaaataaatatatgtttactactgagggacatattgtgtctgtggatgaacgttttcggaactcgctgtggcaagatatcctccctggggaggagggcacagaaaaagttaagcctaacgaattaaaggccgtcaacttcagttctaattgtaacagagttccggatgagaggagatacttgctgccgttgaagagcaactacatgagacagatcgatcggatggtgggcttgatctga

SEQ ID NO: 58518 - protein, 616 aa, Gallus gallus
MQWRSLVLGLLLLRLGLHALLALLPALAPGLCLRLRLPFPFPPRSAALGPPGAARPLPGGGSSHWGSLRGGGGAAGRDEYETRYSAAFPPQLRARLRDAARGMFAFGYDSYMQHAFPSDELDPLHCCGRGPDRDDPSNLNINDVLGNYSLTLIDALDTLAVMGNSSEFQKAVKLVIDTVSFDKDSTVQVFEATIRVLGSLLSAHIIITDAKQPFGDMTIKDYDNELLHMAHDLAVRLLPAFENTKTGIPYPRVNLKKGVPPNSNNETCTAGAGSLLVEFGILSRLLGDSTFEWVARRAVKALWSLRSNNTGLLGNVVNIQTGHWVGKQSGLGAGSDSFYEYLLKSYILFGEKEDLEMFIDAYQNIQNHLRRGREACNEGEGDPPLYVNVNMFTGQLMNTWIDSLQAFFPGLQVLIGDVEDAICLHAFYYAIWKRYGALPERYNWQLQAPDVPFYPLRPELVESTYLLYQATKNPFYLHVGMDILQSLEKYTKAKCGYATLHHVVEKTKEDRMESFFLSETCKYLYLLFDEDNPVHKSGNKYMFTTEGHIVSVDERFRNSLWQDILPGEEGTEKVKPNELKAVNFSSNCNRVPDERRYLLPLKSNYMRQIDRMVGLI

SEQ ID NO: 58519 - DNA, 1977 bp, Mus musculus
  CDS (1)..(1977)
atgtacccaccgccggcgccgccgccggcgcctcaccgggacttcatctcggtgacgctgagcctgggcgagagctacgacaacagcaagagccggcggcggcgctcatgctggaggaaatggaagcagctttcgaggctacagcggaatgtgattctcttcgtcttgggctttctgattctctgtggattcctgtactctcttcatacggctgaccagtggaaagctctgagtggcagacctgcagaagtagagaagatgaagcaagaagtcctgcctgtcttaccagcgcctcagaaggaaagtgctgaacaagaagggtttgcagacatactctctcagaagcggcaaaggcattttcggcggggccctccccatctgcagattagaccccccaacacagtctccaaggatgggatgcaggatgatgctaaggagagagaagcagccctggggaaggctcagcaggaagaaaacacacagagaaccgtcatcagctggcggggagccgtgattgagcctgaacaggccactgaacttccttacaaaagagctgaagcctccatcaaacctctggttttggcatccaagatatggaaagagccagcccccccgaatgagcgccagaagggagtgattgaggcctttctccatgcttggaagggttaccaaaagtttgcttggggccatgatgaactaaaacctgtgtccaaaaccttcagtgagtggtttggcctgggcctcaccctgatcgatgccttggataccatgtggattttgggtctgaagcaagaatttaagcaagccaggaaatgggtatcagagaacttagactttcagaagaatgttgatgtcaacctgtttgagagcaccattcgcatcttagggggcctgctgagtacctaccacctgtcgggggacagcctcttcctgaccaaagctgaagattttggaaaacggctgatgcctgccttcactacgccctccaagatcccatactctgatgtgaacattggcactggatttgcccactcaccccagtggacttcagacagcacggtggcagaagtgacgagcattcagttggagttccgggagctctctcgtcttactggaataaagaaattccaggaggccgtggaggaagtgacaaagcacatccactccctgtctgggaagaaagacgggctggtgcctatgttcatcaacacgaacagcggcctcttcacccacccaggagtgttcaccttgggggccagggctgacagctactacgaatacctgctgaaacagtggatccagggtggcaagaaggagacacagttgctggaagactatgttaaagccattgaggggataaaagcccatctgctccggcagtctcagcccagaaagctcaccttcgtgggagaacttgcccacggccgcttcagtgccaagatggaccacttagtgtgcttcctgccggggacgctggctttgggtgtccaccatggcctgccagctgaccacatggatctagctcgggccctcatggagacctgctaccagatgaaccaacagatggagacaggtctgagccctgagattgcacatttcaacatgtaccctcgggcagatcataaagatgtggaggtcaagccagctgacaggcacaacctgctgcggccagagacggtggaaagcctattctatctgtaccgtgtcacaagggaccgcaagtaccaggactggggctgggaaatcctgcagagcttcaataagtacacacgggtcccctcaggtggctattcttctatcaacaacgtccagaattcccacaagcctgagcccagggacaagatggagagcttctttgtgggggaaaccctgaagtacttgtacctgctcttttctgatgacctggagctgctcagtctggacagctgtgtgttcaacacagaagcccatcccctccccatctgggctcctgcgtag

SEQ ID NO: 58520 - protein, 658 aa, Mus musculus
MYPPPAPPPAPHRDFISVTLSLGESYDNSKSRRRRSCWRKWKQLSRLQRNVILFVLGFLILCGFLYSLHTADQWKALSGRPAEVEKMKQEVLPVLPAPQKESAEQEGFADILSQKRQRHFRRGPPHLQIRPPNTVSKDGMQDDAKEREAALGKAQQEENTQRTVISWRGAVIEPEQATELPYKRAEASIKPLVLASKIWKEPAPPNERQKGVIEAFLHAWKGYQKFAWGHDELKPVSKTFSEWFGLGLTLIDALDTMWILGLKQEFKQARKWVSENLDFQKNVDVNLFESTIRILGGLLSTYHLSGDSLFLTKAEDFGKRLMPAFTTPSKIPYSDVNIGTGFAHSPQWTSDSTVAEVTSIQLEFRELSRLTGIKKFQEAVEEVTKHIHSLSGKKDGLVPMFINTNSGLFTHPGVFTLGARADSYYEYLLKQWIQGGKKETQLLEDYVKAIEGIKAHLLRQSQPRKLTFVGELAHGRFSAKMDHLVCFLPGTLALGVHHGLPADHMDLARALMETCYQMNQQMETGLSPEIAHFNMYPRADHKDVEVKPADRHNLLRPETVESLFYLYRVTRDRKYQDWGWEILQSFNKYTRVPSGGYSSINNVQNSHKPEPRDKMESFFVGETLKYLYLLFSDDLELLSLDSCVFNTEAHPLPIWAPA

SEQ ID NO: 58521 - DNA, 1737 bp, Homo sapiens
  CDS (1)..(1737)
atgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttctctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacacggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggtgcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataa

SEQ ID NO: 58522 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDTVITPYGECILGAGGYIFNTEAHPIDPAALHCCQRLKEEQWEVEDLMREFYSLKRCRSKFQKNTVSSGPWEPPARPGTLFSPENHDQARERKPAKQKVPLLSCPSQPFTSKLALLGQVFLDSS

SEQ ID NO: 58523 - DNA, 1683 bp, Arabidopsis thaliana
  CDS (1)..(1683)
atggcgagaagtagatcgattagtggttatgggatatggaaatatttgaatcctgcgtattatcttagaagaccgagacgtttggctttgcttttcattgtcttcgtctctgtttctatgcttgtctgggatcgtattaatcttgcccgagaacatgaggttgaagtttttaagctaaatgaagaagtttcacggttggagcagatgttagaagagcttaatggtggtgttggcaataagcctttgaagactctgaaggatgccccagaagatccagttgataaacagcgaaggcagaaagtaaaagaggcaatgatccatgcttggagctcttatgaaaagtatgcatgggggaaagatgagcttcagcctcggacaaaagatggcactgatagctttggtggccttggagcaactatggtagattctttagatacactctatataatgggtctagatgagcagtttcaaaaagccagagagtgggttgcaagctcattggatttcgacaaggattatgacgccagtatgtttgagacaaccataagagttgtaggcggacttcttagtgcgtatgatctttctggggacaaaatgttccttgaaaaggctaaggatattgcagacagattattgcctgcatggaatactccaacgggtataccttacaatattatcaacttgagaaatggaaatgctcacaatccttcatgggcggcagggggagacagtattctcgcagactccggcactgagcagctcgagtttattgccctttcccaaaggacaggggacccaaaatatcagcagaaggtagagaaggttattacagaactgaataagaactttcctgctgatggtttacttcccatctatataaatccggataatgctaatccatcgtactctaccacaacatttggtgccatgggagatagcttttatgagtatttgctcaaagtttgggtgcaagggaacaaaacatctgccgtgaaaccctatagagatatgtgggagaaatcaatgaaaggtttgttaagcttggtcaagaaatcaacaccttcatcatttacgtatatatgtgagaagaacggaaataatttgattgataagatggatgaattggcgtgctttgctcctggaatgttggctttaggagcttcaggttatggccctgatgaagaaaaaaagtttctttcacttgctggagagcttgcctggacttgttataacttttaccaatcgacaccaacgaaacttgctggagagaactatttcttcactgcagggcaggacatgagtgttggcacatcttggaacattttaagaccagaaaccgttgaatcactgttttacctctggcgattaactgggaacaagacatatcaagagtggggatggaatatatttcaagcatttgagaagaactctcgcgtagaatctggatatgtaggcttgaaggatgtcaatacaggtgctaaagacaacaagatgcaaagcttcttcttagctgagactcttaagtatctatatcttctcttttcgccttcatctgttatttcattagacgagtgggttttcaacacagaagcccatccgcttaagattgtggcacggaatgatccgcgtaagccaactatagcactacgccagaggaagtttggtcatcagattaacgtttag

SEQ ID NO: 58524 - protein, 560 aa, Arabidopsis thaliana
MARSRSISGYGIWKYLNPAYYLRRPRRLALLFIVFVSVSMLVWDRINLAREHEVEVFKLNEEVSRLEQMLEELNGGVGNKPLKTLKDAPEDPVDKQRRQKVKEAMIHAWSSYEKYAWGKDELQPRTKDGTDSFGGLGATMVDSLDTLYIMGLDEQFQKAREWVASSLDFDKDYDASMFETTIRVVGGLLSAYDLSGDKMFLEKAKDIADRLLPAWNTPTGIPYNIINLRNGNAHNPSWAAGGDSILADSGTEQLEFIALSQRTGDPKYQQKVEKVITELNKNFPADGLLPIYINPDNANPSYSTTTFGAMGDSFYEYLLKVWVQGNKTSAVKPYRDMWEKSMKGLLSLVKKSTPSSFTYICEKNGNNLIDKMDELACFAPGMLALGASGYGPDEEKKFLSLAGELAWTCYNFYQSTPTKLAGENYFFTAGQDMSVGTSWNILRPETVESLFYLWRLTGNKTYQEWGWNIFQAFEKNSRVESGYVGLKDVNTGAKDNKMQSFFLAETLKYLYLLFSPSSVISLDEWVFNTEAHPLKIVARNDPRKPTIALRQRKFGHQINV

SEQ ID NO: 58525 - DNA, 1875 bp, Arabidopsis thaliana
  CDS (1)..(1875)
atggactcaaatttcaagtggcttttgtttgccatcttgatctctctgacattttcgggttttgttcttcaccatggagttctcgctgaaagtgttaagcctgatgaagctaaacagcttagagacgaggtacgtgggatgttttatcatgcctttgatggatatatgaacaatgcgtttccactcgatgaattgagaccgttatcttgccaaggagaagatactcttggaggctatgcgttgactctgattgactcgttggatacattagctttacttggtgaccgagagcgcttcacttcttctgttgaatggattggtaaaaatcttcagtttaatataaataaaacagtctctgtgtttgagacaactatccgagtccttggggggttactatctgctcatctgattgcaagtgattatgcaacgggcatgagaattccatcttacaacaatgaattactagttttggctgagaatttggcacggagaatgcttcctgcatttgatacaccgactggaatcccatttggatctgtgaatttgatgtacggtgttgacaaacatgaaagcaagataacatcaactgccggtggtggtactttgtctttagagtttggcgtgcttagtcgtttaacaaatgatcctgttttcgaacaagttgcaaagaatgcggtgaggggactatgggcacgtcgttcaaatctcgacttggttggtgctcacatcaatgtctttacaggtgaatggacacagaaggatgctggtataggaacaagcattgattccttctatgagtatctactcaaggcttatatactatttggggatgaggaatatctatacatttttcaagaagcttatagatctgcaatgcagtaccttcacaaggatccttggtatgtagaagtcaatatggattccgcagctattgtctggccagtatttaacagccttcaagctttctggccaggacttcaggttttagctggagacgttgatccagcaataagaactcacactgccttctttagcgtctggaaacgatatggtttcacccctgagggttttaatcttgctacacttagtgtccagtatgggcaaaagagttatcccttaaggccggaattaatcgagagtacatactggttgtacaaagctaccagagatcccaggtatcttgatgcaggacgtgactttgtggctagtttgcaatacggggcaaaatgtccttgcggttattgtcacatcacagatgtagaactgcataaacaagaagatcacatggagagcttcttcctcgcagaaacggtgaagtacttatggctactctttgacttagctgttgactcggataacctcgtagacaatggcccttacaagtacatcttcagtactgagggtcatctcttaccaataacaccacaaatatctctagctcgggaacattgctcttactttggtggatactgtccaagcaattccacaaaactagaacaagaagtccttggagaagacagtagtaacgatgatcacagtaacgattatccttaccacgaatcttttccagttaccggtttgataaagggtttatgtccaggactaacacatgctcagaaatatggtttttcgtatgttctaccggagaagacagatcgtgaagatgttaatcaacctaaaccggtagttacaagcagttcaattgtgttaatctcggatcaaacagtggagaagagaccacaggaagaagaaggatttacttctcagtctgaaccaataatgacaatctctggtggtagtagcaacgaccaaacaggtcaagagctaaccttgttagagtcagaaactgatgatcaaagatcatactcttcttaa

SEQ ID NO: 58526 - protein, 624 aa, Arabidopsis thaliana
MDSNFKWLLFAILISLTFSGFVLHHGVLAESVKPDEAKQLRDEVRGMFYHAFDGYMNNAFPLDELRPLSCQGEDTLGGYALTLIDSLDTLALLGDRERFTSSVEWIGKNLQFNINKTVSVFETTIRVLGGLLSAHLIASDYATGMRIPSYNNELLVLAENLARRMLPAFDTPTGIPFGSVNLMYGVDKHESKITSTAGGGTLSLEFGVLSRLTNDPVFEQVAKNAVRGLWARRSNLDLVGAHINVFTGEWTQKDAGIGTSIDSFYEYLLKAYILFGDEEYLYIFQEAYRSAMQYLHKDPWYVEVNMDSAAIVWPVFNSLQAFWPGLQVLAGDVDPAIRTHTAFFSVWKRYGFTPEGFNLATLSVQYGQKSYPLRPELIESTYWLYKATRDPRYLDAGRDFVASLQYGAKCPCGYCHITDVELHKQEDHMESFFLAETVKYLWLLFDLAVDSDNLVDNGPYKYIFSTEGHLLPITPQISLAREHCSYFGGYCPSNSTKLEQEVLGEDSSNDDHSNDYPYHESFPVTGLIKGLCPGLTHAQKYGFSYVLPEKTDREDVNQPKPVVTSSSIVLISDQTVEKRPQEEEGFTSQSEPIMTISGGSSNDQTGQELTLLESETDDQRSYSS

SEQ ID NO: 58527 - DNA, 1623 bp, Caenorhabditis elegans
  CDS (1)..(1623)
atgggcctccgatcacacgaacaacttgtcgtgtgtgtcggagttatgtttcttctgactgtctgcatcacagcgtttttctttcttccgtcaggcggcgctgatctgtatttccgagaagaaaactccgttcacgttagagatgtgcttatcagagaggaaattcgtcgtaaagagcaagatgagttacggcggaaagccgaagaagccaatcccattccaattccaaaacctgaaattggagcatcagatgatgcagaaggacgaagaattttcgtgaaacaaatgattaaattcgcatgggacggatatcggaaatatgcctggggggagaatgaattgaggcccaacagtagatcaggacattcttcatcgatatttgggtatggaaagacgggtgcaacaattattgatgctattgatacattgtatttggttggattaaaagaagaatataaagaggccagagactggattgctgattttgatttcaaaacgtctgcgaaaggagatctatcagtttttgaaacaaatatccgattcactggtggcctactctccgcatttgcacttaccggagacaaaatgttcttgaagaaagcagaagatgtggcaactattcttcttccggcttttgaaactccttctggaataccaaattcattaattgatgctcaaacaggaagatccaaaacgtatagttgggcaagcggaaaggcaattctctcggaatacggttcaattcaacttgaattcgattatctctccaatctgactggaaatccagtttttgctcaaaaagctgataaaataagagatgttttaactgcaatggagaaaccagaaggactttatccaatttatattactatggataatccaccaagatggggacaacatcttttctcaatgggtgcaatggctgacagttggtatgaatatctgctcaaacaatggattgccactggtaaaaaagatgatcgcacgaaaagagaatacgaagaagcgatatttgcaatggaaaaacgaatgcttttcaaatcggaacagtcgaatctttggtatttcgcaaaaatgaacggaaatcgcatggaacattcatttgaacatcttgcatgcttttccggtggaatggttgttcttcatgcaatgaatgagaaaaataaaacaatatcagatcattatatgacgttgggaaaagaaattggtcatacatgtcatgaatcgtacgctagatccacaactggaatcggcccagaatccttccaattcacatcgagtgtagaggcaaaaacagaacgtcgtcaggattcatattatattcttcgtcctgaagtcgttgagacatggttctacttgtggagggctacaaaagacgagaaatatcgacaatgggcttgggatcatgttcaaaatttggaggagtattgtaagggcactgccggatactctggaatccgaaacgtctacgaatcgagcccggaacaagatgatgtgcagcagtcattcctcttcgctgagctcttcaaatatctgtatttaattttcagtgaagataacattcttccacttgatcaatgggttttcaataccgaagctcatccattccgcattcggcattaa

SEQ ID NO: 58528 - protein, 540 aa, Caenorhabditis elegans
MGLRSHEQLVVCVGVMFLLTVCITAFFFLPSGGADLYFREENSVHVRDVLIREEIRRKEQDELRRKAEEANPIPIPKPEIGASDDAEGRRIFVKQMIKFAWDGYRKYAWGENELRPNSRSGHSSSIFGYGKTGATIIDAIDTLYLVGLKEEYKEARDWIADFDFKTSAKGDLSVFETNIRFTGGLLSAFALTGDKMFLKKAEDVATILLPAFETPSGIPNSLIDAQTGRSKTYSWASGKAILSEYGSIQLEFDYLSNLTGNPVFAQKADKIRDVLTAMEKPEGLYPIYITMDNPPRWGQHLFSMGAMADSWYEYLLKQWIATGKKDDRTKREYEEAIFAMEKRMLFKSEQSNLWYFAKMNGNRMEHSFEHLACFSGGMVVLHAMNEKNKTISDHYMTLGKEIGHTCHESYARSTTGIGPESFQFTSSVEAKTERRQDSYYILRPEVVETWFYLWRATKDEKYRQWAWDHVQNLEEYCKGTAGYSGIRNVYESSPEQDDVQQSFLFAELFKYLYLIFSEDNILPLDQWVFNTEAHPFRIRH

SEQ ID NO: 58529 - DNA, 1599 bp, Caenorhabditis elegans
  CDS (1)..(1599)
atggttcgcataaaaattaatcgaaaaactctctttattttattcattgcttatatgcaactactcgtatttcttgcactttatctgaatctagctggaccagcagaacttctcaatcctagaagacagaaattttttggaacaaactcggcaaatcgacaaaattcgaatgaaacatatggcacaccaaaggcaaccaagttgaaaagagcgccgccagtttttcaaggtcctacgaatgaaagacaaaaagccattgtacgagcattccagcatgcttggtctggatataaaaagtatgcatggggtcatgatgaacttcgcccagtttcaaagcgatttgacgattcttttgggcttggacttaccattatagatagtttagatactgcgataataatgggattggaagaagaaactcgcgatggtgttgaatggattcgggaaaatctgaacgtgtctccagccagaagcgttaatgtattcgagaccacaattcgagttctcggtggactgttgagtgggtatcatctgacaggagaagaagcgctccttgaaaaagctactcagcttggagataatttgatcaaagccttcactaaatcgtcttcactaataccaaaaagtgatgtaaacctagataacgggaatgcttgcagtccaaatcgcgatctttcttctttagctgaagccaccactttacaattggaattcagagacttgacagccttgaccggtgatcaaaagtatgaagatgtggcgttcggagcatcggagcatgttcacaatgttggatgtaaaaagatggatggactgtgcccattttacattgacggaaaaggagaattcaaaaaatcaagtattactcttggagctcgtgctgacagctactacgaatatcttatcaagcaatggcttcaaaccaaaaaatcaattgattggctgcgtgacgacttcattcaatccattgccgccatgaaaaagcatctctatagacaatctcagccgaatagcatctggtttctcggtgaaataaccgaattggcacagttctatccaaaaatggatcaccttgtctgtttcctttccggatctcttgtactttcccatttaaatggtcttgatcatgacaatgaacatttggaaatggctaaaaatattggaaatgtttgtcataaaatgtatgaaaatccaacaggacttggaccagaaataatacatttcaatatggaggatagttctgatatgacacaagcggatacttatgtgaagaatcttgatgctcattcacttctccgtccagaagcaattgaagcgtggttctatttgtatcgtgttactaaagataagaaatatcaagagtggggatggaaagcttttgagtcgattgaaaagtatgcaaaagtggaaactggtggatacagctcaattgacaatgtgctcagaaagaagatcaaaagacgtgacaaaatggaatcattcttccttgctgagaccctcaaatacctttaccttctaatggctgatgatcaagaaatccttccactcgatcgatgggttctcaacactgaagcccacccacttccaatttacaattga

SEQ ID NO: 58530 - protein, 532 aa, Caenorhabditis elegans
MVRIKINRKTLFILFIAYMQLLVFLALYLNLAGPAELLNPRRQKFFGTNSANRQNSNETYGTPKATKLKRAPPVFQGPTNERQKAIVRAFQHAWSGYKKYAWGHDELRPVSKRFDDSFGLGLTIIDSLDTAIIMGLEEETRDGVEWIRENLNVSPARSVNVFETTIRVLGGLLSGYHLTGEEALLEKATQLGDNLIKAFTKSSSLIPKSDVNLDNGNACSPNRDLSSLAEATTLQLEFRDLTALTGDQKYEDVAFGASEHVHNVGCKKMDGLCPFYIDGKGEFKKSSITLGARADSYYEYLIKQWLQTKKSIDWLRDDFIQSIAAMKKHLYRQSQPNSIWFLGEITELAQFYPKMDHLVCFLSGSLVLSHLNGLDHDNEHLEMAKNIGNVCHKMYENPTGLGPEIIHFNMEDSSDMTQADTYVKNLDAHSLLRPEAIEAWFYLYRVTKDKKYQEWGWKAFESIEKYAKVETGGYSSIDNVLRKKIKRRDKMESFFLAETLKYLYLLMADDQEILPLDRWVLNTEAHPLPIYN

SEQ ID NO: 58531 - DNA, 1707 bp, Caenorhabditis elegans
  CDS (1)..(1707)
atgaaatttgtcaaaaatgtgttaattttcatcgcattgttctctacgacgtgctcactcaaaacaacgaaaaatccatttcttttaacgaaggaggaaataaaatatgcgtcaatttcagatgtggatttgcaatatggattggcaaaaacacgcgaaatgtttcaatttggatgggataactacatggaacatgcatttccagcagatgaattagatccaattcattgtagaggccgtggacacgatcatgataatccagataatattaatgttaacgatgtgcttggagattactcgttgggattaattgacactttggattcgcttgtggtttttggagacgcagacgaattcaaacgagctgttaatcttgtaattaaaacagtatcgtttgaaaagaatacaacagttcaagtattcgaatcaactattcgagtgatgggtggtcttctggctgctcatatgattgctgccgataaaactaatcgatttggtcctttctatatgtcagactacggtggagaacttttaacacttgcccatgatttagctgggcgacttttaccagcgttcgatggaacggccaccggaattccttacacccgtataaacttgcaaaagggaattcttccgggaacgacaaactctacatgtacatcaggcgcggggagtctattgcttgaatttggtgtattgtcaaagctgcttggagatgacacctatgaacgacttgctcgacgagttaatgaaaagttgtggaatttaagaaatgaggtcactggattgcatggaaacttaattgacattcaaactggagaatggcttggtcacttagcaggcctcggtgctggaattgattcattctatgaatatatgctaaagtcgtacatcctttttggtaatcaacgagatttagatatgtataatgaatcatttgctcgtatcacaacatacatgcgtcgaggtcgttctaggtgttccagtcttgaaggtgatattccaatttatgtaaatgttgattcaagagatggaagcacttcaaatacatggatcgattctcttcaggcaagtttcgcaggagttctggttttggctggtgaagtcgacgaggctgtgtgccatcatgccctttactatgcaatttggaagaaatacggagttctacccgaacgattcaattggcagttacaagctcctgatgtctcattttatccacttcgtccagaatttgttgaatctacatatctattgtacactgctacgaaaaatccattttatcagcatgttggactggaaattcttgattcattagaaacaattactcgagtaaaatgtggcttcgcaactgtgcatgatgtcattgatggaagtcttgaagatcgaatggaatcgtttttcttatcagaaacattaaagtatttatacttgttgttcgatgtagatcatccaattaacaaggaacagcaagaaagtgttcttttttcaacagagggtcacatatttccaatatccccgctgttcaatctgcctcctactccgccatctcaatatgatccacctctcaaaccattgccacgtaccaactcatcattttgcgaaactgccacagacttcacttttggaaccccaccacttcgtcattctcaaatgcgtgaattgttcaaagttattggagttgattcggttcttcacgattggttataa

SEQ ID NO: 58532 - protein, 568 aa, Caenorhabditis elegans
MKFVKNVLIFIALFSTTCSLKTTKNPFLLTKEEIKYASISDVDLQYGLAKTREMFQFGWDNYMEHAFPADELDPIHCRGRGHDHDNPDNINVNDVLGDYSLGLIDTLDSLVVFGDADEFKRAVNLVIKTVSFEKNTTVQVFESTIRVMGGLLAAHMIAADKTNRFGPFYMSDYGGELLTLAHDLAGRLLPAFDGTATGIPYTRINLQKGILPGTTNSTCTSGAGSLLLEFGVLSKLLGDDTYERLARRVNEKLWNLRNEVTGLHGNLIDIQTGEWLGHLAGLGAGIDSFYEYMLKSYILFGNQRDLDMYNESFARITTYMRRGRSRCSSLEGDIPIYVNVDSRDGSTSNTWIDSLQASFAGVLVLAGEVDEAVCHHALYYAIWKKYGVLPERFNWQLQAPDVSFYPLRPEFVESTYLLYTATKNPFYQHVGLEILDSLETITRVKCGFATVHDVIDGSLEDRMESFFLSETLKYLYLLFDVDHPINKEQQESVLFSTEGHIFPISPLFNLPPTPPSQYDPPLKPLPRTNSSFCETATDFTFGTPPLRHSQMRELFKVIGVDSVLHDWL

SEQ ID NO: 58533 - DNA, 2346 bp, Caenorhabditis elegans
  CDS (1)..(2346)
atgatcactcgaaaagcaatattctttttagcattagcgtcaattattcaagcatcagatgattccgaagctcccgataataaaaagtcttcaataagattcactccatcagttattgattcttatagagaaaaagttcaaaaaatgttctaccacgcctacaacggatatttggatcatgcatttccactagatgaactgaaaccaataacatgcgttggacaagacacctggggatcattctctctttcattaattgatgctctagatactcttctggtgatgggaaatacaaccgaattccgaagagcagtgtcacttgttcttgagaaagctcgtgatgatgctaatgtgaatgtttctgttttcgagacgaatatcagagttgttggcggattaatatctgcacatatgctagcgggaaggcataaagatcttgtcgtagattgggaaggttatccatgtgatagtccgcttctcaaattagctgttaaaatggctgatcgacttatgcctgctttcaatacagaaactggaatgccctatggaactgttaacttgaaatatggagttcataaagatgaaacaccaattacttgtacagctggtgtgggcacatttcttattgaatttggtaccctctcacgtttgactggcgatgacaaatacgaaaaagtggctctaaaagcgttggatgctttatggtcgacaagatcaccaatcggactcgtgggcaatcatatcaatgttcaaacaggacaatggacggcaactgattctggaattggtgctggcgttgatagttatttcgagtatttagcaaaaggagcatatctattcagaagaccaagtcttatgaaacaatttcatgaacatgcaacatcaattaataaacatgttcggaaaggtgaatggtttatgtgggtatcaatggccaaaggatctgtctccttgccaatttttcaatctcttgaagcattctggcctggaactctaacaatggttggtgatgttcaagatgcatcaagaattatgttaacatattctgaagttatacgaaaatacgggttcccacctgaattttataacattcataatgaagagccaggagaaaaacgagccgcatttcctttacggcctgaaatggttgaatcattgatgtatctgtatagagcgacaaaggatgaaacgtggttagaacttggagctgaaatgattgatgcaatagaatcatcagcccgaactaaatgtggctatgctacaatcaacaatgtaaaagagcatagtattgaagatagaatggagtcatttttccttgctgaaacaactaaatatctttatttattgttcgatccaacaaacttcattcattcaaaaggagatcaagctagaatattgacgagtccaaagaatttgacttgtgtgatctatggaggaggctatatattcaacactgaagctcatccagttgatccaggaatgttggattgctgtagtgtacaagcaaaacgggatcaggaagttggtgtgaaacaagtgaacaatggtgatgagcatgagaaaatgaatcgaacagaaaagggcggtgaaaagtatttcgagaatcaatatggaaaaaatgaaaatttaattgaattcgaagttgatgagaaactgaaaaaagaatctgaaaaacgaaagattgaactggaagcagaaaaagtgaaagaaaattcacataaagcaatgctcaaagtgcgagaaatacttgtaagagctcatcagaaggatgaagcaatgcagcgaaatggtgaaacatctgattcggctagaaaactgatggatcaactctacaaagcatacccaaatcatacggcagagttggaaaatttgaataaagaagcaattattgaatttgaagaacttcaacatttggaggatattcgagaacttgttagagaaatcccgatacctgaagttttttgtgagaaatgctgtgtcccacttcatgaaattgtcgattcggttgtacttcgagtgttaatggccgatgtttacgaatatcatttttatccaacgagaaaaacaaaatttcttcatggtcctgtttgttggttagaggaaacaccacggattgaggatgattacaaaaatgagccaccaagtgtgaacacagaaaaatggaatagtcctctcttcacaagtgatcaggcttctctcaatgattttatcggagacgatcttgaaactgttcgaaagtttggattcaaaactcttctggctcctggttacaaaaaattggataaattaattgctggacagaatattgcgttgcgaagaaagaagtcgtggtattatgaagtttag

SEQ ID NO: 58534 - protein, 781 aa, Caenorhabditis elegans
MITRKAIFFLALASIIQASDDSEAPDNKKSSIRFTPSVIDSYREKVQKMFYHAYNGYLDHAFPLDELKPITCVGQDTWGSFSLSLIDALDTLLVMGNTTEFRRAVSLVLEKARDDANVNVSVFETNIRVVGGLISAHMLAGRHKDLVVDWEGYPCDSPLLKLAVKMADRLMPAFNTETGMPYGTVNLKYGVHKDETPITCTAGVGTFLIEFGTLSRLTGDDKYEKVALKALDALWSTRSPIGLVGNHINVQTGQWTATDSGIGAGVDSYFEYLAKGAYLFRRPSLMKQFHEHATSINKHVRKGEWFMWVSMAKGSVSLPIFQSLEAFWPGTLTMVGDVQDASRIMLTYSEVIRKYGFPPEFYNIHNEEPGEKRAAFPLRPEMVESLMYLYRATKDETWLELGAEMIDAIESSARTKCGYATINNVKEHSIEDRMESFFLAETTKYLYLLFDPTNFIHSKGDQARILTSPKNLTCVIYGGGYIFNTEAHPVDPGMLDCCSVQAKRDQEVGVKQVNNGDEHEKMNRTEKGGEKYFENQYGKNENLIEFEVDEKLKKESEKRKIELEAEKVKENSHKAMLKVREILVRAHQKDEAMQRNGETSDSARKLMDQLYKAYPNHTAELENLNKEAIIEFEELQHLEDIRELVREIPIPEVFCEKCCVPLHEIVDSVVLRVLMADVYEYHFYPTRKTKFLHGPVCWLEETPRIEDDYKNEPPSVNTEKWNSPLFTSDQASLNDFIGDDLETVRKFGFKTLLAPGYKKLDKLIAGQNIALRRKKSWYYEV

SEQ ID NO: 58535 - DNA, 2796 bp, Caenorhabditis elegans
  CDS (1)..(2796)
atgttcaacacaagatggaaggtgttcatatttttggcactatgctatcgaatatcacatggagaagagttggataagaaaaagttacaaaaagaggcatacgacatgtttatgcatggatacaattcttacatgaactacgcatttcctgctgatgagctcatgcccctttcatgcaaaggacggatccgaggtgtgacccccagccgaggagatgttgacgatgtcctgggaaacttttcggtgactttattggacagcctggataccttggttgtaatgaatgagcttgatgagtttgaaaaagctatagacttggttatcaaacatgtgcgatttgattctgatcacgttgtcagtgtttttgaaactaatatcagagttctcggtggtttgatctcagctcacgtgttggcagaattagtaaaagaaaagtacccaaatcggctgacaacttatgataatcagctgctcaaaatggcgactgaagttggaaatcgactactccctgctttcaatacaaccagtggcttgccatttagtaggatcaacttgaaacatggtatgcaagatcacttgaaaagacagaaggatacatgtacggcttgcggaggaacaatgattttggaatttgctgctcttacaagtttgaccggtgacccaatttatgagaagaaagcaaggaaagctatggacttcttatggcaacaacgtcacagatcttctgacctgatgggtactgtgctcaatgttcattcaggagattggacacgacgggaaagtggaattggagcaggaatagattcttattacgagtatactctcaaagcttacattctccttggtgatgaaagttatcttgacagattcaataagcactatgaagctatcaaaagatacatcaacaagggtccaatatttgtcgacgtacacatgcataggccaacagttgccacaaggggcttcatggactctcttctcgctttttggcccggcttacaagtattgaaaggagatgtcaaggaagcaattgaaatgcatgaaatgctgttccaagtcatacaaaagcacaagttcttgcctgaggctttcactcatgattttcaagtacactgggctgaacacccaatccgacctgaatttgtagaaagtacctacttcttgtatcgagctaccaaggatccccattacttgcatgttgcgaagcagattatggatagtatcaacaagtatgtgaaagtgccttgcggatttgctgctttaaaagatattcgaactatggtcaaagaagatcaaatggaatcgttcgtactttcggaaactttcaaatatctctacatgatcttcactgatcctgaagatctaatgtttgatcccgatcactacgtacttaccacagaggctcacttcttgcctttaagcattggacacaaggagaaaatagaaaataaaataaacccacgtcgaatgatattgcgagcggacgagccacagcagaaaaactacgtgtgtgcaaacccaatcgatttcacgaagttacccactgaacgggaagaagcccaattgataagagaaaggacgaaaattatgttgggagagcttagaaatggggcgagtgcaggtggtgcagcaccgggcaacatgatatgtgaatctccggccgacagaattcgagcatgggcgttttcgtcaagtaaccaagaacacgtcaaacaattggttatgatggggattgaactcattaccttgagtgatggccgtttgcatttaagccataaatcagtaaacgcagcttcaccactttatgcaagatggggaatggaatttatggaggaaatgcagcactatgtcgaacaactcgataaatctggtggtactcctgagcacactcaacagttcgtgcaaatccttaaccgtccttattacggaaaaccatacctacgcggatctgctgctcaatttggacgagacattgcagcaacaaaagcccttgttggacgtgcggccaagacaattccattccgagcatgtgacaaaattttgaacgccgaccaggtagttggaaaaattgcagttgtcgaaaggtcggattgcgttttccaagataaagctagatttgtgcaacaagctggagctataggaatggttgtgattgatcacgaatcaaattcacaatacgttggcgatcggccaactttctctatggcagttgacaaggatggaaaagatgatattggaatcccatccatatttttgttccgtgctgaaggggaccacttgttacgttctttgaaaatgcattccgaaacggtcatttcgatatcatctcatcacctctcgattgaaaacacaattggtcggcttttgcgatatggcaaaatgttcaagtttcctgaatacccacaatgttcactcagagacggtgatattatattgcacaatttggattatcctgaagttattctcaatctgcgtttcaatggtattaatcaagatagtgatccaagactacatcaagaaattgttgagcgtcacgtcacagaactacaaaaatatctagagttcaaggatgctgactatgcgttccagttttatgagttcttccgtacggcagcatatggagcacttgatttgaatgtggaaaatagtaagctgctcacagtaatttctgcactgagtacgttaaaaacaaaaccaattccaccatcagtttttgcgagacttcccggagagattacaaaggtccgttgtattcccagaggagaagaaatgccgtgtgttcgactatctacataa

SEQ ID NO: 58536 - protein, 931 aa, Caenorhabditis elegans
MFNTRWKVFIFLALCYRISHGEELDKKKLQKEAYDMFMHGYNSYMNYAFPADELMPLSCKGRIRGVTPSRGDVDDVLGNFSVTLLDSLDTLVVMNELDEFEKAIDLVIKHVRFDSDHVVSVFETNIRVLGGLISAHVLAELVKEKYPNRLTTYDNQLLKMATEVGNRLLPAFNTTSGLPFSRINLKHGMQDHLKRQKDTCTACGGTMILEFAALTSLTGDPIYEKKARKAMDFLWQQRHRSSDLMGTVLNVHSGDWTRRESGIGAGIDSYYEYTLKAYILLGDESYLDRFNKHYEAIKRYINKGPIFVDVHMHRPTVATRGFMDSLLAFWPGLQVLKGDVKEAIEMHEMLFQVIQKHKFLPEAFTHDFQVHWAEHPIRPEFVESTYFLYRATKDPHYLHVAKQIMDSINKYVKVPCGFAALKDIRTMVKEDQMESFVLSETFKYLYMIFTDPEDLMFDPDHYVLTTEAHFLPLSIGHKEKIENKINPRRMILRADEPQQKNYVCANPIDFTKLPTEREEAQLIRERTKIMLGELRNGASAGGAAPGNMICESPADRIRAWAFSSSNQEHVKQLVMMGIELITLSDGRLHLSHKSVNAASPLYARWGMEFMEEMQHYVEQLDKSGGTPEHTQQFVQILNRPYYGKPYLRGSAAQFGRDIAATKALVGRAAKTIPFRACDKILNADQVVGKIAVVERSDCVFQDKARFVQQAGAIGMVVIDHESNSQYVGDRPTFSMAVDKDGKDDIGIPSIFLFRAEGDHLLRSLKMHSETVISISSHHLSIENTIGRLLRYGKMFKFPEYPQCSLRDGDIILHNLDYPEVILNLRFNGINQDSDPRLHQEIVERHVTELQKYLEFKDADYAFQFYEFFRTAAYGALDLNVENSKLLTVISALSTLKTKPIPPSVFARLPGEITKVRCIPRGEEMPCVRLST

SEQ ID NO: 58537 - DNA, 1725 bp, Arabidopsis thaliana
  CDS (1)..(1725)
atgtcttgtcctatccatcctaggcgtctcttcctctgcttgcttatttctctcactttcttcgtcgtcgacccttcatcgcagcatatcgaggtcaagaagaaacaaatgcgagagaaagtacgcgagatgttctatcatgcgtatgacaattacatgacttatgcatttccgcatgatgagctaaagcctctaactaaaagtttcacagactccctcagtgagcttggaaatcttaagcttgaacacctgccaacagattataatggatcagctgttactcttgttgaatcattatccagccttgctatattggggaacagtacagaatttgaaaagggggttctctggctctcagaaaatcttactttcgatattgatgcccgggtcaacctttttgagtgcaatataagagttcttggaggacttatctctgctcatcttcttgcaattgatccaaataataggttgattcagggttcctacaacaatcagcttcttcgattagctgaagaccttggaaaacgttttttacccgcgtttgaaacacctacaggattaccatatgcatggattaatttgaagaatggagtaatggagaatgagacaactgaaacaagcacttcaggatgtggttctctcgttcttgaaatgggagcattgtcacggctcactggtgacccgaggtttgaatcagctgcactacgtgcgcttcgtcagctatggaggatgcgaagttcgttagatctgcttgggacaacattggatgtggtaactggggaatggatagagtactcctctagcattggagctggggttgactctttctatgaatacctcttgaaggcttatattctttttggaaaagaagactactggcgaatgtttcattctgcttatctggcatctcagaagtacttcagacatgggccttggtaccatgaagctaatatgtggagtggaaaaccaacttactggcagctcacaagtcttcaggcgttttggcctggtctgcaggttcttgttggagatattgcagctgcaaattcatcgcatcgtgagtttttccatgtatgggaaaagtttggtgtattacctgagaggtatctactcgatcatcaaataatacatccgacaatgaagtactatccactacgtcctgaattagcagaatccacgttctacctttaccaagctacaaaagatccatggtatctagatgttggtgaatcaatggtaaaatctcttaatctctacacaaaggtgccagggggatttgcaagtgttagagatgtgacgaccatgcaattggaagatcatcagcacagtttctttctcgctgaaacgtgcaagtacctatatctcctcttcgatgactcatttgtggccaaaaggaattatatatttacaaccgagggccatcctatacaggttgtgagctcctggcatgagaaactaccagaaacttatttctcaggcaactggaccctttcaaagagtggagcatgggaaagtcgagctagcgcattgtcactacaagtctgtccactgatatctcttaactctagacatcctgagcaacaaagagagagtgcttgccatgttcttgacgagcaaatcaatcataagtgttggagcaacaaagagtgcggagttgatgccactacttgtagactaagaacctgcagcggggttggatactgcggcttatggaatcccttataa

SEQ ID NO: 58538 - protein, 574 aa, Arabidopsis thaliana
MSCPIHPRRLFLCLLISLTFFVVDPSSQHIEVKKKQMREKVREMFYHAYDNYMTYAFPHDELKPLTKSFTDSLSELGNLKLEHLPTDYNGSAVTLVESLSSLAILGNSTEFEKGVLWLSENLTFDIDARVNLFECNIRVLGGLISAHLLAIDPNNRLIQGSYNNQLLRLAEDLGKRFLPAFETPTGLPYAWINLKNGVMENETTETSTSGCGSLVLEMGALSRLTGDPRFESAALRALRQLWRMRSSLDLLGTTLDVVTGEWIEYSSSIGAGVDSFYEYLLKAYILFGKEDYWRMFHSAYLASQKYFRHGPWYHEANMWSGKPTYWQLTSLQAFWPGLQVLVGDIAAANSSHREFFHVWEKFGVLPERYLLDHQIIHPTMKYYPLRPELAESTFYLYQATKDPWYLDVGESMVKSLNLYTKVPGGFASVRDVTTMQLEDHQHSFFLAETCKYLYLLFDDSFVAKRNYIFTTEGHPIQVVSSWHEKLPETYFSGNWTLSKSGAWESRASALSLQVCPLISLNSRHPEQQRESACHVLDEQINHKCWSNKECGVDATTCRLRTCSGVGYCGLWNPL

SEQ ID NO: 58539 - DNA, 1875 bp, Arabidopsis thaliana
  CDS (1)..(1875)
atgtcgaaatctctaccatattcagttaaagatattcattacgacaatgccaagttcagacatcgatctcctttaaaggttttttctcaaagcttgcttactcttagtacaaaacgcaactacgctagctgtagcacggggaagttccttatattaatactgttctttggagtagcatgtctaatgctgatgagtaagagtccaaatgaatctggtcttaatgagaaaggaaaggtcacttttgttgggggacttaggctagggggacttttgagaaagccacctaggcttccacctcgtttatcacctgacgaaggacaattaagaggaagttccactaatggctcaactatttcaaattctgacccaaaatgggcagctaggcagcaaagtgtaaaagaggcttttgaccatgcatggtctggctatagaaagtacgccatgggttatgacgagctaatgcctattagccagaaaggtgtggatggtttaggaggattaggtgccactgttgtggatgctcttgatacagccatgataatgggtcttgataatatcgtctctgaagcaggatcatgggttgagactcatctcttggagagaatcagtcaaaaaggtcaagttaatttgtttgaaactacaatacgtgtcttaggtgggcttctaagtgcataccatttgagtggaggagagcagggtacggtgaacatgacccatgttggaccgaaaccagtcatctatctaaatattgctaaggatttggctgaccgtctactttcggcttttacctccagccctactccagttcccttttgtgatgtcatattgcatgaatcgactgctcatccagctccaggaggagcgagcagtacagcagaagttgcctctgtacagcttgaatttaactacctcagttctatttctggtgatccaaagtatagtacagaggccatgaaggtcttagctcatataaaaacacttccaaagacagaaggtcttgttccaatctatatcagccctcaaacaggtgactttgttggtgagaatatcaggttgggatctcgtggtgatagctactatgagtatttaattaaggtgtggcttcagcaaggagctaagttgaatagtaatttcacatatttgcatgatatgtacattgaggcaatgaaaggagtcaggcatttgcttgtgcaaaattcaattccaaaaggtctggtctttgtaggggagttaccttacgggtctaagggagaattcagtccaaaaatggatcatttggtatgcttcttgcctggtactcttgctctcggtgctaccaagggcctcacaaaggaacaagccctgaaggaaaatcttttgtcctttgaggacctagaaaatctgaaacttgcagaagatttagcgaaaacatgctttgagatgtatgaagtaactgccactggccttgctccagaaattgcttactttcacacaaaggattacactgaggatggtcttgatggtgggaataagagttctatgtatgcaaatgacataatcattaagcccgctgatcgacataatctactgcgccctgaaactgttgaatcactctttgtcctctatcgtatcacaaaagatacaaaataccgagatcaaggttggcaaatttttgaagcttttgaaaagtacacaaaggtgaaatcaggtggatacacatcattggatgatgtaacagaagtgcctcctcatagaagagataagatggagacatttttccttggtgaaacattgaagtacttatacttgctctttggagatgactcagtgataccattggataagtttgttttcaacactgaagctcatccattaccaataagaagaaacacctga

SEQ ID NO: 58540 - protein, 624 aa, Arabidopsis thaliana
MSKSLPYSVKDIHYDNAKFRHRSPLKVFSQSLLTLSTKRNYASCSTGKFLILILFFGVACLMLMSKSPNESGLNEKGKVTFVGGLRLGGLLRKPPRLPPRLSPDEGQLRGSSTNGSTISNSDPKWAARQQSVKEAFDHAWSGYRKYAMGYDELMPISQKGVDGLGGLGATVVDALDTAMIMGLDNIVSEAGSWVETHLLERISQKGQVNLFETTIRVLGGLLSAYHLSGGEQGTVNMTHVGPKPVIYLNIAKDLADRLLSAFTSSPTPVPFCDVILHESTAHPAPGGASSTAEVASVQLEFNYLSSISGDPKYSTEAMKVLAHIKTLPKTEGLVPIYISPQTGDFVGENIRLGSRGDSYYEYLIKVWLQQGAKLNSNFTYLHDMYIEAMKGVRHLLVQNSIPKGLVFVGELPYGSKGEFSPKMDHLVCFLPGTLALGATKGLTKEQALKENLLSFEDLENLKLAEDLAKTCFEMYEVTATGLAPEIAYFHTKDYTEDGLDGGNKSSMYANDIIIKPADRHNLLRPETVESLFVLYRITKDTKYRDQGWQIFEAFEKYTKVKSGGYTSLDDVTEVPPHRRDKMETFFLGETLKYLYLLFGDDSVIPLDKFVFNTEAHPLPIRRNT

SEQ ID NO: 58541 - DNA, 1719 bp, Arabidopsis thaliana
  CDS (1)..(1719)
atggcgaggaataaacttgtaagtggtagtcatgggatatggaaatatttcaacccagcgttttatctccgaagaccaagacgtcttgctttgctcatcatcctcttcgtctctgtttcaatggttgtttgggatcgtcaatctctttcccgagactaccagtttgaagtttccaagttaaatgaagaagttttgcggttgcagcagatgttggaagagataaagagcgtcactgaggatgtgtctgtcaatagtttgaaggatgttcaggaagatccagttgatgctcagcgaatgcagagagttaaagaggcaatggttcatgcttggagttcatatgaaaagtatgcctggggacaagatgagcttcagccccagacaaaggatggtgttgacagctttggtggcctgggtgcaactatgatagatgcattagacacactatatataatgggtctagatgagcagtttcagaaagccagagagtgggtagcaagctcattagatttcgacaaggattatgctgccagtatgtttgagacaaccataagagtggtaggagggcttctcagtgcgtatgatctttctggggataaaattttccttgaaaaggctatggatattgcagacagattattgcctgcatgggacactcaatcgggtataccatataatattatcaacttgaagcatggaaatgctcacaatcctacatgggcggggggagacagtattcttgcagattctggtactgagcagcttgaatttattgccctttcccagaggacaggggacccaaaatatcagcaaaaggtagaaaaggttatttcagtgctaaataagaacttccctgctgatggtttacttccgatatatataaatcccgatacagctaatccatcgcagtctacaataacatttggtgccatgggagacagcttttacgaatatttgctcaaagtttgggtgtttgggaacaaaacttcagcagtgaaacactatagagatatgtgggagaagtcaatgaatggtctgctaagcttggttaagaaatcaacacctttgtcgtttacatatatctgtgagaagagtggaaattctttgatcgataagatggatgaattggcatgctttgctcctggaatgttggctttaggagcatctgggtatagtgatcctgctgaaggaaagaagtttctcacactcgctgaagagcttgcgtggacatgttataacttttaccaatcaactccaacaaaactggctggggagaattatttcttcaactctgggagtgacatgagtgttggaacgtcgtggaacatcttgagaccagaaactgtcgaatcactgttttacctctggcggttaactggaaacaagacatatcaagagtggggatggaatatatttgaagcatttgagaagaactcgcgcatagagtctggatatgttggtttgaaggatgttaatacaggcgttaaggacaacaagatgcaaagtttcttccttgcagagacactcaagtatctctatctactcttctcgccgacaacagtcattcctttagacgagtgggtattcaacaccgaagctcatccacttaagattaagtctcgaaacgatcaggtaaatctcaaacaatccaacaaagtactgctacgaaaaccggcatttagaatacgccagaggcattatggtcggataacaaagaagtaa

SEQ ID NO: 58542 - protein, 572 aa, Arabidopsis thaliana
MARNKLVSGSHGIWKYFNPAFYLRRPRRLALLIILFVSVSMVVWDRQSLSRDYQFEVSKLNEEVLRLQQMLEEIKSVTEDVSVNSLKDVQEDPVDAQRMQRVKEAMVHAWSSYEKYAWGQDELQPQTKDGVDSFGGLGATMIDALDTLYIMGLDEQFQKAREWVASSLDFDKDYAASMFETTIRVVGGLLSAYDLSGDKIFLEKAMDIADRLLPAWDTQSGIPYNIINLKHGNAHNPTWAGGDSILADSGTEQLEFIALSQRTGDPKYQQKVEKVISVLNKNFPADGLLPIYINPDTANPSQSTITFGAMGDSFYEYLLKVWVFGNKTSAVKHYRDMWEKSMNGLLSLVKKSTPLSFTYICEKSGNSLIDKMDELACFAPGMLALGASGYSDPAEGKKFLTLAEELAWTCYNFYQSTPTKLAGENYFFNSGSDMSVGTSWNILRPETVESLFYLWRLTGNKTYQEWGWNIFEAFEKNSRIESGYVGLKDVNTGVKDNKMQSFFLAETLKYLYLLFSPTTVIPLDEWVFNTEAHPLKIKSRNDQVNLKQSNKVLLRKPAFRIRQRHYGRITKK

SEQ ID NO: 58543 - DNA, 2364 bp, Schizosaccharomyces pombe 972h-
  CDS (1)..(2364)
atgggtagcttgcactcgattttctgtgtttgtttgattttactatgcatttttaaagaaaactcaatcgttggggccataaactccgcgagaatggtagagctaagggaaacttctcggagactgttttatcatggatataacaattacatgcaatttgcctttcctaacgatgagctcgccccattgtcctgcgaagggttgggaccggactacgaaaatcctaacaacattggtgtcaacgatgttcgaggtgattatttgttgacattggtcgatgttttagataccttggtggttttgggagaccgagaagggtttcaggatgctgttgacaaagtcattcatcatattaattttgaacgagacacaaaagtacaagttttcgaagcaaccatccgaattcttggaggactactttcatctcatatttttgcctcagaagaaaaatatggatttcaaatcccattgtataagggtgaattattgacattggctacagaactagcagaacgtttacttcctgcatttcgaacacctactggaattccttttgcaagaatcaatctaatgaagggtgtcgcgtatcgtgaggtaaccgaaaactgtgctgctgcggcctccagcctggtattggaattttctatgcttactgctttgactgggaataataagtttaaagcttctgctgaaaacgcttttttctccgtatggaagcgaaggtcaggtattggtcttttgggcaatagtatcgacgttttgagtggcagatggatttatcctgtttcaggagtcggtgcaggcatcgatagcttttacgaatatgcttttaaatcttatatctttcttggagatcctcggtatttagaagtttggcaaaagtctttggaatcattacggcattataccgcttctcttaacgaatattactatcaaaacgtttattcagctaatggcatggtgatgtcgcgctgggttgattctttgagtgcttatttccctgggttattggtattggcgggcgaactggagcttgccaagaaaatgcatttgtactatttttctatttatttgaagtttgggcaattaccagagcgctacaacttgtatacaaagtccatcgaactaaacggttatcctttacgtcctgaatttgctgagtctacatattatttatacagggcaactaaagatgtattttatcttcatgtcggtgaattactgctaagtaatatcgaaaaccacctatggactccttgtggatttgcggcagtagagaatctagaaaagtatacactttcgaatcgaatggaaagtttctttttgagcgaaacccttaaatatttgtttctattatttgacgatgataatcccattcacagaagtcaccatgattttatttttacgacagaaggtcatttgtttcccgtgacaaatcaaacacgactgtctacctctcaaagaatttacgacggtggagaagtttgtgttgcagaagattacgacagatctaaatggccaatgttatattcgttgatagcatctagagacgattacgattatgtctctcatttagtaggaattgataacaaagcaataccctcgtatctaattgatccatcgggtgtttgcaagaggccagagtattccgatggttttgaactcctttatggaagtgcacttgttagtcctataaaatcagtggaacgtgtaaccaataatgtatacatatccgacattatcggtaataaacttaaattcgttcaaaaagaaggttctaattctctgtttttatacactgctggagctgaatctataaatgagaatgacacggtcttcctaaccgatccggattatgagaccttcacaagacctgatgcattgtactttgatcgaactattgctcagctagaaaatccgaacagtggtcaaaaaacgtttggaaaattccttcaatttgacaacgataattctttaccttcaaaggtttttaagacagtcttgttaaataacagtatgtgtcaaaaaccctccgatactctcgacaaagatacagcatatattgctccacttggcaactgctcatgggtgcagcaagcaaaaaataccaataaggcaggattgttaattctcatcacggatggtgaatttattaatccgttagaaaatattcattctcaaaacagtctattcaattgggttaaaccatacatccctccgactattctcttaaaaaatgaaaacaattttgtttctaaatgggccaacgtctctgtgcgtcaatcagactttgacgccccttcgtacttccaaggaactccagtttcaaacctatatttgtgtctgaaatgcataaacagctag

SEQ ID NO: 58544 - protein, 787 aa, Schizosaccharomyces pombe 972h-
MGSLHSIFCVCLILLCIFKENSIVGAINSARMVELRETSRRLFYHGYNNYMQFAFPNDELAPLSCEGLGPDYENPNNIGVNDVRGDYLLTLVDVLDTLVVLGDREGFQDAVDKVIHHINFERDTKVQVFEATIRILGGLLSSHIFASEEKYGFQIPLYKGELLTLATELAERLLPAFRTPTGIPFARINLMKGVAYREVTENCAAAASSLVLEFSMLTALTGNNKFKASAENAFFSVWKRRSGIGLLGNSIDVLSGRWIYPVSGVGAGIDSFYEYAFKSYIFLGDPRYLEVWQKSLESLRHYTASLNEYYYQNVYSANGMVMSRWVDSLSAYFPGLLVLAGELELAKKMHLYYFSIYLKFGQLPERYNLYTKSIELNGYPLRPEFAESTYYLYRATKDVFYLHVGELLLSNIENHLWTPCGFAAVENLEKYTLSNRMESFFLSETLKYLFLLFDDDNPIHRSHHDFIFTTEGHLFPVTNQTRLSTSQRIYDGGEVCVAEDYDRSKWPMLYSLIASRDDYDYVSHLVGIDNKAIPSYLIDPSGVCKRPEYSDGFELLYGSALVSPIKSVERVTNNVYISDIIGNKLKFVQKEGSNSLFLYTAGAESINENDTVFLTDPDYETFTRPDALYFDRTIAQLENPNSGQKTFGKFLQFDNDNSLPSKVFKTVLLNNSMCQKPSDTLDKDTAYIAPLGNCSWVQQAKNTNKAGLLILITDGEFINPLENIHSQNSLFNWVKPYIPPTILLKNENNFVSKWANVSVRQSDFDAPSYFQGTPVSNLYLCLKCINS

SEQ ID NO: 58545 - DNA, 2406 bp, Drosophila melanogaster
  CDS (1)..(2406)
atgtctaccacatcctccgaatcctttgtccgcggccagcggcttatgctcatcttcctggtggccatgtgcatcgtagttgcctgcgtccttagcaccgaaaccaccatgcccacgcagaacatgtccaataaggagcgggcggaactccgggaagaggctcgcgatatgttctatcatgcatacaacgcctacatgcagaacgcctatccagctgatgagcttatgccgctctcctgcaaaggacggtaccgaggagtgacgccatcacgtggcgacatggacgacatccttggaaatttctccatgactctggtggatactctggacactctggtgctcctgggcgatttcacagagtttgatcacgcggtgaagctagttatccgcgacgttcaattcgacagcgacattattgtgtcggtgtttgagacgaacattcgaatggtcggtggcttgctgtcggcgcacatcctggcggagtatctgcaaaagcatgcggacacgatgcattggtacaagggcgaactgctggagatgtctcgcgagctgggctaccgtttgctaccggcgttcaacacatccacgggcattccgcatgcgcgggttaatctccgcctgggcatgaaggacccgatgctcaagaagtcccgtgaaacgtgtacggcgtgtgctggtaccatccttctggaatttgctgctctgtcgcgtctcaccggcgatcccattttcgaggtgcgagctcacgccgccatggatgcactgtggaagctaaggcaccgtggctccgatctcatgggcacggtacttaatgtccattcgggcgattgggtgcgtcgcgattctggagtcggagctggcatcgacagttactatgagtacctgttcaagtcgtacgtcctactgggtgacgacaagtacctggcacgctttaatcgccactacaacgcagtgatgaagtacgtcagcgaaggacccatgctactcgacgtgctcatgcacaggccacatgctaagtccaaaaacttcatggactcgcttctggcattttggccgggcttgcaggtgctatcgggcgatctgaaaccagctgtgcagacacacgagatgctctatcaggtcatgcagatgcacaccttcattccagaagcatttaccgtcgacttccagatccattggggacagcatcccctgcgaccagaatttatagagtccacttacttcctgtaccgcgccactggcgatcatcattatctgcaggttggcaagaaggctctgaaaacactccagcagcatgctaaggtatcttgcggctatgcggccgtcaatgatgtacggactggcaagcatgaggatcgcatggactcgtttgtgctctccgagacgatcaagtacctcttcctactgttctccgatccccaggatctgatcataaacgtcgatgagttcgtcttcacgaccgaggctcatctgctaccgctctctattgcccaactagggaatgccacgtttagctttcgccagacggacgaacacaacgtactcgacttcatgcgcacctgccccagttcaaataggctttttcctgaaaaagtacgcaaaccactgcgcaacttcattacgggctcgtgccctcgcaccacagcgggaaagcgactcagcgccctggattttcaggcaagcaatgcagatcatcttcgagctgtttacgacatgggcattaccatggtttcggtaggcgaccgcagccaaggcaaggtgcgactgtttcatagtttctataatgccaaaagtcacgaggagggcgaaatgggactgcaatttatgcaggagatgcttgagctgaccaagatgcaaagcataaatcagctagcgcaactgcaggccgttgcctacgccactgacgagaactcacaggattggatcgcactgatggccgggccgtcgcactttagcccagagttaactggcgatcagttcgtcgaaggggacgtgattctggccaagccgctacgagcatgcgatgagagcctagagaacgccgaggaggcgaaaggaaaggtcctggtggccgagcgcggcgattgcacgttcgttagcaaagcgcgactggcccagaaggtgggggcggcggcgctgattgtctgtgataatgttccgggctcttccggtgagacgcagccgatgttcgcaatgtctggcgacggcaaggacgacgtgctcattccagtcgtattcatgtacagcatggagttcggcaaactgtcggcggtcatgcagcgacggaaacaacctctgcgtgttcgcgtcatgcagatggtggagtttaagcggtggcaactggccaaggagcagcgccagaaccaaacagcgtcggtagcacagaaaccggaaaaagaattgtag

SEQ ID NO: 58546 - protein, 801 aa, Drosophila melanogaster
MSTTSSESFVRGQRLMLIFLVAMCIVVACVLSTETTMPTQNMSNKERAELREEARDMFYHAYNAYMQNAYPADELMPLSCKGRYRGVTPSRGDMDDILGNFSMTLVDTLDTLVLLGDFTEFDHAVKLVIRDVQFDSDIIVSVFETNIRMVGGLLSAHILAEYLQKHADTMHWYKGELLEMSRELGYRLLPAFNTSTGIPHARVNLRLGMKDPMLKKSRETCTACAGTILLEFAALSRLTGDPIFEVRAHAAMDALWKLRHRGSDLMGTVLNVHSGDWVRRDSGVGAGIDSYYEYLFKSYVLLGDDKYLARFNRHYNAVMKYVSEGPMLLDVLMHRPHAKSKNFMDSLLAFWPGLQVLSGDLKPAVQTHEMLYQVMQMHTFIPEAFTVDFQIHWGQHPLRPEFIESTYFLYRATGDHHYLQVGKKALKTLQQHAKVSCGYAAVNDVRTGKHEDRMDSFVLSETIKYLFLLFSDPQDLIINVDEFVFTTEAHLLPLSIAQLGNATFSFRQTDEHNVLDFMRTCPSSNRLFPEKVRKPLRNFITGSCPRTTAGKRLSALDFQASNADHLRAVYDMGITMVSVGDRSQGKVRLFHSFYNAKSHEEGEMGLQFMQEMLELTKMQSINQLAQLQAVAYATDENSQDWIALMAGPSHFSPELTGDQFVEGDVILAKPLRACDESLENAEEAKGKVLVAERGDCTFVSKARLAQKVGAAALIVCDNVPGSSGETQPMFAMSGDGKDDVLIPVVFMYSMEFGKLSAVMQRRKQPLRVRVMQMVEFKRWQLAKEQRQNQTASVAQKPEKEL

SEQ ID NO: 58547 - DNA, 2058 bp, Drosophila melanogaster
  CDS (1)..(2058)
atgaaggacggcggtcacataacgctcacactcccgccgggatcagcggcgacgacggacgagcggggcaggaagagcctgcgtcgggcttggaatcagctaccgcgttgtcagcgcaatctcattattctgggcatcaccggattctgcgtgacagtgttgctctgcctaagtggcgatcagctgctggctgccagcttaaaggatgtggacaccaaggccgaggtggcagcatatcaaatgcccctgcccaatccgcaccatcatccgggggtggataaggatgtgcccaaagacactgctgcggtacctgttccggccgataagagagcaccccgggtggaggcggttagtgataagtttaatgagctagttgcctatggagaagcgaactcagcggagaacgtggcccgtctgccggagacggtggctgctgaaggacttccccaggcctcggccatggccgtggccttgcctccccccgatagtaacaaggagcaggacatcggtggaatcgacatcctaaacaatgtagaggagcccgtcgcccaggatccagcagagccgcttagcgagggcgagcagcttgagcaagccatcaagaacccactcactctgggcggcgttagcttcaaagagcatctcaaaaagatcaagcccattctggccaagggccagcacttccatggcgccaccaacgaaagacagtcggctgttgtagccgccttcaagcactcctgggctggctacaagaagtatgcctggggccacgacaacctgaagcccatctcccagtactcccacgagtggttcggtctgggactaaccattgttgactcattggataccatgtacataatgggactggatgatgaattcaaggaaggacgcgactgggtagagcaatcactgcgctttgataccaagcgcgatgtaaacctattcgaggtcaccatacgtgtcctaggcggactgctgtctgcatatcacctgagcggcgatacaatgtttctggccaaggctgcggaacttggcaaccgtttacttcccgcctttcaatcgccgtcaaatatcccctattctgatgtgaatctcggagatctttcggcgcactcgccgaagtggtctcctgatagctccaccagtgaggtcaccaccattcagctagagtttcgtgatttgagtcgctctacaaacatctccatttatgaacaggttgctcacaaagtaaacgagaaggtgcatgatctggagaagaaccatggtttggtgcccatattcattaacgccaacacaggaacattccgaaactacgccactatctcgcttggtgctcgtggggactcctactatgagtacttgctcaaacagtggattcagaccggccgcaaggataatgataaccttattttggactacatgcaagcagtcgatggtgttctaacacaactgatgcggcgcacgccacgcgagcactgggtttacattggcgagctgatcaatggcaaagactttaagccgaaaatggatcaccttacgtgttatctgccgggcactttgattctgggtcaccagaacggaatgccagactcgcaccttatacttgcgagggatttattggacacatgctatcagacctatatgatgaatcccacacatttggctgctgagatctcgtattttgcgctaaccgaaaaggacgatcaggacatttatgtgaagccaaacgatgcccacaacctgttgcgcccggagtttgtggagagtctctattacttctactcaataactggcaatcggacataccaggacatgggatggaaaatcttccaggcgtttgagactcacgctaaagtaaatgcaggctacacatcgatgggaaatgtaaagaacacacagagcacgcgtctgcgcgatctgatggaaagcttttggatgagcgagaccctgaagtacttctacctgctgtttagcgacgaccgcaaggaaatcgacctggagcaatgggtcttcaattcggagggccatccactgccggtctatccgctcaagacttaa

SEQ ID NO: 58548 - protein, 685 aa, Drosophila melanogaster
MKDGGHITLTLPPGSAATTDERGRKSLRRAWNQLPRCQRNLIILGITGFCVTVLLCLSGDQLLAASLKDVDTKAEVAAYQMPLPNPHHHPGVDKDVPKDTAAVPVPADKRAPRVEAVSDKFNELVAYGEANSAENVARLPETVAAEGLPQASAMAVALPPPDSNKEQDIGGIDILNNVEEPVAQDPAEPLSEGEQLEQAIKNPLTLGGVSFKEHLKKIKPILAKGQHFHGATNERQSAVVAAFKHSWAGYKKYAWGHDNLKPISQYSHEWFGLGLTIVDSLDTMYIMGLDDEFKEGRDWVEQSLRFDTKRDVNLFEVTIRVLGGLLSAYHLSGDTMFLAKAAELGNRLLPAFQSPSNIPYSDVNLGDLSAHSPKWSPDSSTSEVTTIQLEFRDLSRSTNISIYEQVAHKVNEKVHDLEKNHGLVPIFINANTGTFRNYATISLGARGDSYYEYLLKQWIQTGRKDNDNLILDYMQAVDGVLTQLMRRTPREHWVYIGELINGKDFKPKMDHLTCYLPGTLILGHQNGMPDSHLILARDLLDTCYQTYMMNPTHLAAEISYFALTEKDDQDIYVKPNDAHNLLRPEFVESLYYFYSITGNRTYQDMGWKIFQAFETHAKVNAGYTSMGNVKNTQSTRLRDLMESFWMSETLKYFYLLFSDDRKEIDLEQWVFNSEGHPLPVYPLKT

SEQ ID NO: 58549 - DNA, 1734 bp, Mus musculus
  CDS (1)..(1734)
atgcctttccggctactcatcccgctcggcctcgtgtgcgtgctgctacccctgcaccatggtgcgccaggccccgacggcaccgcgcccgaccccgcccactacagggagcgagtcaaggccatgttctaccacgcctacgacagttacctggaaaatgcctttccctacgatgagctgagacctctcacctgtgatgggcacgacacctggggcagtttttctctgacgctaattgatgccctggacaccttgctgattttggggaatacctctgaattccaaagagtagtggaggttcttcaggacaatgtggactttgatatcgacgtgaacgcctctgtgttcgaaaccaacatccgagtggtaggaggactcctttctgctcatctcttgtcaaagaaggccggtgtggaggtggaagccgggtggccttgttctgggcctctcctcaggatggcggaggaagcagcccggaaactcctcccagcatttcagacccccacgggcatgccctatggaactgtgaacctgcttcatggcgtgaaccctggagagacccctgttacctgtacagcagggattgggaccttcattgtggaatttgctaccctgagcagcctcaccggtgaccctgtgtttgaagatgtggccagagtggccctgatgcgtctctgggagagccggtcagatatcgggctggttggcaatcacatcgatgtgctcactggcaagtgggtggcccaggatgcaggcatcggggctggtgtggattcctattttgagtacctggtaaaaggagccatccttcttcaggataagaaactcatggccatgttcctagagtacaacaaagccatccggaattacacgcacttcgatgactggtacctctgggtgcagatgtacaaggggaccgtgtcaatgcctgtcttccagtccttggaggcctactggcctggccttcagagccttattggagacattgacaatgccatgaggacctttctcaactactacactgtatggaagcagtttggggggctgccagaattctacaacattcctcagggatacacagtggagaagcgagaaggctacccactccgaccggagctcatcgagagcgcaatgtacctctaccgcgccactggggatcccactctcttagaacttgggagagacgctgtggaatccattgagaaaatcagcaaggtggagtgtggatttgccacgatcaaggacctccgggaccacaagcttgacaaccgcatggagtctttcttcctggctgaaactgtgaaatacctctatcttctgttccacccaaacaacttcatccacaacaatggctccacctttgactctgtgatgactccccatggggagtgcatcctaggagccgggggctacatcttcaacacggaggctcaccccattgaccctgctgccttgcactgctgccggaggctcaaggaggagcagtgggaagtggaggacttgataaaggagttctactccctcaaacagagcaggccaaagagagctcagaggaagacagtgaggtcggggccctgggagccccagtcagggccagccacactcttctcacctgcaaaccagcccagggagaagcagcctgcccggcagcgaaccccgcttctcagctgccccagccagcccttcacctctaagctggcattgctaggccaggttttcctagactcctcatag

SEQ ID NO: 58550 - protein, 577 aa, Mus musculus
MPFRLLIPLGLVCVLLPLHHGAPGPDGTAPDPAHYRERVKAMFYHAYDSYLENAFPYDELRPLTCDGHDTWGSFSLTLIDALDTLLILGNTSEFQRVVEVLQDNVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTHFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFHPNNFIHNNGSTFDSVMTPHGECILGAGGYIFNTEAHPIDPAALHCCRRLKEEQWEVEDLIKEFYSLKQSRPKRAQRKTVRSGPWEPQSGPATLFSPANQPREKQPARQRTPLLSCPSQPFTSKLALLGQVFLDSS

SEQ ID NO: 58551 - DNA, 2949 bp, Drosophila melanogaster
  CDS (1)..(2949)
atgcagcaaaaaccccgaaacaacggctatccgggcaccctcatctgcgcggtcctcctcgtcctgctgtccaccggtgtcagcggccagaagcagtattccaaggcaagaaagttggaactgagggaggatgtgcggcgcatgttccagcacgcctacgatggttacctgcgccacgcctccaactacgatgaactgcgtccgctgacctgcgatggccacgacacctggggcagctactccttgacactgatcgacgctctggacacgctggccaccatgggcaacttcacggaattccgccgcgcggcaagactgctcgaggagaagatggattttgacagggacatcaacgtgtccgtgttcgagacaaacatccgcatcgtgggcgggctgctgtccgcgcatctgctctccaagcgtgctggcgtagagctagagccaggatggccctgcaagggacctctgctgcgactggcggaggatgtggcccgacgattattgccagccttcgtcacgaacacgggtatgccttatggcacggtgaacctgcgctatggcgtgcccaagggcgagacctctataacctgtacggcgggcgtggggacattcctcatcgaatttggtacccttagccggttgaccgggaaaaccatctacgaggatgttgctatgaaggcggtacatgctctatgggcatatcgctcgcccattggactttttggcaatcacatcgacgtgcagagcggtcgttggaccgccctcgactctggtatcggagcaggagtggattccctttttgaatacctagttaaggcatctgtcctgctcaatcgcccagaactcttggagttattccatgaggctcgcgcggccattgataagtacatgcggaaggaggactggtacgtgtgggtaggcatgaacaaaggccgcgtcacccttcccgtctttcagtccctggaggcgttttggcccggcatcctgagcattattggcgacacggagccggccttgcgcaccatatcacggtacattggggtctggaagaagtacggctttctgccagagttttataacattgctgctggagaggcatcgccgaatcgggaggtgtaccccctgcgaccggagctaatcgagtcagctatgtatctctatcgagccacaggaaacgagtatcttctggagtttggtgagcacatgctggagaccttggagttcagtgccaaaaccaaatgcggatatgcaacgattcgcaatgttgtcacccacgaaaaggagaatcgcatggagtcattcttcctggcggaaacaagcaagtacctttatctgctgtttgacgaggaaaacttcctgcacaacgatgggtccggaggcgagctgctgtcaaccgaggatgatgtatgcgtggtacaggccggtgcgtacatcttcaacacagaggctcatcccatggacatgtcagccctccactgttgccacgcccacaacgaggacatctacacctctctggatctacagcggtttagtccacgggcgatattagagaggagcaaaaagcggcaggtagctgttcaggaacagtgggtgccgcagtgtcacccagagaacaacgagttctttaataaagaggatgagagtgtgcaggcgcaggactctgaaaaagagcaggaacgcgagcaatccggcacaagcactaccatggccgtagatattgaggtgttcgacgaatttcaacagcccgccggcgatctgttagtaagcaacttcgagcagatacgcgaggagcgggagctaaacgagagcctgcacagaaacgtggtggcacgaaaccagttgacagtcagcgatttggatgaattctttgctcagcgacgggagagtttcgcaagcgcctccgaggctcttaactatgtaaagaccttcatgggcaactataccatggatgtagcctttatacggggcttgcaactgtacgatactaatatgagtagtgtattgggcacaggcgcccagaaagagtatgagtctcgaatgaggaccctttggcagctgtacgaactgcagcagcaatatgtggccaacatccgagtgattcaaggattaggtttgctaacctttccggcggacggtgaccggatacctagccatttgacagaggtgttggacagcctggataagtcggctcacttggagcatatggatctacaagatctcgaaacaagagtgtccaatacctcctcgccccagttggctcatataagagaagttattctaaaagcacgtaatgcctatgccatagccatggtcaatacttcggccatgcaggaatttgctatccgaatctacctcagtggcacttcggaggccggtgttcgcattcacccacttttggaagacggagaactaagtgaggaagcacgtaaaaggccattaaagttggcggaggagcgagccctcttcagctacgcccgtcgaatagtggactttcggaaacgaatggcggagacagttgatcgattgcagacgctcatgcaggacattccgccacccaaaaggaaagaggccactaccgactctcaggccgcagatgcgtccacagtctacactcaaaccaaagcccagatggcggcgcctgcacagcagccggagccgagccaggaagagaagcagtcgacacaaattcaaaaaggaaagcttgccgaaaacggctccggattgggtgaagaggagtccggctgcgtgtggtcgcagttggtgcagaccatccttcggaagaccacggtgcagcgggtcaaatttgacgaggccgtgctccaggaaaatacgcgcaaggcactggagaagtacgcccgcaaggagttaccccaccatctgttcgcctgccaccggccggagtacattgagggattcgcctatcgggacttttatccggaagcgctgtaa

SEQ ID NO: 58552 - protein, 982 aa, Drosophila melanogaster
MQQKPRNNGYPGTLICAVLLVLLSTGVSGQKQYSKARKLELREDVRRMFQHAYDGYLRHASNYDELRPLTCDGHDTWGSYSLTLIDALDTLATMGNFTEFRRAARLLEEKMDFDRDINVSVFETNIRIVGGLLSAHLLSKRAGVELEPGWPCKGPLLRLAEDVARRLLPAFVTNTGMPYGTVNLRYGVPKGETSITCTAGVGTFLIEFGTLSRLTGKTIYEDVAMKAVHALWAYRSPIGLFGNHIDVQSGRWTALDSGIGAGVDSLFEYLVKASVLLNRPELLELFHEARAAIDKYMRKEDWYVWVGMNKGRVTLPVFQSLEAFWPGILSIIGDTEPALRTISRYIGVWKKYGFLPEFYNIAAGEASPNREVYPLRPELIESAMYLYRATGNEYLLEFGEHMLETLEFSAKTKCGYATIRNVVTHEKENRMESFFLAETSKYLYLLFDEENFLHNDGSGGELLSTEDDVCVVQAGAYIFNTEAHPMDMSALHCCHAHNEDIYTSLDLQRFSPRAILERSKKRQVAVQEQWVPQCHPENNEFFNKEDESVQAQDSEKEQEREQSGTSTTMAVDIEVFDEFQQPAGDLLVSNFEQIREERELNESLHRNVVARNQLTVSDLDEFFAQRRESFASASEALNYVKTFMGNYTMDVAFIRGLQLYDTNMSSVLGTGAQKEYESRMRTLWQLYELQQQYVANIRVIQGLGLLTFPADGDRIPSHLTEVLDSLDKSAHLEHMDLQDLETRVSNTSSPQLAHIREVILKARNAYAIAMVNTSAMQEFAIRIYLSGTSEAGVRIHPLLEDGELSEEARKRPLKLAEERALFSYARRIVDFRKRMAETVDRLQTLMQDIPPPKRKEATTDSQAADASTVYTQTKAQMAAPAQQPEPSQEEKQSTQIQKGKLAENGSGLGEEESGCVWSQLVQTILRKTTVQRVKFDEAVLQENTRKALEKYARKELPHHLFACHRPEYIEGFAYRDFYPEAL

SEQ ID NO: 58553 - DNA, 1614 bp, Oryza sativa (japonica cultivar-group)
  CDS (1)..(1614)
atgcagccggcgctgcgacggcggcggcggcgccaaggcttcctcctccccttcgcctgcctctccgccgccctcatcgccgctgccctgctccccggcgccgctttcgccgatggcgtcacgccctccgaggcccgccggctccgcgacgaggtcaaagatatgttctatcatgcatttgatgggtacatgcaacatgcttttccacttgatgaattgcggcctttaagttgccaaggagaagattcacttggtggctatgcacttactcttatagactctttggataccttggctttactaggggataaggagagatttgatgctgccgtggagtgggttggtaagaatgtccgctttgatattggaatgagaattcaatcttatgatgatcagttgcttcatttagcggctgacttagctcaaagattgctacctgcatttgacactccaacagttttggttgtttatcctctgaacactaatttagttcttatcgccagtctgttattctttgttaaactcactgattgtcacgatgcagtttatgaacgagttacaaaaaactctgtgcgtggaatatgggcacgcaggtcgaaacttgaccttgttggtgcccatataaatgtatttactggtgaatggacacagaaggatgcaggaattggcacaagcattgactcattctatgagtatcttctaaaggtgttagctggagatgttgatcctgccattcgaactcatgctgccttcttcagtgtatggaaaaaatatggcttcaccccagaagggtttaatcttgctacatccactgttcagaatggacaaaggagctacccgctgcggcctgaattgattgaaagcacatattggctgttcaaggctactagagattataggtaccttgatgttggaagggatatattagcaagccttcaatatggtgctaaatgtccatgtggttactgccatatttcagatgtagaaacccaccagcaggatgaccacatggagagttttttccttgcagaaacaataaccttgttagatgagcattgcttgtatgctggagcattctgcaatggtactgcaggccatggatatggtaccggtgatagttctaataagcatcaaaatgcaaactctgttccgttcgatgatagtcgaacaccttccgatcaatctttatccaatattttgtctacgacaagagggtacatcaagggagtttgtccaggattaactcatgcccagaaacttggcatatcatactctgccgaggaggataactcaatacagcagaattctggaagtagtgagaatcttgatgaatcacacgtgatcaaatccagtgtccaagctcaatcaagttctgttatattgatatcgcatccagtcgcaagccaaactgaggagcctacgtcgggcagaagtcagtacaatgcaaacattgtggcaactgctgagtctgtagggactgatactgccggcgcctcatcccaccccgaggatcttgttaaggaaactgagagcgtctctgaacagaaagaaatcaatgacaaagagatcgcttctcagggtagtcaaccgaccgaaggaagatacctgacctaa

SEQ ID NO: 58554 - protein, 537 aa, Oryza sativa (japonica cultivar-group)
MQPALRRRRRRQGFLLPFACLSAALIAAALLPGAAFADGVTPSEARRLRDEVKDMFYHAFDGYMQHAFPLDELRPLSCQGEDSLGGYALTLIDSLDTLALLGDKERFDAAVEWVGKNVRFDIGMRIQSYDDQLLHLAADLAQRLLPAFDTPTVLVVYPLNTNLVLIASLLFFVKLTDCHDAVYERVTKNSVRGIWARRSKLDLVGAHINVFTGEWTQKDAGIGTSIDSFYEYLLKVLAGDVDPAIRTHAAFFSVWKKYGFTPEGFNLATSTVQNGQRSYPLRPELIESTYWLFKATRDYRYLDVGRDILASLQYGAKCPCGYCHISDVETHQQDDHMESFFLAETITLLDEHCLYAGAFCNGTAGHGYGTGDSSNKHQNANSVPFDDSRTPSDQSLSNILSTTRGYIKGVCPGLTHAQKLGISYSAEEDNSIQQNSGSSENLDESHVIKSSVQAQSSSVILISHPVASQTEEPTSGRSQYNANIVATAESVGTDTAGASSHPEDLVKETESVSEQKEINDKEIASQGSQPTEGRYLT

SEQ ID NO: 58555 - DNA, 1575 bp, Danio rerio
  CDS (1)..(1575)
atgcaatggaggtcaatagtcgtgggtctccttgttttaagagtgctgctcaattgcgcggtgtggctcgtgtttggactgggacccagctggggctttgacttccccattaaattcacgttcaactcgcataaaattgaacttttcaatgatggcgaaagagccaccgtgaaaactaacgcctggttgcggcacctttatgacagcagaaaccctcaagcgaagacctgctccaagatcagcgggaattcgccaaagaagtcctacctcagtttctttgaggagggcagagatgagtatgacagaaagtacagctctttcccggacgccctcaaagtcaagatgagggccatggcgcgggacatgttttatttcggatatgataactacatgaagtttgcctttccagaggatgaactgaaccctatagcatgtgaaggtcgagggcctgacgtgctcaatccgtcaaatatcaacatcaatgatgttcttggaaactactctttaactctcatcgatactcttgatacactgttggttctcggaaatgtgaccgaatttcatcgagctgttaaattggtgattgatacagtatcttttgacaaggactccactgttcaagtctttgaggccaacattagaatccttggcagtttgatctcagcccacattctgctgactgacccacggcacccgtttggagatgtaggactgaaagactatgacaatgagctgctacacctggcacatgatcttgccgttcgactactacctgctttcgagaacactagcacaggcatcccttatccaagggtgaatttaaagaatggtgttcctcctgacagcattaatgagacctgtacggcaggggcaggctctctgctcgtggagtttggtattcttagccgtctgattggtgactctacatttgaatgggtcgcccggcgggctgttaaagctctgtggagattaagaagcaatgaaactggactattggggaatgtggttaatattcagactggccagtgggtgggcaagcagagcggtctgggcgccggcatggactcattttatgagtacctcctcaagtcttacatcttgtttggagagaaagaagactttaggatgttcactgcagcctatgagagcattcagagccacctgagaagaggaagagaggcgtgtaatgaaggagaaggtgacccaccactctatgtgaatgtgaacatgttcaacggacagatcatgaacacatggattgactctctgcaggcattcttccctggactacaggttttaaacggagatgttgaaaatgccatttgccttcatgccttctactatgcaatctggaagcgtttcggtgctcttcctgagaggtacaactggcagcttcaggccccagatgtccttttctaccccttaagacctgaactagtggagtccacatacctgctctatcaggcaaccaagaatccattttatcttcatgttgggatggacattcttgaaagccttgaaaaaaaataccaaagtgaggtgtggttacgctactcttcatcatgtagtggataa

SEQ ID NO: 58556 - protein, 524 aa, Danio rerio
MQWRSIVVGLLVLRVLLNCAVWLVFGLGPSWGFDFPIKFTFNSHKIELFNDGERATVKTNAWLRHLYDSRNPQAKTCSKISGNSPKKSYLSFFEEGRDEYDRKYSSFPDALKVKMRAMARDMFYFGYDNYMKFAFPEDELNPIACEGRGPDVLNPSNININDVLGNYSLTLIDTLDTLLVLGNVTEFHRAVKLVIDTVSFDKDSTVQVFEANIRILGSLISAHILLTDPRHPFGDVGLKDYDNELLHLAHDLAVRLLPAFENTSTGIPYPRVNLKNGVPPDSINETCTAGAGSLLVEFGILSRLIGDSTFEWVARRAVKALWRLRSNETGLLGNVVNIQTGQWVGKQSGLGAGMDSFYEYLLKSYILFGEKEDFRMFTAAYESIQSHLRRGREACNEGEGDPPLYVNVNMFNGQIMNTWIDSLQAFFPGLQVLNGDVENAICLHAFYYAIWKRFGALPERYNWQLQAPDVLFYPLRPELVESTYLLYQATKNPFYLHVGMDILESLEKKYQSEVWLRYSSSCSG

SEQ ID NO: 58557 - DNA, 2451 bp, Eremothecium gossypii
  CDS (1)..(2451)
atgaattgggaagacatcttatgtgccatattttgctctttattctttgcagtagttgcagcctcggagctgttttcacccttctccttcaacaaatatgagctagagcattacaaaaacgagatccgctctctcttctatcatggatacgaccaatacctacagcatggatatccatttgatgaggtcaggcccatatcatgcgtccccaacaagcgaaactttcaagatccctacgacatcagtacgaatgatgtcctaggcaacttcacgaccacgcttattgactcattgactaccattgcagtcatgggagacgtagacaaattcctggagggagtagagctggtgaacaaggtaatacctgcagatttttcactaaatgtcacggtgcaggtgtttgagacgacgatcaggcttgttgccggcctcatgtcagcgcatttatatgctgtggaccccaccaagaaagtttacctcggctcgcaatatgatggccacctgctcgccaaggcaaagaagctagcggaccgactacttccggcctatttaacagaaactggtctacccgttccacgcgttaacctagctaacgggctggaaggagttccggaagagctactgcaagaaaacaatgctgctgcaagcgcctcaccgatgcttgagttcacaatgctttcgtatctgacgtttgatgaaaagtatcggctgatcgctcggtatgcctttaacaagacctggtcgcttcggagtgacctcaaccttctcccaatgtcttttaatccgcatacggaagatgtctatcatcctatgactggtgttggggcttcaattgactccttctacgaatatgccataaaaggctccattctttttgacgactctgatctccatagtgtatgggaaacggcatattatgctttatccgtctattcgaaatctgattggttctttcagaacgtccatactgcaaccggtgatattgtaacgccctggatcgattccctgagcatgtttttccctatgctgcaggttttacatggtgacattgcggatgccgaactaaagaaccttatgtctttgaaactctggaacacttacggcggaattcctgaacgctggctattcactactctctacaagaaacagcaagttaccgtaaatgataccgtgcagctcgagtggtatcctttacggccagagtttgtagaatcaacctattccctttacagggccactaaagacgcattttatctgaatatcggacgaagcatcctccaggctctatcaacgcgctttaaaacgaaatgtgggtttgcgggcatacaaaacgtcataacgggagagccacatgataggatggaatcgttcgttttgggcgagaccttaaaatatctctatctcctctttgacgtatccaatgaattgcatacacaaaaacgcactaaccaaatatttagcactgaggcgcatccactgtggttgactgcctcgatgaaggctcgctacgaaaagaacaagtactgtgaaaacgacgtgtatatacagaacttgcgtcgcctacaggagcttgaccagctgaaaagccgtgccaattcatccactgcagaggaagccatgataccagctccagatttcaaaacagaagactccgaggagtctttgaaggaccgcgttgcagcgccaatactagaggcctcacacgtagaatacgaccacgttcgtggaacatgcagacctctccgccgcaacaaatccgccttctatgactcgcacctgctgaaccatttccaccgcctctttgagatcgactaccgttacaatgtcacgctgctgcgtccgcactggatgcgaagccagcacgcgatagagctggcgagcgggtttcctcgccgctggagcacggctgccgcacagtcgcagctggccacgaatacggtctcgctagagctcattttggatggcgcaaaccgcccgctctttcccccgcagtcgacccgtgactgtttctaccgctactttccagccttgcgatgctcccgcctccgggtcgagcgcatcacccccaacgccacatcatcctacgggctgcaagtcgcgccggcagctttctgcggcctgtcctacgaaagcatcgccgggcccgcctgcgaccgtagccttcccgaatttctgctgcttaccgccgtggacggccaggccatcgcacaagaggaagtggttctcgtggactacgaagatcttttcgggcctcacgccctgcatctgaaacacgtactcggctacaatgcgcagcaccaactcctgctcaactgcgttcctgtcgtgaacgtctacgttcagtggagcggccacgccgccaaggcgcactttggcagctgccgaactgctgccttacataatccagcccaagattttcaatgcagccctttacataaccggatagattga

SEQ ID NO: 58558 - protein, 816 aa, Eremothecium gossypii
MNWEDILCAIFCSLFFAVVAASELFSPFSFNKYELEHYKNEIRSLFYHGYDQYLQHGYPFDEVRPISCVPNKRNFQDPYDISTNDVLGNFTTTLIDSLTTIAVMGDVDKFLEGVELVNKVIPADFSLNVTVQVFETTIRLVAGLMSAHLYAVDPTKKVYLGSQYDGHLLAKAKKLADRLLPAYLTETGLPVPRVNLANGLEGVPEELLQENNAAASASPMLEFTMLSYLTFDEKYRLIARYAFNKTWSLRSDLNLLPMSFNPHTEDVYHPMTGVGASIDSFYEYAIKGSILFDDSDLHSVWETAYYALSVYSKSDWFFQNVHTATGDIVTPWIDSLSMFFPMLQVLHGDIADAELKNLMSLKLWNTYGGIPERWLFTTLYKKQQVTVNDTVQLEWYPLRPEFVESTYSLYRATKDAFYLNIGRSILQALSTRFKTKCGFAGIQNVITGEPHDRMESFVLGETLKYLYLLFDVSNELHTQKRTNQIFSTEAHPLWLTASMKARYEKNKYCENDVYIQNLRRLQELDQLKSRANSSTAEEAMIPAPDFKTEDSEESLKDRVAAPILEASHVEYDHVRGTCRPLRRNKSAFYDSHLLNHFHRLFEIDYRYNVTLLRPHWMRSQHAIELASGFPRRWSTAAAQSQLATNTVSLELILDGANRPLFPPQSTRDCFYRYFPALRCSRLRVERITPNATSSYGLQVAPAAFCGLSYESIAGPACDRSLPEFLLLTAVDGQAIAQEEVVLVDYEDLFGPHALHLKHVLGYNAQHQLLLNCVPVVNVYVQWSGHAAKAHFGSCRTAALHNPAQDFQCSPLHNRID

SEQ ID NO: 58559 - DNA, 1785 bp, Xenopus tropicalis
  CDS (1)..(1785)
atgcggtggtgctctgtgctgctggggctgctgcttctgcggcttgggctacacgctctgcggggtcttatcctgcccggaacgtctcctgtagtggtgccgggagtccatgctgtgtgccgagcctcgtatggccgctttgtcctgggagccggggatgagtacggccgccgctacagctctttccctgaggggctgcggaaagaaatgcgggagatggcccgtgggatgttctcattcggctatgacagctacatgaagtacgcctttcccgaggatgagctcaaccccatcctgtgccggggacgcgggccagaccacggagacccttcaaatctaaacatcaatgatgtccttgggaattactccctaaccctgattgatgcactggacactttagcggtgatgggcaatgccactgagtttcacagagctgttcgcttggtgattgacacagtttcctttgataagaattcaacggtgcaagtgtttgaggctactattcggattctaggcagcttactgtcagcccacataatcctaacggacagcaagcagccttttggcaacatgacactaagtggttatgataatgaacttcttcatatggctcgtgacctcgcagttagacttctgcctgcgtttgagaacaccaagacaggcatgccttatcccagggttaatctgaagaagggggtccctccagatagcagaaatgagacctgcactgccggggccggttcactgcttgtggagtttggaatcctaagtcggcttttgggggactccacgtttgagtgggttgctcgccgggctgtcagagccctctggagtttacgaagcaatgataccggcctccttggaaacgtggtgaacatacagactgggcagtgggttggaaaacaaagcggcctgggagctgggttggactcattctttgaatatttgctcaagtctcacatcctgtttggagaggaagaggatttggaaatgtttaatgaggcttacaagagtatccagaaccacctacgcagggggcgtgaagcatgtaatgaaggagagggggacccgccattgtatgtgaatgttaatatgcttaatggtcagctcatgaacacttggattgactcgctgcaggctttcttccccgggctgcaggtcttaaagggagatattgaggatgccatttgcctgcatgctttttattatgccatttggaagcgatatggagctttacctgaacgatacaactggcaactacaggcccctgatgtctccttctaccctctcaggccagagttggtagagtccacatatcttttataccaggccaccaagaaccccttctatctgcatgtgggaatggatattctgttgagcctggagaagcatgctaaggccaagtgtggatatgcaactttacaccatgttgtggacaaatctcaggaggatcggatggagagcttcttcctgagtgaaacttgcaaatacctctacctgctgtttgatgaggataatccgctgcatcgggttgataataagtaccttttcaccactgagggccacctgatcccacttgacccgcgtttgagggacacttcatggcaggacatcttccataataaaaacaaagtgcagcaaacccaggagaaactgtcacagacaaagctcagaactgctaactccagcacaaattgttataaggttccggaagagcgcaggttttcactaccgctgaagagtgtctacatgcgccagattgaccagatggttgggctgttgtaa

SEQ ID NO: 58560 - protein, 594 aa, Xenopus tropicalis
MRWCSVLLGLLLLRLGLHALRGLILPGTSPVVVPGVHAVCRASYGRFVLGAGDEYGRRYSSFPEGLRKEMREMARGMFSFGYDSYMKYAFPEDELNPILCRGRGPDHGDPSNLNINDVLGNYSLTLIDALDTLAVMGNATEFHRAVRLVIDTVSFDKNSTVQVFEATIRILGSLLSAHIILTDSKQPFGNMTLSGYDNELLHMARDLAVRLLPAFENTKTGMPYPRVNLKKGVPPDSRNETCTAGAGSLLVEFGILSRLLGDSTFEWVARRAVRALWSLRSNDTGLLGNVVNIQTGQWVGKQSGLGAGLDSFFEYLLKSHILFGEEEDLEMFNEAYKSIQNHLRRGREACNEGEGDPPLYVNVNMLNGQLMNTWIDSLQAFFPGLQVLKGDIEDAICLHAFYYAIWKRYGALPERYNWQLQAPDVSFYPLRPELVESTYLLYQATKNPFYLHVGMDILLSLEKHAKAKCGYATLHHVVDKSQEDRMESFFLSETCKYLYLLFDEDNPLHRVDNKYLFTTEGHLIPLDPRLRDTSWQDIFHNKNKVQQTQEKLSQTKLRTANSSTNCYKVPEERRFSLPLKSVYMRQIDQMVGLL

SEQ ID NO: 58561 - DNA, 1878 bp, Mus musculus
  CDS (1)..(1878)
atgctggtgaggaaagtgccgggtttcgtcccggcctcgccgtgggggctgcggctgccgcagaagttccttttcctgctcttcctctcgggcctcgtcaccctgtgctttggcgccctgttccttctgccccattcctctcgcctcaagcgcctcttctcggcctcgcggacccaacagcccggcctggaggtgatggccgaaatcgccggtcaccactcggtgtcagagcaggagccgcctcccaaccctgcccctgcggctccggccccgggtgaggacgatcccagccgcctggtcggtgttctccgtaggaaagggtggctgcggcgaacccgccccaccgggccccgggaggaaggcaacagggttgcagccctcaggcctcaggaagagagcgtccggttcactttcgactacaatggtttccgcagccgccttcgacacccggtcttggggacaaggactgatgagagtaaggagtcccagagtctggtgcgagctcagcgagagaaaatcaaagagatgatgcggttttcctggcagaattaccgccgttatgcgatgggcaagaatgagctccggccactcacaaaggacggcttcgagggcagcatgtttggcggtctcagtggggctaccatcatcgattctcttgacaccctctacctcatggagctgaaagaggagttccaggaggccaaggcctgggtgcaagacagcttccacctgaacgtgagtggagaagcatctttgtttgaagtgaacatccggtatatcggaggactgctctcggccttctacctgactggagaagaggtgttccgagtgaaggccatcaagctgggtgagaaactgctgcctgccttcaacacacccacgggcatccccaagggcgtggtcaacttcaaaagcggtagctggggctgggccacggcaggcagcagcagcatcctggccgagtttgggtccctgcacttggaattcctgcatctcactgaactctctggcaatccagtctttgcagaaaaggtcaaacatatccgcaaggtcctcagggagattgacaaacccttcggtctctaccccaacttcctcagccccacgagtggaaactgggtgcagcatcatgtctcggtaggaggacttggggacagtttttatgaatatttgatcaagtcctggttgatgtcagccaaaacagatatggaggctaaaaatatgtactacgaagccttggaggccatagagacctatctcgtgaatgtctctcccgggggcctgacctacattgctgagtggcgtggaggaattctggaccacaagatgggacaccttgcctgcttctcagggggcatgatcgcccttggtgcagatgatgccaaggaagataaaagagcctactaccgagagcttgcagcccagatcaccaggacgtgccatgagtcctatgcccgctcagacaccaagctggggcctgaggccttctggttcaactctggccgagaggcggtggccacacaactgagcgagagctactacatcctgcgccccgaggtggtagagagctacatgtacctatggcggcagacgcatgaccccatctacagggagtggggctgggaggtggtcatggccctggagaaacactgtcggacggaagccggcttctcggggatccaggacgtgtacagcagtaaccccaaccatgacaacaggcaacagagcttcttcctggctgagacgctgaaatacctctatcttctgttctctgaagataacgtgctgtcactggaagactgggtgttcaacaccgaggctcatccgctgcccgtcaaccgctcggacagctttagcatagctggccaccctcactga

SEQ ID NO: 58562 - protein, 625 aa, Mus musculus
MLVRKVPGFVPASPWGLRLPQKFLFLLFLSGLVTLCFGALFLLPHSSRLKRLFSASRTQQPGLEVMAEIAGHHSVSEQEPPPNPAPAAPAPGEDDPSRLVGVLRRKGWLRRTRPTGPREEGNRVAALRPQEESVRFTFDYNGFRSRLRHPVLGTRTDESKESQSLVRAQREKIKEMMRFSWQNYRRYAMGKNELRPLTKDGFEGSMFGGLSGATIIDSLDTLYLMELKEEFQEAKAWVQDSFHLNVSGEASLFEVNIRYIGGLLSAFYLTGEEVFRVKAIKLGEKLLPAFNTPTGIPKGVVNFKSGSWGWATAGSSSILAEFGSLHLEFLHLTELSGNPVFAEKVKHIRKVLREIDKPFGLYPNFLSPTSGNWVQHHVSVGGLGDSFYEYLIKSWLMSAKTDMEAKNMYYEALEAIETYLVNVSPGGLTYIAEWRGGILDHKMGHLACFSGGMIALGADDAKEDKRAYYRELAAQITRTCHESYARSDTKLGPEAFWFNSGREAVATQLSESYYILRPEVVESYMYLWRQTHDPIYREWGWEVVMALEKHCRTEAGFSGIQDVYSSNPNHDNRQQSFFLAETLKYLYLLFSEDNVLSLEDWVFNTEAHPLPVNRSDSFSIAGHPH

SEQ ID NO: 58563 - DNA, 1716 bp, Rattus norvegicus
  CDS (1)..(1716)
atgactaccccagcgctgctgcccctgtctggtcgtaggataccacctctgaacctggggccgccctccttcccacatcacagggctaccttgagactctccgagaagtttatccttctcctcatccttagtgccttcatcaccctgtgttttggggcattcttcttccttccagactcttcaaaacacaaacgctttgatctgggcttagaagatgtgttaattcctcacgtagatgcgggcaaaggggctaaagaccccggagtcttcctgattcatggacccgacgaacacagacacaggttcgtttgtttctcaaattctggtactcccttttgggagagcaagatgatgaaacatgcctgggataattacagaacatacggatggggccataatgagctcagacctattgcaaggaaagggcattccactaacatattcggaagctcacagatgggggccaccatagtggatgctttggataccctttatatcatggggcttcatgatgaattcatggatgggcaaagatggattgaagacaaccttgatttcagtgtgaactcggaagtgtctgtgtttgaagttaacattcgctttattggagggctccttgcagcatattacctgtcaggagaggaaattttcaagactaaagcagtgcagttggctgagaagctccttcctgcctttaacactcctactgggattccttgggcaatggtgaacctgaaaagtggagtaggtcggaactggggctgggcatctgcaggcagcagcatcctggctgaatttggcaccctgcacatggagttcgtgcacctcagctacttgactggtgacctgacttactataataaggtcatgcacatccggaaactactacagaaaatggaacgcccaaatggtctttatccaaattatttaaacccgaggacagggcgctggggtcagtatcacacatcagttggtggcctaggtgacagtttttatgaatacttactaaaagcatggctgatgtcagataaaacagaccacgaggcaagaaggatgtacgacgacgctgttgaggctatagagaaacatcttattaagaagtcccgaggaggtctagtctttattggagaatggaaaaatggacacttggaaaggaagatgggtcatttggcctgctttgctgggggaatgtttgcacttggagcggatggttccagaaaggataaagctggccactatttagaactaggggcagaaattgcacgaacatgccatgagtcatatgacagaactgcattaaaactaggtcctgagtcattcaagtttgatggtgcagtggaagcagtggctgtgcggcaagctgagaagtattacatccttcgtccggaagtgatcgaaacctattggtatctatggcgattcacccacgacccaagatacaggcagtggggctgggaagccgcattggctattgagaagtcctgccgagtcagtggtgggttttctggtgtcaaggatgtctactccccgactcctgcgcacgacgacgtgcagcagagcttttttcttgccgagacgttaaaatacttgtacctgctgttctctggcgatgacctcctacctttagaccactgggtgtttaatacagaggctcatcctctgccggtgttgcgtttagccaacaccactctttcaggtaaccctgctgttcgatga

SEQ ID NO: 58564 - protein, 571 aa, Rattus norvegicus
MTTPALLPLSGRRIPPLNLGPPSFPHHRATLRLSEKFILLLILSAFITLCFGAFFFLPDSSKHKRFDLGLEDVLIPHVDAGKGAKDPGVFLIHGPDEHRHRFVCFSNSGTPFWESKMMKHAWDNYRTYGWGHNELRPIARKGHSTNIFGSSQMGATIVDALDTLYIMGLHDEFMDGQRWIEDNLDFSVNSEVSVFEVNIRFIGGLLAAYYLSGEEIFKTKAVQLAEKLLPAFNTPTGIPWAMVNLKSGVGRNWGWASAGSSILAEFGTLHMEFVHLSYLTGDLTYYNKVMHIRKLLQKMERPNGLYPNYLNPRTGRWGQYHTSVGGLGDSFYEYLLKAWLMSDKTDHEARRMYDDAVEAIEKHLIKKSRGGLVFIGEWKNGHLERKMGHLACFAGGMFALGADGSRKDKAGHYLELGAEIARTCHESYDRTALKLGPESFKFDGAVEAVAVRQAEKYYILRPEVIETYWYLWRFTHDPRYRQWGWEAALAIEKSCRVSGGFSGVKDVYSPTPAHDDVQQSFFLAETLKYLYLLFSGDDLLPLDHWVFNTEAHPLPVLRLANTTLSGNPAVR

SEQ ID NO: 58565 - DNA, 1968 bp, Rattus norvegicus
  CDS (1)..(1968)
atgcccgtggggggcctgttgccactcttcagtagccctgggggcggaggcctgggcggtggcctgggcgggggtcttggcggcgggaggaaggggtctggccccgccgccttccgcctcactgagaagttcgtgctgctgctggtgttcagcgccttcatcacgctctgcttcggggcaatcttcttcctgcctgactcctccaagctgctgagcggggtcctgttccactccaaccctgccttgcagccaccggcggagcacaagcccgggctcggggcgcgtgccgaggatgccgccgaagggagagtccggcaccgcgaggaaggcgtgcctggggaccctggagctggactggaggataacttagccagaatccgtgaaaaccacgagagggctctcagggaagccaaggaaaccctgcagaagctgccagaggagatccaaagagacattctgctggagaaggagaaggtggcccaggaccagctgcgtgacaaggatctgtttgggggcttgcccaaggtggacttcctgccccccatcggggtagagaaccgagagcctgctgacgccaccatccgtgagaagaggtcaaagatcaaagagatgatggcccatgcttggaataattataaacgctatgcgtggggcttgaacgaactgaaaccgatatcaaaagaaggccattcaagcagtttgtttggcaacatcaaaggagctacaatagtagatgccctagatacccttttcattatgggtatgaagactgaatttcaagaagctaaatcatggattaaaaaatacttagattttaatgtgaatgctgaagtttctgtttttgaagtaaacatacgtttcgttggtggattgctgtcagcctactatttgtccggagaggagatatttcgaaagaaagcagtggaacttggggtaaaattgctacctgcatttcatagtccctctggaataccttgggcattgctgaatatgaaaagtgggattggacgtaactggccctgggcctctggaggcagcagtattctggcagaatttggaactctccatttggagttcatgcacttggcccacttatcaggaaatcccgtctttgccgaaaaggtaatgaatattcgaacagtgctgaacaagctggacaaaccagaaggcctttatcctaactacctgaaccccagtagtggacagtggggtcaacatcatgtgtcagttggaggacttggagacagcttttatgaatatttgctcaaggcatggttaatgtctgacaagaccgatctcgaagccaagaagatgtattttgatgctgtccaggccatcgagactcacttgatccgcaagtcaagtgggggactaacgtacatcgcagagtggaaagggggcctcctggagcacaagatgggccacctgacgtgctttgcaggggggatgtttgcacttggggccgacggagctccagaagctcgggcccaacactaccttgaactcggagctgagatcgcccgcacctgtcacgagtcttacaaccgcacatatgtgaagttggggccagaagcgtttcgatttgatggcggcgtggaagccattgccacgaggcaaaatgagaagtattacattctacggccagaggttatcgagacatacatgtacatgtggcgtctgacccatgatcccaagtacaggacctgggcctgggaagccgtagaggccctagaaagccactgtagagtgaacggaggctactcaggcctacgggatgtttacattgcccatgagagttatgacgacgtccagcaaagcttcttcctggcagagacactgaagtatctgtacttgatattttccgacgatgaccttcttccactggaacactggatcttcaacaccgaggctcatcctttccctatactccgtgaccagaagaaagaagttgatgtccaggagaaatga

SEQ ID NO: 58566 - protein, 655 aa, Rattus norvegicus
MPVGGLLPLFSSPGGGGLGGGLGGGLGGGRKGSGPAAFRLTEKFVLLLVFSAFITLCFGAIFFLPDSSKLLSGVLFHSNPALQPPAEHKPGLGARAEDAAEGRVRHREEGVPGDPGAGLEDNLARIRENHERALREAKETLQKLPEEIQRDILLEKEKVAQDQLRDKDLFGGLPKVDFLPPIGVENREPADATIREKRSKIKEMMAHAWNNYKRYAWGLNELKPISKEGHSSSLFGNIKGATIVDALDTLFIMGMKTEFQEAKSWIKKYLDFNVNAEVSVFEVNIRFVGGLLSAYYLSGEEIFRKKAVELGVKLLPAFHSPSGIPWALLNMKSGIGRNWPWASGGSSILAEFGTLHLEFMHLAHLSGNPVFAEKVMNIRTVLNKLDKPEGLYPNYLNPSSGQWGQHHVSVGGLGDSFYEYLLKAWLMSDKTDLEAKKMYFDAVQAIETHLIRKSSGGLTYIAEWKGGLLEHKMGHLTCFAGGMFALGADGAPEARAQHYLELGAEIARTCHESYNRTYVKLGPEAFRFDGGVEAIATRQNEKYYILRPEVIETYMYMWRLTHDPKYRTWAWEAVEALESHCRVNGGYSGLRDVYIAHESYDDVQQSFFLAETLKYLYLIFSDDDLLPLEHWIFNTEAHPFPILRDQKKEVDVQEK

SEQ ID NO: 58567 - DNA, 2271 bp, Rattus norvegicus
  CDS (1)..(2271)
atgtactatggagaaattgacattaataaggactgtgagtctggaggggctggagaatacaaaagctggagggagtccccggccgcgcccctcgaggccgggcccgtgcgaggccaatccggggcgaccggcgggcgaacgcggggccaggcgggccgggcaggtccgcggggcgggggacaatggatcagttcctggtgcgtcacgagggagttccttaaaggggaagtgagcgggctcccggcggacgcgcggggaggccgtcggctggggacgcgcccggcgcttcaaaataatgcccgcggcggccgcgcgaccatgcaatggcgagcgctcgtcctggggctggtgctgctgcgcctcggcctccacgcagtgctctggttggtcttcgggctggggcccagcatgggcttctaccagcggtttccgctcagtttcggcttccagcgcttgagggaccccgacggctcggggccagttggtcctccgggaggcccgtcctggcttcatcggccaaggcgcgggacagaggggcggctcgagaccccgccgggaccagggccgggaccgggcgtgtgcggcccggcgcactggggctatgctttgggcggcggtggctgcggcctggacgagtacgagcggcgctacagcggcgccttcccgccgcagctgcgtgcccagatgcgcgacctggcgcggggcatgttcgtcttcggctatgacaactacatggcgcacgcctttccgcaggacgagctcaaccccatctactgccgcggccgggggcctgacctcggagacccttcaaatctgaacatcaacgatgtactaggaaattactctctgaccctggttgatgccttggatacactcgcaataatgggaaattcatccgagttccagaaagcagtcaagttagtgatcaacaccgtttcatttgacaaagattccaccgtccaagtctttgaggccacgataagggttctgggaagcctcctttctgctcatagaataataactgactccaaacagccctttggtgacatgacaattgaggattatgataacgaattgttgtacatggcccatgacctggctgtgcggcttcttccagcttttgaaaacaccaagacagggatcccctatcctcgggtgaatctgaagacgggtgtccctcctgacagcaataatgagacctgcacagcaggggctggttctctcctggtggaatttgggattctgagccgactgctgggggattccacttttgagtgggttgccagacgagctgtgaaagccctctggaaccttcggagcaacgatacaggattattaggcaatgttgtgaacatccagacaggccattgggttggaaagcagagtggcttgggtgctgggctggattccttctatgaatacctcttgaaatcttacattctttttggagaaaaagaagatctagagatgtttaatgcagcttatcagagcatccagagctacctgcgaagaggccgggaagcctgcaatgaaggagaaggagacccaccgctctacgtcaacgtgaacatgttcagtgggcagctcatgaacacctggattgactctctgcaggctttcttcccggggctgcaggttctgataggggatgtggaagacgccatctgcctacacgccttctactacgccatatggaaacgctatggggccctccctgagcgctataactggcaactgcaggcccctgatgttctcttctaccccctgagaccagagttagtggagtccacatatctcctctaccaggcgaccaagaatcccttctacctccatgtaggaatggacattctgcagagtctcgaaaaatacacaaaagtcaaatgtggatatgccacgctgcaccatgtcatagacaagtctaaagaagaccggatggagagcttcttcctcagcgagacttgcaaatacttgtatctgctgtttgatgaagagaatccagtacacaaatctggaaccagatacatgtttacaactgagggccatatcatatctgtggacaaacgtcttcgggaattgccttggaaggaattcttctctgaagatggggagcgggaccaagaggaaaagtttgtgcacaggcctaagtctcaggagcttagagtcattaactccagttctaattgcaatcgtgttcctgatgagaggagatactccctgcccttaaagagcatctacatgcgccagatcgaccagatggttggcttgatttga

SEQ ID NO: 58568 - protein, 756 aa, Rattus norvegicus
MYYGEIDINKDCESGGAGEYKSWRESPAAPLEAGPVRGQSGATGGRTRGQAGRAGPRGGGQWISSWCVTREFLKGEVSGLPADARGGRRLGTRPALQNNARGGRATMQWRALVLGLVLLRLGLHAVLWLVFGLGPSMGFYQRFPLSFGFQRLRDPDGSGPVGPPGGPSWLHRPRRGTEGRLETPPGPGPGPGVCGPAHWGYALGGGGCGLDEYERRYSGAFPPQLRAQMRDLARGMFVFGYDNYMAHAFPQDELNPIYCRGRGPDLGDPSNLNINDVLGNYSLTLVDALDTLAIMGNSSEFQKAVKLVINTVSFDKDSTVQVFEATIRVLGSLLSAHRIITDSKQPFGDMTIEDYDNELLYMAHDLAVRLLPAFENTKTGIPYPRVNLKTGVPPDSNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQSYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSKEDRMESFFLSETCKYLYLLFDEENPVHKSGTRYMFTTEGHIISVDKRLRELPWKEFFSEDGERDQEEKFVHRPKSQELRVINSSSNCNRVPDERRYSLPLKSIYMRQIDQMVGLI

SEQ ID NO: 58569 - DNA, 1365 bp, Anopheles gambiae str. PEST
  CDS (1)..(1365)
atgggcccaacaaacgacagacagcgggccgtggttgatgccgtactgcattcctggaaagggtacaaggagtacgcctgggggcacgataatttaaagcccatctcgatggggtactccgactggtttgggctcggccttactctggtcgattccctcgatacgctctacattatggatttgcaggacgagtacgatgaagcgcgagcgtgggtcgagaagtacttaaagtttgacattaaccgtgaagtcaacttgtttgaagtaaccatccgtgtcgttggtgggctgttgagtgcgtaccatctgagcggcgatcgtatgtttctcgacaaggccatcgatctcggcaatcggttgttgccgtgcttcgattcaccgtcgggcattccgttttcggacgtgaacattggatcgcttgccgcacatgcgcctaaatggtcgcccgacagttccacgagcgaggtaacgaccatccagctggaatttcgtgacttgtcccgtgcctcccagaatcccgtcttcgaaaaggtggcatcgagagtgaatcttaaaatacacgagctagataaaaacgaaggtttggtgcctatcttcatcaacgctaacacagggcagtttcgcaattttgcaacggtttcgttgggagcgcgcgccgactcgtactacgagtatctgctgaaacaatggcttcagacgggcaaaaaggccgatgactatcttatcgaagactatcaaaagtcgatgcgaggcgttctgaatcagctcgtgcgaacaactccgaacgaaaagcacgtctacatcggcgaattgctcaatgggaaggacttcaagcccaagatggaccatctaacgtgttaccttcccggcacgctgctgctcggctacaagaacggaatgccaaagacgcatctgcgactggcaaccgatctactggaaacgtgctatcaaacgtacatgaagcaaccgacccagctagcaccggaaatatcgtacttcaacgtgaacggcgaatccgagacggacatctacgtgaagacgaacgatgcgcacaatctgctgcgaccggagtttgtcgaaagtctgtactatttctacgccatcactggcaaccgaacgtatcaggacatgggttggacgatctttgaagcgttcaatcgctacaccaaggtaaagaacggctacacttcgatcggtaacgtgaaaaacccgctcaacacgcggccccgcgatatgatggaaagcttctggctgggcgaaacgctcaagtacttctacctgctgttcagcgacgatcggaacgagatcgatctcgacaagtacgtgttcaattccgaggctcatctgcttccgatacgggactag

SEQ ID NO: 58570 - protein, 454 aa, Anopheles gambiae str. PEST
MGPTNDRQRAVVDAVLHSWKGYKEYAWGHDNLKPISMGYSDWFGLGLTLVDSLDTLYIMDLQDEYDEARAWVEKYLKFDINREVNLFEVTIRVVGGLLSAYHLSGDRMFLDKAIDLGNRLLPCFDSPSGIPFSDVNIGSLAAHAPKWSPDSSTSEVTTIQLEFRDLSRASQNPVFEKVASRVNLKIHELDKNEGLVPIFINANTGQFRNFATVSLGARADSYYEYLLKQWLQTGKKADDYLIEDYQKSMRGVLNQLVRTTPNEKHVYIGELLNGKDFKPKMDHLTCYLPGTLLLGYKNGMPKTHLRLATDLLETCYQTYMKQPTQLAPEISYFNVNGESETDIYVKTNDAHNLLRPEFVESLYYFYAITGNRTYQDMGWTIFEAFNRYTKVKNGYTSIGNVKNPLNTRPRDMMESFWLGETLKYFYLLFSDDRNEIDLDKYVFNSEAHLLPIRD

SEQ ID NO: 58571 - DNA, 2019 bp, Anopheles gambiae str. PEST
  CDS (1)..(2019)
atggtctccgtgacgaacccgctgctcgggcggcggtcgttccggtcgcgcgagaagtgcctcatcctgctcgtcctctccacgttcgggttcgtctgcttcggcgggttcttcttcctgccggacaacttcagcgcggaccgggtgctgaaggcgtacaagcagttccagcgggcggggccggaaatcttcataccggcgccgccgcccgcccacggccgcaccggcgaggaggacatccaccggcaggacgaccgggtgaagctggcggaaaagatacggaaggagctgccggacgactttctcgagaagccggacacgggcggcggtggcgaggcgggcgttggcggtgaggaaacggagggcggagagcagcagcaggcgcgggacggtgccggagcgatcgatgagccggcgctgcagccgggtggcgccggtggtgtgggcgttgtggccggcccggccatcgagggcccggccggggtggtgcagccgccccaccagcagcacgccccggaacaggaggaaggccagctgcaggaggtggcgggcggggacaggcgcggcgagaaggcgcgcgccccggccgggctgcactttaacgcgtccgtcggcgaggacccggaccgggccgtgcgggagaagcgcaacaaagtgaaggagatgatggtgcacgcctggagcaactacaagctgtacgcgtggggcaagaacgagctgcggccgctgtcgaagcgcggccacagcaacagcatcttcgggtcgttcgatctcggcgcgacgatcgtggacgggctggacacgctctacctgatgggcctgcacaaggagttcgacgaggggcgggagtgggtcgagcgcaagttcaccctcgacaacgtggacgcggagctgtccgtgttcgagacgaacatacggttcatcgggggcttcctcacctgctacgccttcaccggcgaccggatgttcctggagaaggcgcgctacgtcgcggacaagctgctgcccgccttccagaccccgaccggcatcccgtacgcgctggttaacgtgcacaatggggtgagcaaaaactacggctgggcaagcggcggcagcagcatcctgtccgagttcggcacgctgcacatggagttcgcctacctgagcgacatcaccggcgactcggtgtaccgggagcgggtccagacgatccgggcggtgctgaaggacatcgagaagccgaagggcctgtacccgaactatctcaacccgaagacgggcaagtggggccagcagcacatgtcgctcggtgcgctcggcgacagcttctacgagtacctgctgaaggcgtggatccagtccgggcaggaggactgggaggcgcgcgaaatgtacgacgacgcgatgcaggccatcatcaagcacatggtgcggaacaccccgtccggtctgacgtacgtgtccgacatgaagttcgaccggctcgagcacaagatggaccatctggcgtgctttgcaggtggtctgttcgggctcggcggtacctcgctcaacaatcagtattcccagcagtacatggagatcggcgaggggctgaccaacacgtgccacgagagctacatccgcacgtacacccggctcgggccggaatcgttccgcttcaacgatggcgtcgaggcgaaggcactgaaagcgcaggagaagtactacatcctgcggccggaaacgttcgaaagctacttcatcatgtggcggctgacgcacgaccagaagtaccgcgactggggctgggatgcggtgcaggcactcgagaagcactgccgcacaccgaccggctacaccgggctgaagaacgtctacctcaccgagccggtgaaggacgacgtgcagcagagcttcttcctcgccgaaacgctcaagtacctctatctgctgttttccgacgactcgctgctgccgctggacgattgggtgttcaacacggaggcgcacccgctgccggtcaaggaccggaatccgctgtaccgtccggcgtag

SEQ ID NO: 58572 - protein, 672 aa, Anopheles gambiae str. PEST
MVSVTNPLLGRRSFRSREKCLILLVLSTFGFVCFGGFFFLPDNFSADRVLKAYKQFQRAGPEIFIPAPPPAHGRTGEEDIHRQDDRVKLAEKIRKELPDDFLEKPDTGGGGEAGVGGEETEGGEQQQARDGAGAIDEPALQPGGAGGVGVVAGPAIEGPAGVVQPPHQQHAPEQEEGQLQEVAGGDRRGEKARAPAGLHFNASVGEDPDRAVREKRNKVKEMMVHAWSNYKLYAWGKNELRPLSKRGHSNSIFGSFDLGATIVDGLDTLYLMGLHKEFDEGREWVERKFTLDNVDAELSVFETNIRFIGGFLTCYAFTGDRMFLEKARYVADKLLPAFQTPTGIPYALVNVHNGVSKNYGWASGGSSILSEFGTLHMEFAYLSDITGDSVYRERVQTIRAVLKDIEKPKGLYPNYLNPKTGKWGQQHMSLGALGDSFYEYLLKAWIQSGQEDWEAREMYDDAMQAIIKHMVRNTPSGLTYVSDMKFDRLEHKMDHLACFAGGLFGLGGTSLNNQYSQQYMEIGEGLTNTCHESYIRTYTRLGPESFRFNDGVEAKALKAQEKYYILRPETFESYFIMWRLTHDQKYRDWGWDAVQALEKHCRTPTGYTGLKNVYLTEPVKDDVQQSFFLAETLKYLYLLFSDDSLLPLDDWVFNTEAHPLPVKDRNPLYRPA

SEQ ID NO: 58573 - DNA, 1878 bp, Rattus norvegicus
  CDS (1)..(1878)
atgctggtgaggaaagtgccgggcttcgtcccggcctcgtcgtgggggctgcggttgccgcagaagttcctttttctgctcttcctctcgggcctcgttaccctgtgcttcggtgccctgttcctgctgccccactcctctcgcctcaagcgcctcttctcggcctcgcggacgcagcagcccggcctggaggtgatggccgaaatcgccggccaccactcggtgtcagagcaagagccgcctcccaaccctgcccctgcggctccggccccgggtgaggacgattccggccgcctggtgggtgtcctccgtaggaaagggtggctgcggcgaacccgccccaccgggccccgggaggagggcaacagggtttcagccctccggccgcaggaagagagcgtccggttcagtttcgactacaatagtttccgcagccgccttcgacacccggtcttggggacaaggactgatgagagtcaggagtcccagagtctagtgagagctcagagagagaaaatcaaagagatgatgcggttttcgtggcagagttaccgccgttatgcgatggggaagaacgagcttcggccactcacaaaggacggcttcgagggcagcatgtttggcggtctcagtggggcgaccatcatcgattctctcgacaccctctacctcatggagctgaaagaggagttccaggaggccaaggcctgggtgcaagacagtttccacctgaacgtgagtggagaagcatctttgtttgaagtgcacatccggtatatcggaggactgctctcggccttctacctgacaggagaagaggtgttccgagtgaaggccatcaagctgggtgagaaactgctgcccgccttcaacacacccacgggcatccccaagggcgtggtgaacttcaaaagcggtagctggggctgggccaccgcgggcagcagcagcatcctggcggagtttgggtccctgcacttggaattcttgcatctcactgaactctctggcaatccaatctttgcagaaaaggtcagaaatatccgcaaggtcttcagggagattgacaaacccttcggcctctaccccaacttcctcagcccagtgagcgggaactgggtacagcatcacgtctcagtcgggggacttggggacagtttttatgaatatttgatcaagtcctggttgatgtctgccaaaacagatatggaggctaaaaccatgtactacgaagccttagaggccatagagacctatctggtgaatgtctctccggggggcctgacctacattgctgagtggcgaggaggaattctggaccacaagatgggacaccttgcttgcttctcggggggcatgatcgcccttggtgctgaggatgccaaggaagataaaagggcctactaccgagagcttgcagcccagatcaccaggacctgccacgagtcctacgcccgctcagacaccaagctggggcctgaggccttctggttcaactctggccgagaggcggtggccacacagctgagcgagagctattacatcctgcgacctgaggtggtggagagctacatgtacctgtggcggcagacacacgaccccatctacagggagtggggctgggaggtggtgatggccttggagaaacactgccggacggaaggtggcttctcggggatccaggacgtgtatagcagtaaccccaaccacgacaacaggcaacagagcttcttcctggctgagacactgaaatatctctatcttctgttctctgaagatgatgtgctgtcgctggaagactgggtgttcaacaccgaggctcatccactgcccgtcaaccgctcggacagctccagcgtggctgggcaccgccactga

SEQ ID NO: 58574 - protein, 625 aa, Rattus norvegicus
MLVRKVPGFVPASSWGLRLPQKFLFLLFLSGLVTLCFGALFLLPHSSRLKRLFSASRTQQPGLEVMAEIAGHHSVSEQEPPPNPAPAAPAPGEDDSGRLVGVLRRKGWLRRTRPTGPREEGNRVSALRPQEESVRFSFDYNSFRSRLRHPVLGTRTDESQESQSLVRAQREKIKEMMRFSWQSYRRYAMGKNELRPLTKDGFEGSMFGGLSGATIIDSLDTLYLMELKEEFQEAKAWVQDSFHLNVSGEASLFEVHIRYIGGLLSAFYLTGEEVFRVKAIKLGEKLLPAFNTPTGIPKGVVNFKSGSWGWATAGSSSILAEFGSLHLEFLHLTELSGNPIFAEKVRNIRKVFREIDKPFGLYPNFLSPVSGNWVQHHVSVGGLGDSFYEYLIKSWLMSAKTDMEAKTMYYEALEAIETYLVNVSPGGLTYIAEWRGGILDHKMGHLACFSGGMIALGAEDAKEDKRAYYRELAAQITRTCHESYARSDTKLGPEAFWFNSGREAVATQLSESYYILRPEVVESYMYLWRQTHDPIYREWGWEVVMALEKHCRTEGGFSGIQDVYSSNPNHDNRQQSFFLAETLKYLYLLFSEDDVLSLEDWVFNTEAHPLPVNRSDSSSVAGHRH

SEQ ID NO: 58575 - DNA, 1776 bp, Magnaporthe grisea 70-15
  CDS (1)..(1776)
atggtggccttcttttcgcctcgccgcatgggcaagcgtctaattcttgtcttggcgcttgccctaaccggaaccttcttcctgtcccagatcctcattaccttctcgtcctcgacgccatcccccattggaacggagcagcaaacgtcatggacgtccggctggttccgtcaggactgggcgcgcaggaaggagaagttccccgtgaacaggtccttaatggtccgaccgccatcggggcctccacgacaactgccgcgggtgcagcacaagtttgcagcccctgacgcagaattccggaagctgcaggcaaccaggcaggcggccgtgaaacaagcctttgaaaagtcttggggcagctaccgtcaatacgcctggggatacgatgagctgcgccccgtgacgcttgaaggtcataatagctttgctggctggggagccacgctcgttgacagtctcgactcgctttggatcatgggaatgaaggatgattttgccgaggccgtaaaggctgtccaaaaaatcaactggttcaagtcgagcggtcccatgtgctcactctttgaaactaacattcgctaccttggcgggttactttcggcctatgatttgagccaggaaaaagtgctgcttgacaaggccgtagagctggcacatatgctttacgcagcgtttgacaaccagtacagactgccagtcaatgcattcttttttacagacgcatggaatggagaccttcagctctcgtacagggaagtggccgcagcagtcggttccatgtccctcgaatttaccagagtggctcagctcacgggtgatccaaagttctacgacgccattgacaggatcaaggttcacttgagcatttcccaaaacgagacacgtgtgcctgggctgtggcccatttcctttgatttgcacgacggcttctctgcacaggataccatgttcacacttggtgcgcaggcggactcgctgtatgaatatctgccaaagatgtacgcccttcttggtggactggaccaaacgtatgccactatgcacaaaactgcaatggatgcagccgaaaagcacatactattcagaccgatgatacccgacaaggacgtggacattttgttctccggaaaccttagagcctatgtctctgcaggcgatctccagatgacgcctgaagtccaacatcttggctgctttaccggcggtatgtacgcgctcggaggccgtctgctcaataatgacagccacgtcgagctggggaagcagctggctcgcggctgtgcctgggcatataaggctaccgtctcgggcatcatgcccgaggttgcatccatggtggcatgcgaggagcccaagctgggcaagtgtaaatggaacaagtccatcttcgaggccaagggtggcaagtaccgaaccgaaggaatgcccccggcgttcgcgagcatcacagactaccggtacatattgaggcccgaagccattgagagcgtctttgttctctatcgcatcacgggcgaccagaaatggctggactgggcctgggcaatgtttcagtcgatcaaaaaggccaccgagaccgagaaggcattttccgcaattgcaaatgtattggcgcctgacgctcgcgggaacaaggccaatggaatggagagtttttggttggcagagacgctcaaatacttttacctaatcttctctgacccggacctgataagtctggatgactatgtactcaacacggaagcacaccctttgaagattcccaagcccacatag

SEQ ID NO: 58576 - protein, 591 aa, Magnaporthe grisea 70-15
MVAFFSPRRMGKRLILVLALALTGTFFLSQILITFSSSTPSPIGTEQQTSWTSGWFRQDWARRKEKFPVNRSLMVRPPSGPPRQLPRVQHKFAAPDAEFRKLQATRQAAVKQAFEKSWGSYRQYAWGYDELRPVTLEGHNSFAGWGATLVDSLDSLWIMGMKDDFAEAVKAVQKINWFKSSGPMCSLFETNIRYLGGLLSAYDLSQEKVLLDKAVELAHMLYAAFDNQYRLPVNAFFFTDAWNGDLQLSYREVAAAVGSMSLEFTRVAQLTGDPKFYDAIDRIKVHLSISQNETRVPGLWPISFDLHDGFSAQDTMFTLGAQADSLYEYLPKMYALLGGLDQTYATMHKTAMDAAEKHILFRPMIPDKDVDILFSGNLRAYVSAGDLQMTPEVQHLGCFTGGMYALGGRLLNNDSHVELGKQLARGCAWAYKATVSGIMPEVASMVACEEPKLGKCKWNKSIFEAKGGKYRTEGMPPAFASITDYRYILRPEAIESVFVLYRITGDQKWLDWAWAMFQSIKKATETEKAFSAIANVLAPDARGNKANGMESFWLAETLKYFYLIFSDPDLISLDDYVLNTEAHPLKIPKPT

SEQ ID NO: 58577 - DNA, 3375 bp, Magnaporthe grisea 70-15
  CDS (1)..(3375)
atggaccaaggtcgcagcagcgccatgtccggatgcgtgattctcggcccccgcgccgcaccggtccccgccatccgcctggtgctattgccgctgctgctacttttatcatgttttagtttttgtgagggcatgcggcccgctcagattgcggacctgcgccgggagacggtcgaactgttttatcatggctttgacaactacatggaaattgcctttcccgaggatgagttgcggccagtaacatgcgcacccctcacccgcgatccaaaggatcccaccaatatctctctaaacgacgtcttgggaaactactccctgacccttgttgacagcttgtcaacacttgctatacttgcatctgcacccaaagaggacggcgatgttggcccaaaagcgcttcgtgactttcaggacggcgtcaaggcgttggtggagcaatatggagacggcacagacggcccctcgggccagggtctacgggcccggggctttgatgtcgacagtaaggtgcaagtctttgagactgtcattaggggcgtagggggcctgctcagcgcccatctgtttgctgccggagagctacccatccggggctacgaaccactgccggtttttgagggccaggagcccaaaccgtggcccaatggtatgacctacaatggccagcttttgaggcttgcgaacgacctggccgatcgcctactcccggcattctacacgcagactggtatgccgtatcctcgagtgaacctgcggcacggtattccgttctaccgcaactctcccctgcacgatacctctggtatcaatgacgaaccgaacggtcggggtggcgccccggagatcaccgagacatgtagtgccggagctggaagtctggtgttggagtttaccgtgctgagtcggcttactggcgaccctaaatatgaacaacttgcaaagcgggccttctgggctgtttggtatcggaggagcgacattggcctgataggcgcaggagtggatgccgaacatggcaagtggataggagcctattcggtgattggcgccggcgccgacagcttctttgaatatgcgatgaaaacgcacattcttctctcgggccatgcgcctcccaagaaggcgtcgagtacggattcgacaccaggaaaggggaacaccaacaactccaagaggggccttgatccgaacatactgttcccccctttgacagacgaggagaactcgcctgacagtttcctcgaggcatggcatcacgcgcacgctgcgaccaaacggcacctttacaatgaccgcggccatccacactatgtgagcgtgaacctttggactggctcacttgcatcacaatggatagatagcctgggtgcatactactctggtctcttgacgctcgccggtgagctggacgaagctattgagacaaatctcctctatgcggccgtgtggaccaagtacgccgcgcttcctgaacgctggaatgttagagacaagattgtcgagggaggcctgggctggtggccactacgtcccgagtttgtcgaatcgacctacttcctctatttggcaacaaaagacccttggtatctgcacgttggcgagatggttctgcgcgatgtcacccgtcgttgcaagacgtcttgcggctgggcgggactgcaaaatgtgatagacggggagatgagcgatcgtatggagagtttctttttgggagaaactgcaaagtacatgtacctgatgtacgatgagaaccaccccttgaacaaaatcgatgcgcccttcgtcttcactaccgaaggccatccacttataattcccaaggccaccgaacctggcaagtctcacccaaaagcctctgccacgcgcaagcacaaggcagctgcatcttattacgatccgggcttcaccaactcgtgccctgtgcccaaagcaccgatgccactgacgggttccctgaccgccgcgaggaaagacattttccacgctgcaaagatggtcaatcttcaccagactcctgtccactcgggaagaactgttgtcgaggacacgccaggtcgaaaacgggcgaccaaggagaaccacagtgtgttcccctggactttgccaagccgcctgatcccagaggatggcatttgttcaaaggtgcatgagcccacggagataacgctcgagtttgcgtccaacgcgcaacaagctgtcggtggaagctcgtttaactacatggtcggcacacaaaacctggagcgtctcaccgtcgacaagattcgtgtgctgagcatctcgggtctcaagttgactttacgactagaggatcgtgctgctggaagcagttcgcctacttcttattggcgcatcacaaaggtcaacggcttgcccctgggccgagacgagtcacttgtgctcaacagggctacgctaggtgacgtctcggatccgcgcttcaacatggtgcgggatccggtcgtcgtcaagctgcaccatctgcaccaggtcgaccttgtgtacaatgtcaccgcggcggcggaggcagcagaaggcgaaggcgacgtcgagatcaaggaacggattacgctacagcaaacccaaaccgaaagcggagttccgatggcctccgctgctgtaaatgcacccgatctcggaaacaggatgaagagcttcttccagcagatcatgagctcgctggaggaagccggtgcggaaccgacatacaccccacgatcaggcaatggagtgtccacaaccccaggcaccgccgcgcccccgtacaacgttctgatgaacctcacgggaattacccccacaggcctcggggcggcccccctgccctcggtggacatgccgccaggcgcgcacatcccgcacatgggacctttcaccgccagctacctcccctggtcgaccgtgttcgcggccggggacgcgtgcggcgggcctctgcccgagatggcgccgcgggaccaccacgtgatcgtgatccggaggggcggctgctccttctcgaccaagctggccaacatccccgcgcacaagcggtcttctgcgagcctgcagctcgtcgtggtggtgtcggacgacgacgaagacgacggcttcttccgcgacggtcgcgagggcggcggcatggccgcgcgcgactacgataggatcgtgcgcccgctgctcgacgtcatgcagaccaccccgtcgggcatggtgaggcacaacccgctgtccatgctgcttgtaggtggcggcgacgcggcctaccatcagatctcgcaggcggagaggttggggctgactaggaggtattacatcgagagccacggcgtcagggttagaaatattttgatagatgatggtgatagcggcgagctgacgttgaaggcatag

SEQ ID NO: 58578 - protein, 1124 aa, Magnaporthe grisea 70-15
MDQGRSSAMSGCVILGPRAAPVPAIRLVLLPLLLLLSCFSFCEGMRPAQIADLRRETVELFYHGFDNYMEIAFPEDELRPVTCAPLTRDPKDPTNISLNDVLGNYSLTLVDSLSTLAILASAPKEDGDVGPKALRDFQDGVKALVEQYGDGTDGPSGQGLRARGFDVDSKVQVFETVIRGVGGLLSAHLFAAGELPIRGYEPLPVFEGQEPKPWPNGMTYNGQLLRLANDLADRLLPAFYTQTGMPYPRVNLRHGIPFYRNSPLHDTSGINDEPNGRGGAPEITETCSAGAGSLVLEFTVLSRLTGDPKYEQLAKRAFWAVWYRRSDIGLIGAGVDAEHGKWIGAYSVIGAGADSFFEYAMKTHILLSGHAPPKKASSTDSTPGKGNTNNSKRGLDPNILFPPLTDEENSPDSFLEAWHHAHAATKRHLYNDRGHPHYVSVNLWTGSLASQWIDSLGAYYSGLLTLAGELDEAIETNLLYAAVWTKYAALPERWNVRDKIVEGGLGWWPLRPEFVESTYFLYLATKDPWYLHVGEMVLRDVTRRCKTSCGWAGLQNVIDGEMSDRMESFFLGETAKYMYLMYDENHPLNKIDAPFVFTTEGHPLIIPKATEPGKSHPKASATRKHKAAASYYDPGFTNSCPVPKAPMPLTGSLTAARKDIFHAAKMVNLHQTPVHSGRTVVEDTPGRKRATKENHSVFPWTLPSRLIPEDGICSKVHEPTEITLEFASNAQQAVGGSSFNYMVGTQNLERLTVDKIRVLSISGLKLTLRLEDRAAGSSSPTSYWRITKVNGLPLGRDESLVLNRATLGDVSDPRFNMVRDPVVVKLHHLHQVDLVYNVTAAAEAAEGEGDVEIKERITLQQTQTESGVPMASAAVNAPDLGNRMKSFFQQIMSSLEEAGAEPTYTPRSGNGVSTTPGTAAPPYNVLMNLTGITPTGLGAAPLPSVDMPPGAHIPHMGPFTASYLPWSTVFAAGDACGGPLPEMAPRDHHVIVIRRGGCSFSTKLANIPAHKRSSASLQLVVVVSDDDEDDGFFRDGREGGGMAARDYDRIVRPLLDVMQTTPSGMVRHNPLSMLLVGGGDAAYHQISQAERLGLTRRYYIESHGVRVRNILIDDGDSGELTLKA

SEQ ID NO: 58579 - DNA, 2064 bp, Gibberella zeae PH-1
  CDS (1)..(2064)
atgattcgagatccgttcaacctccaccgaaacataaacacttttaatcgaccgccaactcgaaatattccttcgccatcgcgggtcgaggctgatgaagtagctatggccttctctatgccccgaaccgctccggacttcaatagccgtcaaagagagctcgaagacaaattctggggttctggacagagatctggcaagtcagatcgattaccgatgtacaaagacaaaccctacgcgtcgccatacgacgacgaggaccggccatggtggaaacgtaagaaggtgctgggcatcattgccctcgtctttacgttactatactggttcggatcttcctccaagtcacctaagaagagaaccgtaacgaccgactggagctttgcaggcttgtccaaacatgataagaaggtggattgggatcacagaagagaccgcgtggtggaagcattcgagttgagctgggatgcttacaggcgtcatgcttggggatccgacgaatttcaccctatcaccaagacaggcgagaacatggcaccaaaagggctcggttggatcatcattgactcactggacaccatgatcctgatgaacttgacatctcgccttcaagacgcccgccaatggatctcggagtctttgacgtgggatcaagatcaagatgtgaacaccttcgaaaccaccattcgcatgatgggcggtcttctcagcgcacactacctatccaccgagtttccaggtcttgctccactcgcggaggatgacgagggagccattggggaggacttgtatctggagaaggccaaagatctagctgatcgtctcatgagcgctttcgaatccccttctggtatcccctatgcaagcgtcaatcttcaaaaattccagggtatcgaatcgcacgccgataacggggcgtcgtcgaccgccgaagctacaaccctccaactcgagttcaagtaccttgcaaaactcacgggagagaaggacttttgggatagagttgaaaaggtcatgaaggttgtcgatgaccagggggccgaagacggcttggttcccatcttcatctatgcgagcacaggaaagttcaaggacgaaaacatccgactcgggagccgtggcgactcatactacgaatatcttattaagcagtatctccaaacgaacaagaaggagcctatttatagagatatgtggtacgacgcccttgagggtgtccgcaagcaccttgtcacctacacgtcgaaacagaagttcaccatcatcggagagcgacctaatgggttgagcaatgcccttagccccaagatggatcatcttgtatgcttcatgcccggaacaatggcattggcggccacagagggtctcacggaggccgaggcacgcaagctccctacgtggtcaaagaagaacgaagaagacatgaaattggcgcgtgagttaacggagacatgctggggcatgtacaaatacatggcaactgggctggcagccgaaattacctattttgaaattgatgataaaccaccggcttatggcaaccctcgccaggggccagccaactttgaaccaagcccagaggcggaatggcgtaaagatttcactgtcaagtctggcgatgttcacaatctccaacgaccagagacagttgaaagtctgttctacatgtggagaattaccaacgataaccaataccgtgaatggggctgggaaatgttcaaatctttcatgaaccacacagctgtgaggaacggaggaggttttacgagcttgcgcaacgccaatgtcgtgccacccaaggtgcgcgacaatatggaaagcttttggttggccgaaacgctcaagtacttttacctcttgttctcacccccggatctcctgcctctggacaaggttgttatcaatactgaaggacacccgctgcctcggtttgatatgggacatctgtttacgactggatggcaaagacagccaagggatgccagtggtaagattgccaagatggtcaaaattgatggcgatgtgaaggaggcggtcatgcaggataccaaaaaggtgacttag

SEQ ID NO: 58580 - protein, 687 aa, Gibberella zeae PH-1
MIRDPFNLHRNINTFNRPPTRNIPSPSRVEADEVAMAFSMPRTAPDFNSRQRELEDKFWGSGQRSGKSDRLPMYKDKPYASPYDDEDRPWWKRKKVLGIIALVFTLLYWFGSSSKSPKKRTVTTDWSFAGLSKHDKKVDWDHRRDRVVEAFELSWDAYRRHAWGSDEFHPITKTGENMAPKGLGWIIIDSLDTMILMNLTSRLQDARQWISESLTWDQDQDVNTFETTIRMMGGLLSAHYLSTEFPGLAPLAEDDEGAIGEDLYLEKAKDLADRLMSAFESPSGIPYASVNLQKFQGIESHADNGASSTAEATTLQLEFKYLAKLTGEKDFWDRVEKVMKVVDDQGAEDGLVPIFIYASTGKFKDENIRLGSRGDSYYEYLIKQYLQTNKKEPIYRDMWYDALEGVRKHLVTYTSKQKFTIIGERPNGLSNALSPKMDHLVCFMPGTMALAATEGLTEAEARKLPTWSKKNEEDMKLARELTETCWGMYKYMATGLAAEITYFEIDDKPPAYGNPRQGPANFEPSPEAEWRKDFTVKSGDVHNLQRPETVESLFYMWRITNDNQYREWGWEMFKSFMNHTAVRNGGGFTSLRNANVVPPKVRDNMESFWLAETLKYFYLLFSPPDLLPLDKVVINTEGHPLPRFDMGHLFTTGWQRQPRDASGKIAKMVKIDGDVKEAVMQDTKKVT

SEQ ID NO: 58581 - DNA, 1761 bp, Gibberella zeae PH-1
  CDS (1)..(1761)
atgctggccactttccaagggcgacccggtcgtcgctatattagcctttttcttttcatcgccatcacatggttccttgtccacaactttcgtccctacgaacgttaccgtactgtgagaataggaacgtacaactaccttcctagtagttacgattggagcaagcagcagatcttccaccccgtcgaagacatcaggggccccccgaatggcacattcaagctgctgcccaagattcaaaaagaacgccccaacggttacacagaagacagcgagacgactgctagaaaagcggccatcaagcaggctttcaccaagacctgggaggcctataagaagcatgcgtggggttgggacgagctggcaccagtctccctcaagggaaagaccactttctctggctgggccgcccagattgtcgatgctctcgacactctctggattcttgacatgaaggatgagttcaaagaagctgtccagattgttgccatgatcgattgggcacgtactggtgatagctacctcaacctgtttgaggtagctattcgtcaccttggtggcctcctctctgcttacgagctctctgacgaagctgtcttgctcggtaaggccattgagctaggcgagatgctctacgctgcattcgacacccccaaccgcctgccatctcactggctttacttcaagtctgcgaaaaatggagaacagcaagccgatgaagaaatgtctggcgctgcaggtggttcaatgtgcctcgagttcactcgcctatcccagattactggcaaccccaagtactatgatgccaccgaacgcatcaagaagttcttttatcgtaaccaggacaatactaaaattcctggtttgtggccacatgtcatgaactatcgtgaggaaaacgttgacgacgatcgctttaccctcggagctggcgcggattccctctacgagtacctacccaagatgcacgccttgctaggcggtctagatcctgaatacgttgagatgaccaccaaagctctcgacaccgccactaagaacttgctcttcaaacctcgtaaccctagtgacctggacatactgatgtcaggcaacgcagtgccaggcgaggatggtgccaagcccaagcttactgctgaaatgcagcacttgacatgctttatcggtgggacttatgctctggctggcaagcttgtttcacgagctgatcttgtagacctcggttctcgtttaacagctggttgtgtctgggcatacgatgctttccccaccaatatcatgcctgagattgctgagcttgaagcatgcgagtctatcaccagcaagtgccgctggagtgataagcctgtggagaaaaaggacaagctgcctgagggtttcgtccgagtccgcaactcagaatacagactgcgccccgaggctattgagagtgtcttctacatgtggcgtatcacaggcgacgatgtctggcgcaccgctgcttggcgcatgtgggataacattgtcaagcagactgagactcaggaggcctttgctacaatcactgatgtcaacagaaagggtagcgataagcgcgataacatggagaccttttggatgtccgaaacaattaagtacttctacctcacctttgaggatcccaatgttatcaacctggatgattgggtgcttaataccgaggcacaccccctgaagcgtcccaagggcgaggagctcgagactcctcagaagaagacatcgtggtggaaattcggccattaa

SEQ ID NO: 58582 - protein, 586 aa, Gibberella zeae PH-1
MLATFQGRPGRRYISLFLFIAITWFLVHNFRPYERYRTVRIGTYNYLPSSYDWSKQQIFHPVEDIRGPPNGTFKLLPKIQKERPNGYTEDSETTARKAAIKQAFTKTWEAYKKHAWGWDELAPVSLKGKTTFSGWAAQIVDALDTLWILDMKDEFKEAVQIVAMIDWARTGDSYLNLFEVAIRHLGGLLSAYELSDEAVLLGKAIELGEMLYAAFDTPNRLPSHWLYFKSAKNGEQQADEEMSGAAGGSMCLEFTRLSQITGNPKYYDATERIKKFFYRNQDNTKIPGLWPHVMNYREENVDDDRFTLGAGADSLYEYLPKMHALLGGLDPEYVEMTTKALDTATKNLLFKPRNPSDLDILMSGNAVPGEDGAKPKLTAEMQHLTCFIGGTYALAGKLVSRADLVDLGSRLTAGCVWAYDAFPTNIMPEIAELEACESITSKCRWSDKPVEKKDKLPEGFVRVRNSEYRLRPEAIESVFYMWRITGDDVWRTAAWRMWDNIVKQTETQEAFATITDVNRKGSDKRDNMETFWMSETIKYFYLTFEDPNVINLDDWVLNTEAHPLKRPKGEELETPQKKTSWWKFGH

SEQ ID NO: 58583 - DNA, 1797 bp, Apis mellifera
  CDS (1)..(1797)
atgtttccaccgaaagacttggagaaatcagattatattagtttaaatattcaagaaagtgcaacatttacgcgaggatcatcacgtagtctttggagacaatggaaacaattgtcaaggtttcaaagaaatattctttatttcttagttattacaatcatattagttgtattttatcttttacctggtgataataaaaatggagttttagatgaaagtgactataataacatagaagtagtgcaagatacacttaaatatgaaaaggcagcagaagatattgtagtagatagtataaatcaagaacataaaggaggtggggaggtcattgaggaacctgaattccaaccagaaataaaccaggtggacgatgatcaaattggagaaccacctcaacctaaaccaaatacacttaaatttaatggaccacagaatagtagacaaaaagctatagttgcagcattcaaacattcatggaatggatataaagaatatgcttggggttatgataatataaaaccaatatcaagaaaatattatgaatggtttggtttaggtctcactatagttgattctcttggtactatgtatataatgggtttaaataatgaatttttagaagctaaaatgtgggttgaaaaaaatttagtattttcttcaaatagagatgttaatttatttgaagttacaattagagtattaggaggtctattatctgcatatcatctttcaggtgataagattttcttaaataaagctgtaaaattaggagatcgtttgatgccagcgttttctacttcatctggcgttccttattccgacgtaaatcttggaactaaaactgcacatggtcctaaatggggtcccgatagcagtacaagtgaagttacttcaattcaattagaatttcgtgatttaagtcgcagtacaggagatcctaaattcgaagaagcagtagcaaaagtatcagaacatgtacatcaattagaaaaatatgatggtttagtacccattttcattaatgctaatactggacaatttagagatcattcaacaattacactcggtgcacgcggtgatagttattatgaatatttattgaaacaatggcttcaaacaggaaagactattaattacttacgagatgattatctattaggtatttctggaactcaaaaacacttggtaaagcgtacagcaattaataaatatcttttcatagcagaattagttggagcaaacaaagaaataacaccaaaaatggatcatcttacatgttacttaggaggtactttagctttaggagtacatcatggtttaccacctgatcatatggatcttgctaatgaaattgttaaaacttgttatcaaacatatgcaattcaacccacgttccttgctccagaaattacttattttaatattcagaacacagatggagaaaaatcaatggatatgtatgtaaagatgaatgatgcacataatttactcagaccagaattcattgaaagtattttttatatgtggtattttactgggaataagacttaccaagattggggatggcaaatatttcaagcttttgaaaattatacgaaagtagaaaaaggatacaccagcattggaaacgtgagaattgtttataatacaccacaaaaggatatgacagaaagtttttggtttgctgaaactttaaagtatttgtacttgttatttgacgatacaagacaattaatagatttagatagatgggtatttaattctgaaggacatccattacctatatacgaatcgtaa

SEQ ID NO: 58584 - protein, 598 aa, Apis mellifera
MFPPKDLEKSDYISLNIQESATFTRGSSRSLWRQWKQLSRFQRNILYFLVITIILVVFYLLPGDNKNGVLDESDYNNIEVVQDTLKYEKAAEDIVVDSINQEHKGGGEVIEEPEFQPEINQVDDDQIGEPPQPKPNTLKFNGPQNSRQKAIVAAFKHSWNGYKEYAWGYDNIKPISRKYYEWFGLGLTIVDSLGTMYIMGLNNEFLEAKMWVEKNLVFSSNRDVNLFEVTIRVLGGLLSAYHLSGDKIFLNKAVKLGDRLMPAFSTSSGVPYSDVNLGTKTAHGPKWGPDSSTSEVTSIQLEFRDLSRSTGDPKFEEAVAKVSEHVHQLEKYDGLVPIFINANTGQFRDHSTITLGARGDSYYEYLLKQWLQTGKTINYLRDDYLLGISGTQKHLVKRTAINKYLFIAELVGANKEITPKMDHLTCYLGGTLALGVHHGLPPDHMDLANEIVKTCYQTYAIQPTFLAPEITYFNIQNTDGEKSMDMYVKMNDAHNLLRPEFIESIFYMWYFTGNKTYQDWGWQIFQAFENYTKVEKGYTSIGNVRIVYNTPQKDMTESFWFAETLKYLYLLFDDTRQLIDLDRWVFNSEGHPLPIYES

SEQ ID NO: 58585 - DNA, 2127 bp, Aspergillus nidulans FGSC A4
  CDS (1)..(2127)
atgtcttttccaaatactcacggcagtcccgcataccctacctcacggtccccttcagaaaaatactggcaggccagtcgcagcccgggagccaacgggctagggggttacggtttctcccaatcagccggtgtcacgaacaacctcaacaatttcttctccggtgaccgcaccctgcccatgtacaaggacaaaccgtactttgcgccgcgccgaactggccctaggctcaggcggaggagggttctccaaggcataatccttctgcttggtctttttagtttgtggtatattgttactgggtctagtgatacctaccggtctccctggactcctgatacagttaagggggaggagttatggaggtgggtgcagcgcttggactcagagcagccctatgacggtactccgctgaagggcattgactgggcagcacgacgagagaaggtccgggatgctttcattgtcagctgggatggttacgagcagtatgcctggggctttgacgagtatcatccggtcaccaaaaagggcaaacagatgatcgagggtggaatgggctggcagattgtggatgcactggacacgttgatgatcatgaacttgacatctcgtgtacaacatgcgcgcacatggattcataactcgctacaatatgaccaggatcacgatgtgagcacttttgaaacgacaatacgcatgctcggtggtctgctctctgctcattatctctctacggagtattccaaccttgcccccattcccgacgacgacgttggttccccaggggaggatctctatattgaaaaggcaaccgaccttgcggaaagactacttggggctttcgaatcggaaacaggtattccgtatgccagtgtgaacctcaatacatcgactggtatcccgtcgcattcagaccgcggcgcctcatctacggctgaggccacctccgtacaactggaattcaagtacctagccaaactgacgggcgaggctgagtactggcgcgttgtggagaaggtaatgcaagtggttgacgccaatcaagcccctgatggccttctcccgatctatatctatccagatacgggaacgttcaggggagcgaacattcgcctcggtagcagaggcgactcttattatgagtatcttgttaagcaataccttcagacgtcagaagaaatatacaaggacatgtgggacgaggccctcgtcggaattcgcaaacacctcatcacattttccaagaatgccaagttgactgtcctgggcgagcgacaggccggtcttgacggccctctaaccccgaaaatggaccacctcgcctgcttccttcctggaacaattgctctcggggctacagaaggaatccctctctctgaagccaaaaagtccgccgcatggactcgccgtaaggacgaagaaatcctcctcgccaaagaactcatgaaaacttgctgggcaacctatctagccacccgcaccggcctagcccccgaaattacctacttcgacatcgacaccccgcacgtctccgagctagaccggtatcccgactccacgctcgccgcaggcaacgcggacaagaagcccgcggacaaagatctaccgctgaaatcccaagcgctgtaccctctcgcagactcaaattcagaccctaactcctggcgtcgcgacattatcatccagcctcaggatagacataatctccagcgcccggaaaccatcgaatccctcttctacatgtaccgcatcacgggagacgaaacataccgccactggggatgggaaatgttcaagtcctttatcaagcataccgccgtcgtcgaaaggtcgtctcattatgagaccgagtccggagacgcaacggcataccgcattgtcggcttcacctccctctccaatgtgaactccgagccgcctatgcagcgcgataatatggaaagcttctggatggctgagacgctgaagtatttctatctgctcttttcggaccgcgacttcatctcgcttgaggagaacgtatttaataccgaggctcatccaatgcccagattcaagcctacaggggagttgagtacgggctgggtcaggagtgcgagggtgcctaagtctgtacctgtataa

SEQ ID NO: 58586 - protein, 708 aa, Aspergillus nidulans FGSC A4
MSFPNTHGSPAYPTSRSPSEKYWQASRSPGANGLGGYGFSQSAGVTNNLNNFFSGDRTLPMYKDKPYFAPRRTGPRLRRRRVLQGIILLLGLFSLWYIVTGSSDTYRSPWTPDTVKGEELWRWVQRLDSEQPYDGTPLKGIDWAARREKVRDAFIVSWDGYEQYAWGFDEYHPVTKKGKQMIEGGMGWQIVDALDTLMIMNLTSRVQHARTWIHNSLQYDQDHDVSTFETTIRMLGGLLSAHYLSTEYSNLAPIPDDDVGSPGEDLYIEKATDLAERLLGAFESETGIPYASVNLNTSTGIPSHSDRGASSTAEATSVQLEFKYLAKLTGEAEYWRVVEKVMQVVDANQAPDGLLPIYIYPDTGTFRGANIRLGSRGDSYYEYLVKQYLQTSEEIYKDMWDEALVGIRKHLITFSKNAKLTVLGERQAGLDGPLTPKMDHLACFLPGTIALGATEGIPLSEAKKSAAWTRRKDEEILLAKELMKTCWATYLATRTGLAPEITYFDIDTPHVSELDRYPDSTLAAGNADKKPADKDLPLKSQALYPLADSNSDPNSWRRDIIIQPQDRHNLQRPETIESLFYMYRITGDETYRHWGWEMFKSFIKHTAVVERSSHYETESGDATAYRIVGFTSLSNVNSEPPMQRDNMESFWMAETLKYFYLLFSDRDFISLEENVFNTEAHPMPRFKPTGELSTGWVRSARVPKSVPV

SEQ ID NO: 58587 - DNA, 2028 bp, Gallus gallus
  CDS (1)..(2028)
atgtacgctgccgccgccgccgccgtcgccgcctcgccgcccaggcgggatttcatctccgtcaccctcagcccggaggaggcggtgggcgccggcggctacaacaacagcaaggcctggagacggcgctcctgctggcggaaatggaagcagctgtctcgactacagcggagcataattctcttcctgtttgccttcttgacggtctgcggagtcatttcatatacaagcgtgagggaaccttggaaaagtttaacaagcaaatcatcggacgagcatggaacagaaccagatgcacctggattgaggctggcaaatccagctgtcctaccagcgccccagaaggcagatgccaacgctggagactacccagagctttcacctcagaagaagccaaaattaccacatggtcggcgtaatccttccaattttcagatcaagcccccttggggagatgtgaggctgcaaacccgacatgacaccaggaaggcagtagaagagccagcccaggctgataaacaagagaaaacagagaaatctgttatcagctggagaggagcagtgatagaacctgaccaaagcagtgaacctccatctagtagagtaaaggaaccagaaaaaccttcatctgtggaaggtgaaagccagaaagaaccagtgcccataaacgaacgtcagatggctgtgatagaagccttccgccacgcgtggaaaggatacaaagattttgcctggggccatgatgaactgaagccattatccaagtcttacagtgagtggtttggcctcgggcttaccttgattgatgccttggatactatgtggattttaggcctgagagaagagtttgaagaagcaagaaaatgggtagcaaacgatttagcctttgataaaaatgtggatgtgaacctgtttgagagcactattcgtattctgggtggcttactgagcacctaccatctctctggagatagcctcttcctggaaaaagctaaagacattgggaacaggctcatgccagcattcaagactccttccaaaattccgtactctgacgtcaacattggccggggcaccgcacacccaccccgctggacgtctgacagcactgtggcagaggtgaccagtatacagctggagttcagagagctctctcgtctcactggggatgaaaaataccagaaagctgttgatgaggtgatgaaacatgttcacaccctttcagggaaaaatgatggactggtgcctatgttcataaacaccaacagtgggcagttcactcacttaggtgtttatactatgggagccagagctgacagctactatgagtatttactcaagcagtggattcagggtgggaaaacagaaaatgaactgttggaggactatatgaaagccatagaaggcgtgaaaaagcatcttcttcagagatcacaacccaagaagcttacctttgtaggagagcttgctcatggccatttcagtgccaagatggatcacttggtttgttttctgcctgggactttggctctgggagctcacaatggattgactgctgatcatatgaagctggccgaagccctgatagaaacatgttaccagatgtatgcacaagtagagacaggcctgagtccagagattgtgcacttcaatctccatgcacaaaagggccacaaagatgtagaaatcaagcctgcagacaggcacaacttactgcgaccagaaactgtggaaagccttttttatatgtacagattcaccggagataagaaataccaagactggggctgggaaatcttgcagaacttcaataaatacacacgggttccaacaggtggttatacttctattaacaacgttcagaaccccagtaacccagagccacgagataagatggagagcttctttcttggggaaacactcaaatacatgtttctactgttttcagatgacatagacttaattaatcttgacaaatacgtatttaacacagaagctcatccactccccatctgggtgccagcatag

SEQ ID NO: 58588 - protein, 675 aa, Gallus gallus
MYAAAAAAVAASPPRRDFISVTLSPEEAVGAGGYNNSKAWRRRSCWRKWKQLSRLQRSIILFLFAFLTVCGVISYTSVREPWKSLTSKSSDEHGTEPDAPGLRLANPAVLPAPQKADANAGDYPELSPQKKPKLPHGRRNPSNFQIKPPWGDVRLQTRHDTRKAVEEPAQADKQEKTEKSVISWRGAVIEPDQSSEPPSSRVKEPEKPSSVEGESQKEPVPINERQMAVIEAFRHAWKGYKDFAWGHDELKPLSKSYSEWFGLGLTLIDALDTMWILGLREEFEEARKWVANDLAFDKNVDVNLFESTIRILGGLLSTYHLSGDSLFLEKAKDIGNRLMPAFKTPSKIPYSDVNIGRGTAHPPRWTSDSTVAEVTSIQLEFRELSRLTGDEKYQKAVDEVMKHVHTLSGKNDGLVPMFINTNSGQFTHLGVYTMGARADSYYEYLLKQWIQGGKTENELLEDYMKAIEGVKKHLLQRSQPKKLTFVGELAHGHFSAKMDHLVCFLPGTLALGAHNGLTADHMKLAEALIETCYQMYAQVETGLSPEIVHFNLHAQKGHKDVEIKPADRHNLLRPETVESLFYMYRFTGDKKYQDWGWEILQNFNKYTRVPTGGYTSINNVQNPSNPEPRDKMESFFLGETLKYMFLLFSDDIDLINLDKYVFNTEAHPLPIWVPA

SEQ ID NO: 58589 - DNA, 2430 bp, Candida glabrata CBS138
  CDS (1)..(2430)
atgctgatcactgtcttatggctatgcacattgtgtgtagtactggcgagaccggaattaaattataaagagcggacttttaccaaatgggaattggatgaatacaaagcggaagtcaaagagttaatttattttggactggatgagtatttaggcaaagggtttccttacgacgaaataaggccaataagttgcaaaccaaagacaaggaattttaaggacctttatgatactggaaccaatgatgtgttaggaaatttcacaacgactctaatagactctttgaccacagtggcagttcttggtgatagagacaggtttaagtccttagtcgatttagttgactcaacttacccaaatggatttgatatggattctactgttcaagtctttgaaacaacaattagaataataggtggtttactctcaagtcacttgtacgcaacagacccaagtaagaaggtatatttgggcaaaaaagattataatggttgccttctgaaattggcaaaagacatgggagatagattattgccgtcttacttaaccaagacaggtttgccagttccaagaataaatttgaaatacaaatttcatggaataacaccagacttagtcaacgaaaacaatgctgcagctctaagttgtcctatgtttgagtttacattactttcctatttaacacatgacgctaagtatgaagagatcacgaagtatgctttcaaaaaaacatgggatttaaggtccgaaataggcttagtaccgatgtctttcaatccccaatattcgtattcatttggaggcgtaactggtataggtgcctcaattgattcgttttatgaatacgcactgaaaggttcaatcctatttgatgataattatcttcttgatgtttggcatagttcatacgatgcaataagaactcacgccaaggaagattggtattttaatacaatcggaacgagagacggccataaagccaccaattgggtggattccttgagtgcttttttccccggattgcaagttctggctggaaacattgaggactcggtttaccagcatatgctgtttttgaaattatgggatacttttggtggtattcctgaaagatggatgatggatggaatatatagttttagaccgctagaactgccctggtatccactgcgtccagagtttgttgaatccacttatttcttatatagagccaccaaggatcctttttatctaaatgttggatatcgaatcctccaagatttcaaatttagatttaagaaagagtgtggatttggtggtatgcaggatttaattagtggtgagccacaagatagaatggagacatttgttttgagtgaaacactaaagtacttatacttattatttgatgaagaaaatgaaatacatgccgatagaggtaatatcatttttagtacagaggcccatccgatgtggattacctatgaaatgaaaagagactataatgaaaagaagttcttcactgataaaacctatttggaacacttagaagaggttcaactttttgattgggataaaaaactgagggataataacgaaaagaataaggaattgttgaacaaatatgcagatgtattgaaaagaattaacaagtttagaaataaaaccaaagaggaactttctggcctgatgaaagaaaaaaaggaagaactggaagagaatggcatagttgagtctcacaacgctgaaattggacatagtcaatttaaggacgtgtgtaaggtaagcaaatatcgtcaaaatgatgctgggttttcattttctaatatcatgtcatcatttaaaagaatatcagagccggagaggatattcaacacaacactcataaagcctaattatctagatgattatgcaccatttgagtttgataaacagttctacgataggtggtgtccacgcaatgcatcatcatctcttgctgctacaacattaccatttgatattgttttagaacttccaggacaatatgaattatatcaatacccaaatgggactgttaatgcgatgaagcttggaaacaaaaggaagttacgtcttgaaagaataactcgtggcgatattgacgtgtatggagaatttgttagcgatgcagatttctctggagttaactgggacttagttcgacaaggaaatgctaagtatgaaaatggcactgcactaaagaataataaaagcctctatagagtagtgaagattgatggtgttgttatacctaggaaacaaatgctattcgttaattccacattgttcaaagaggtagtaagtttcgaggaactttatgaagatcctgaaatattgcataagagagacatcttacgtgcatttggtgtcaataaggatggctacttaattttcaatgacaccgttgtaagcaactgtaaaattatttaa

SEQ ID NO: 58590 - protein, 809 aa, Candida glabrata CBS138
MLITVLWLCTLCVVLARPELNYKERTFTKWELDEYKAEVKELIYFGLDEYLGKGFPYDEIRPISCKPKTRNFKDLYDTGTNDVLGNFTTTLIDSLTTVAVLGDRDRFKSLVDLVDSTYPNGFDMDSTVQVFETTIRIIGGLLSSHLYATDPSKKVYLGKKDYNGCLLKLAKDMGDRLLPSYLTKTGLPVPRINLKYKFHGITPDLVNENNAAALSCPMFEFTLLSYLTHDAKYEEITKYAFKKTWDLRSEIGLVPMSFNPQYSYSFGGVTGIGASIDSFYEYALKGSILFDDNYLLDVWHSSYDAIRTHAKEDWYFNTIGTRDGHKATNWVDSLSAFFPGLQVLAGNIEDSVYQHMLFLKLWDTFGGIPERWMMDGIYSFRPLELPWYPLRPEFVESTYFLYRATKDPFYLNVGYRILQDFKFRFKKECGFGGMQDLISGEPQDRMETFVLSETLKYLYLLFDEENEIHADRGNIIFSTEAHPMWITYEMKRDYNEKKFFTDKTYLEHLEEVQLFDWDKKLRDNNEKNKELLNKYADVLKRINKFRNKTKEELSGLMKEKKEELEENGIVESHNAEIGHSQFKDVCKVSKYRQNDAGFSFSNIMSSFKRISEPERIFNTTLIKPNYLDDYAPFEFDKQFYDRWCPRNASSSLAATTLPFDIVLELPGQYELYQYPNGTVNAMKLGNKRKLRLERITRGDIDVYGEFVSDADFSGVNWDLVRQGNAKYENGTALKNNKSLYRVVKIDGVVIPRKQMLFVNSTLFKEVVSFEELYEDPEILHKRDILRAFGVNKDGYLIFNDTVVSNCKII

SEQ ID NO: 58591 - DNA, 2295 bp, Kluyveromyces lactis NRRL Y-1140
  CDS (1)..(2295)
atggaactgaatctcatttctttatggtttttcatatgggtcattctggtaagaactgttgactgttttaaagccgagccgtactctttcaccaagaacgaattgaaccaatataaggaccaagtcaaggagttattctatcatggattcaattcttatttagaatatggatacccgtatgatgaggtactacccatcgcgtgcgttcctatgaaacggagattcgatgatccttacgataccaataccaacgatgtcttgggtaatttcacgaccactttagtcgattcatttacgacactcgctgtattgggcgataagaagggattcgctgatgcaatcaatttatttcataaaacggtgcccgaaacttttgatattgactctacggtgcaattgtttgaaactacaattcgattactcggtgggatgatgtctgcgcatatatatgcaacagacccacgcaccaaggtttacttgggtaaagataactatgatggatttttgctacgaagatgtattgccctaggtgataagttgcttatggcatacctatctcccacaggtttacctgtacccaggataaatctccgttacggtactcggattgatcccaaacttattgaggagaataatgctgctgcgacagcatctccattgtttgaattcaggctgctttcgatgttgacgttgaatgatacttaccgcgaagtctctgaattttcattcaacagaacctgggatcttagatcagaattgaatctcgttccaatgtcgttcagtccatacgataccacgatatacaacgaggttacaggtattggtgcatcgattgattcattttacgaaactgctcttaagggttccatcttattcgatgattcgtggctctatagtgtgtgggaaactgcaatatccgcccttaactcttactcaaagacagattggttctacagtaacgttggagtatctcatggtaaaactgtcgttctttggatagattcgttaagtgctttctttcctggtctactgactttagatggaaggctggaagatgcaaggaagaaacacataatgttttccaaactatggtctacatacggtggtatcccagaaagatggaactttgtgcaatcgccaccgaccaccgaagaattagactcaccctcattgtcgatagatttagaatggtatccattgagaccggagttcattgaatcgacgtattacctttacagagccactaaagacgtttattatttgaatatcggtattcgaattctaaaagatctacagcatcgcttcaagactaggtgtggatttgcggggctacaggatgtgactactggagaagttcaagaccgaatggaatcatttgtcctaggggagacgttgaagtatctgtatttattgttcgatgaggataacgaattgcatacaacgctatggaatcatattttcagtacagaagcgcatccattctggatcgatgtgggtttaaagagacgttacgaatcatacaggagggaagcagacccacctcatgttactacagaaatgtaccagttccatttgctaaaggcgaaaaactggatgagaaggaccaaatctcctaacaggagaattaaccatgctaagaagaaactagatggccaatgtatttctcctgaactggcgtacaccaagagacaatcgaatagacaaggtttccaagattccgacgtgctatccgatccaaaactgtttgaaatagatttcagatatcaggctaccttggaacaacctgcatggaacaaaggatacatacctttcgagctaacaccagaactatactctcattggtctttctcccaacagaaaatttgtctggtcccattgacaaaagcattcgaaggaaccataggaagcagagacccggactcaacactgatatcgacacaccaatggtcttctgacgctcgaatgtaccggttccaatcaatctacggtatcaagatcgctttcctcgattttacatggcacccgaactctattgaagtgcaggaccctaactcgaaattcgatctatatgatgtcttgaacaagcaaaactgtaaacccaaagacgatacaagcatacatacctacacagtaaccgcaatagatggcattgaccttggtgacaacgacgtagtcgttgtcaataaatcaagcctcttcttcgatgactcgagcaaagagagctacatctcgataaatcgcaaatctcaactgctcatcaactgcataccaataactaatatcttcgttttgtaa

SEQ ID NO: 58592 - protein, 764 aa, Kluyveromyces lactis NRRL Y-1140
MELNLISLWFFIWVILVRTVDCFKAEPYSFTKNELNQYKDQVKELFYHGFNSYLEYGYPYDEVLPIACVPMKRRFDDPYDTNTNDVLGNFTTTLVDSFTTLAVLGDKKGFADAINLFHKTVPETFDIDSTVQLFETTIRLLGGMMSAHIYATDPRTKVYLGKDNYDGFLLRRCIALGDKLLMAYLSPTGLPVPRINLRYGTRIDPKLIEENNAAATASPLFEFRLLSMLTLNDTYREVSEFSFNRTWDLRSELNLVPMSFSPYDTTIYNEVTGIGASIDSFYETALKGSILFDDSWLYSVWETAISALNSYSKTDWFYSNVGVSHGKTVVLWIDSLSAFFPGLLTLDGRLEDARKKHIMFSKLWSTYGGIPERWNFVQSPPTTEELDSPSLSIDLEWYPLRPEFIESTYYLYRATKDVYYLNIGIRILKDLQHRFKTRCGFAGLQDVTTGEVQDRMESFVLGETLKYLYLLFDEDNELHTTLWNHIFSTEAHPFWIDVGLKRRYESYRREADPPHVTTEMYQFHLLKAKNWMRRTKSPNRRINHAKKKLDGQCISPELAYTKRQSNRQGFQDSDVLSDPKLFEIDFRYQATLEQPAWNKGYIPFELTPELYSHWSFSQQKICLVPLTKAFEGTIGSRDPDSTLISTHQWSSDARMYRFQSIYGIKIAFLDFTWHPNSIEVQDPNSKFDLYDVLNKQNCKPKDDTSIHTYTVTAIDGIDLGDNDVVVVNKSSLFFDDSSKESYISINRKSQLLINCIPITNIFVL

SEQ ID NO: 58593 - DNA, 2541 bp, Debaryomyces hansenii CBS767
  CDS (1)..(2541)
atgttctatacttcaataaacaatcgaattgcacttgtgacatgtatacttgcgtgtttctgttgcgtgcaatcattgaaataccaatacgaatcatccttcactccaaatcatatacaatatttgaaaaatgagacgagacttctattcaaacatgcatggtcgtcatacatgcaatatggatttccagcagatgaggtattaccggatacgtgtgagccttatggcccagattacaataatgtcgataacgtggtaagaaatgatgctttgggcaatacttctctgacgattctagacaatttggatactttaatgataatggaagaatgggaagagttagagagggctttagaataccttaaatcagaagagaagaccttatttaataaagatacaatagtgcaagtttttgaaactaccattcggtcgttaggtgggcttttatcgacacatctacttttgacagatgttactaaaggcaataaaatattgccatcaagataccaaaaattcaaggaaatatctgataactatgatgggtccttatcaaatatggcatatgatttgggacttaagttacttccagccttcaagacatccacagaaatacccgttcctcggattaatttggcaaaaggggtcttaaaagtaccatcaaatcttcaaaaagaaacttgtacatctggtgctgcgtcgccggttcttgaatttactcttctctcaaagctctcaggagacccgcaatttgaatactattcacaattgacgttttggaaactttggtcttccagactggcgcttgatttaatgccaatgtcaatagatccaattgcaaataaatggaaggatcaaattacaggaataggagcttccgttgattcattttatgagtatgcggctaaggcatctatactatttaatgatgattatatgtggcatgtatttaaaacctcgtataaagcattactagcccacctggtccaaggaggtggagataatgaaggagtgatgatatttggaaatgtaggggttaatgatggctcattggcttctatatggatagatctgctcggtgcattttggtcgggtctacaagtcttgactgggcaattgcaagatgcaattaaaacgcacttgatgtacttaaaattatgggatcattttgacctgattcctgaaagatggaactttttactaaataaatctcaattagagaacgatgattctgaagcgataatgcttgagtggtatccactaaggcccgagtttatcgagtctacatattacttatatagagcgactcgagacccaatgtacctacagatcggagctagagtacttgaattattacaaactaagtacaagacaatttgcggattccatggattacaggacataagaacaggaaattttcagaatagaatggagaccttcgttatgagtgaaacattgaagtatttaatgttattatttgatgctgataatgagatatttcttcatacaagcatgatgagcaataagaactggattttttcaaccgaagcgcatcctatgtggtttgataaacgattagatccatacaacttcacacattccagatctgccgataaacaaaacatgggtacgttgaaaaacctgctttttgctaagatgaagtcaaagtttagtagaagcaagcggaaattgaccactgctgatgaaaagacattctaccgaaacattactacaccacgagtgatcacatacgagatgcccggaataatagaaaatggggatatacacaagatcgatccattggaaagtaagtttgacaaatgtgaagtaaacgtatttaataataagccatcgatgttaacagtatccgggtattaccaattgagctctttcttctatccagatcatgcattcaaatactccctaataaagccacgttatcttctgaaatcggctcttgatggaagctgtgtagaattgacgccgtctttcctcagaatttttgcaatgtcaggacctgataatactaccaaataccatcaccagtgtcctagaacatcgaccactacataccttgaactagttttaggaaatatcgaaaaagcccaaagtgtcgagatttcaagattaaagtataagagaaagcaaccaactgagtatatttctcttcaagaagatgatttatgggttcctgacttttcctcgattagactaaagattgagaaattatcgtctggcttgatcgattccgaaaatatgttaatcactgactcattcatacaatccattagagttgacgattataatgccgagataggaatgtctgccgcgaatcaatctgtttctactacaaaggatatcctgttggtactcagaatcaagaaaatcaacggtatatctgttaagcccggccaggttgtatggacattaccatttgaaattaatacatcaatcataggtgactcatcaattggggttgcaagtgacaatagagtagtattacaaggcaatgtagttgaaaacttgaaggtatggtatggttaa

SEQ ID NO: 58594 - protein, 846 aa, Debaryomyces hansenii CBS767
MFYTSINNRIALVTCILACFCCVQSLKYQYESSFTPNHIQYLKNETRLLFKHAWSSYMQYGFPADEVLPDTCEPYGPDYNNVDNVVRNDALGNTSLTILDNLDTLMIMEEWEELERALEYLKSEEKTLFNKDTIVQVFETTIRSLGGLLSTHLLLTDVTKGNKILPSRYQKFKEISDNYDGSLSNMAYDLGLKLLPAFKTSTEIPVPRINLAKGVLKVPSNLQKETCTSGAASPVLEFTLLSKLSGDPQFEYYSQLTFWKLWSSRLALDLMPMSIDPIANKWKDQITGIGASVDSFYEYAAKASILFNDDYMWHVFKTSYKALLAHLVQGGGDNEGVMIFGNVGVNDGSLASIWIDLLGAFWSGLQVLTGQLQDAIKTHLMYLKLWDHFDLIPERWNFLLNKSQLENDDSEAIMLEWYPLRPEFIESTYYLYRATRDPMYLQIGARVLELLQTKYKTICGFHGLQDIRTGNFQNRMETFVMSETLKYLMLLFDADNEIFLHTSMMSNKNWIFSTEAHPMWFDKRLDPYNFTHSRSADKQNMGTLKNLLFAKMKSKFSRSKRKLTTADEKTFYRNITTPRVITYEMPGIIENGDIHKIDPLESKFDKCEVNVFNNKPSMLTVSGYYQLSSFFYPDHAFKYSLIKPRYLLKSALDGSCVELTPSFLRIFAMSGPDNTTKYHHQCPRTSTTTYLELVLGNIEKAQSVEISRLKYKRKQPTEYISLQEDDLWVPDFSSIRLKIEKLSSGLIDSENMLITDSFIQSIRVDDYNAEIGMSAANQSVSTTKDILLVLRIKKINGISVKPGQVVWTLPFEINTSIIGDSSIGVASDNRVVLQGNVVENLKVWYG

SEQ ID NO: 58595 - DNA, 1773 bp, Debaryomyces hansenii CBS767
  CDS (1)..(1773)
atgctatttaaaggattcatagcgtctttggtattctacgtaatctattactatgcgtctacaggggcacttgactttgaatttggaggaagtagcaaaacttgggctgacaagcaacaggaagtgaaagatgtgtttttggaaagttggagttcatacgagaatcatgcctggggtaaggatgtatatcaccctataaaagaaacgggaagcaacatgggacccaagcctttgggatggatgattgttgattcgttggatacattgatgattatggattgtcctgaacaattggcccgtgccaggaagttcgtcaaggatgacctcgactatcattttgattacaatgtcaatgtatttgaaacgacaattcggatgcttggggggttactctcggcccatcacatttctgaggatgatatgtacttggacaaggccatggacttggcaaatgggttaatgggtggtttcgacagcaacagtgggttgccttatgcttccgtgaacttgatgacgggcgaaggtatcaagaatcatgttgataatggtgcgtcatctacagcagaagtggcaacattgcaattggagttcaaatacttatcgaagttaacaggagagaccttattctgggaaaaagttgaaaaagtgatgaaagttctcgatgaaaataagccgcaagatgggttggtacctatttacgtccaacctgataccgggaaatatcagggtaagttaatcagattgggctccagaggtgattcatactacgaatacttattgaagcagtacttacaaacgaacaaccaggaacctatctattgggacatgtaccgtgaatctgtagatggagtcaaaaagcacttggtaagaaaatcatcgccaaatggattgacctacattggtgaattagagcatggaattggaggtggattatcgccaaaaatggaccacttggtgtgtttctatggtggattattggccgttggggccaccaacgggttgccatacaaagaggctaagaagttaccaaattgggatgctgataaagaatctgacttcaagttgggtgaagaattgacttactcctgctacaagatgtaccacgatgtaccatcgggattatcgcctgaaattgcagtatttaacgaaaaccctcaggttaaaagtgacttctacatcaagccactcgatagacataacttgcaacgtcctgaaaccgtcgaatctttattctacttatatagacttacaggtgacgtcaagtaccgtgaatacggatatgagatcttccagaatttcctcaagcacactaaggtcaccaacgcaaaaggggaggtgtcttacacctctttggatgatgtcacgcaggtccccccaccaaagagagacaatatggaatcgttctggtttgctgagaccttgaaatacttgtacttattattcgacgatactaacaagttccccttggacaaatatgttttcaacacagaagcgcatccatttccaagattcgatttgggtcttttacacaagactgactggaccagagataagccgtatctcaagtctcctcaagccaacttcaagcttcctgaccaaaaaatacaggacactcctaagaatgatccgaaaaatattcctgaagctgcaccagctgataagcccgctatcgaggaggctatgaaggaggctcaaaagaatccagaaatcctaaaagatgcaaaggcagagaagaaggagaagctaaacaaaatgttacaagatcttgattag

SEQ ID NO: 58596 - protein, 590 aa, Debaryomyces hansenii CBS767
MLFKGFIASLVFYVIYYYASTGALDFEFGGSSKTWADKQQEVKDVFLESWSSYENHAWGKDVYHPIKETGSNMGPKPLGWMIVDSLDTLMIMDCPEQLARARKFVKDDLDYHFDYNVNVFETTIRMLGGLLSAHHISEDDMYLDKAMDLANGLMGGFDSNSGLPYASVNLMTGEGIKNHVDNGASSTAEVATLQLEFKYLSKLTGETLFWEKVEKVMKVLDENKPQDGLVPIYVQPDTGKYQGKLIRLGSRGDSYYEYLLKQYLQTNNQEPIYWDMYRESVDGVKKHLVRKSSPNGLTYIGELEHGIGGGLSPKMDHLVCFYGGLLAVGATNGLPYKEAKKLPNWDADKESDFKLGEELTYSCYKMYHDVPSGLSPEIAVFNENPQVKSDFYIKPLDRHNLQRPETVESLFYLYRLTGDVKYREYGYEIFQNFLKHTKVTNAKGEVSYTSLDDVTQVPPPKRDNMESFWFAETLKYLYLLFDDTNKFPLDKYVFNTEAHPFPRFDLGLLHKTDWTRDKPYLKSPQANFKLPDQKIQDTPKNDPKNIPEAAPADKPAIEEAMKEAQKNPEILKDAKAEKKEKLNKMLQDLD

SEQ ID NO: 58597 - DNA, 1719 bp, Oryza sativa (japonica cultivar-group)
  CDS (1)..(1719)
atggctcgtcggtcctcctcctcctcgtcgtcgtcgggggcgtggcggtacctcaacccggcgtattacctcaagcggccgaagcgcctcgccctcctcttcttcgtcttcgtcgccgccaccttcgccttctgggatcgacagtcgctcgtccgcgagtacgagtcagaaatttctcgattggatgataaagtaaatcagttgcgtgaccagttaagaaaggctggagttcatctggatgaaaatccaacaggtgacaaagtatccagagaaaagcttgtagaaattgatcctattaataatgaaaggagagaaaaggttaaggaggctatggcccatgcttggaattcctatgtgaagtatgcctggggaatggatgaacttcagccacaatcaaagaatggtgtcaatagctttggtggtctcggggcaactcttgtggactcacttgatacactgtatataatgggcctaaaggatgaatttcagagggccagagactgggtggccgattcactaagctttgacaaggattacgatgcaagtgtctttgaaacgaccataagagttgttggaggcctcctcagtgcatatgatctatctggtgacaaagtatttcttgagaaggccaaagatattactgaccgtctactacctgcttgggatacaccatctggtatcccttataatagaatcaacctagctcatggacgagcccataatcctggatggaccaatggtgatagtatccttgctgattctggcacggagcaacttgaatttatagctttgtcacagaggactggtgatcccaagtatcaacaaaaggcagagaatgtcatcagacagcttcagaagatatacccaagcgatggcttactccctatatacataaaccctcattcaggaactgcgtcgtactcaacaattacatttggtgcaatgggagatagcttctacgagtacttgctcaaggtttgggtccaggggaataaaactgagcatgtaaagcattacagacaaatgtgggagacatcaatggaaggcctactaagcttgaccaaaaaaactacaccctctaattactactacatttgcgagaagaatggtggttcattgtctgacaagatggatgagcttgcatgttttgcccctggtatgctggcactgggggcctctggctatgaggagactgaaaaggctgaagaaattatgaatcttgcgaaagagcttgctcggacctgttataacttctaccaaacaactcctacaaagttggctggggagaattattttttccatactggacaggatatgaacgtgggcacatcatggaatatcctgagacctgagactgtcgaatcacttatgtacttgtggcgtcttacggggaacaaaacataccaagactgggggtgggacatattccaggcatttgaaaagaactcccgcatagaatctggttacgttgggctgagagatgtgaatactggcgagaaggataacatgatgcaaagcttcttcctagcagagactctcaagtacctatacctcctgttctctcctccatcagtcatatccttcgatgagtgggtcttcaataccgaagcccacccattgcgaattgttcctttaaatgacaatagcaaagcccactcagtaggcattgcaacaccgacggtacgaccgttcgggaggaagcaggggaaacaagagtag

SEQ ID NO: 58598 - protein, 572 aa, Oryza sativa (japonica cultivar-group)
MARRSSSSSSSSGAWRYLNPAYYLKRPKRLALLFFVFVAATFAFWDRQSLVREYESEISRLDDKVNQLRDQLRKAGVHLDENPTGDKVSREKLVEIDPINNERREKVKEAMAHAWNSYVKYAWGMDELQPQSKNGVNSFGGLGATLVDSLDTLYIMGLKDEFQRARDWVADSLSFDKDYDASVFETTIRVVGGLLSAYDLSGDKVFLEKAKDITDRLLPAWDTPSGIPYNRINLAHGRAHNPGWTNGDSILADSGTEQLEFIALSQRTGDPKYQQKAENVIRQLQKIYPSDGLLPIYINPHSGTASYSTITFGAMGDSFYEYLLKVWVQGNKTEHVKHYRQMWETSMEGLLSLTKKTTPSNYYYICEKNGGSLSDKMDELACFAPGMLALGASGYEETEKAEEIMNLAKELARTCYNFYQTTPTKLAGENYFFHTGQDMNVGTSWNILRPETVESLMYLWRLTGNKTYQDWGWDIFQAFEKNSRIESGYVGLRDVNTGEKDNMMQSFFLAETLKYLYLLFSPPSVISFDEWVFNTEAHPLRIVPLNDNSKAHSVGIATPTVRPFGRKQGKQE

SEQ ID NO: 58599 - DNA, 2106 bp, Oryza sativa (japonica cultivar-group)
  CDS (1)..(2106)
atgagcggcggcggcggcggctcgggccccctcccctactcgatgcgcgatgtggacggccgcggcgcctacaacaacgccaagttccgccaccgatctcgcctcaaggttttgctccctcccgatccccttccacccctcccatttctttccccgcgaggagatgtagaaggtgtggaatctggttggcttgagggattcatggctccccgatctgtgggtttagctgctgccgaattagttcttggtcatgtccgtgggcgtctgcgccttaggatggcctctcaggctctgtttaccaatagcagcaagtaccaatgtggaaagttcactgttggaaaatttttgagtcttttaatggtttctggcgtaatatacttacttgtgcacaaaagttcggatggttttgtatccggtgagctccatgaaaaagtagggaatacacataccaagaaagattttcccaaaattcgtacattttggagaaagccaccaaggctgccgccacgtcttcctccaaatgaaatctatagaaacaattcattgcttctacagtctcctcaatctgaatggacactcagacagaagaaagttaaagaagcatttgaacatgcatggtctggctatcgaaattatgcaatgggttatgatgagcttatgcctttaacccgccgaggtatagatggactaggaggtctaggcgctactgttgtagattctttagacactgcaataataatgggtgctgatgatgttgtttccgaagcatcaaaatggattgaagataatctcatgaaaaagttaagtgagaaagggcaggtcaatctatttgaaactactatccgtgtcttgggagggcttcttagtgcctatcacttgagtggtggtgacaaagcaagaggtgactctgggataccaatgacatctaaaagggctaatccggagcgtcttttggaagtttcaaaggacttggcagacagattattgttagcctttacatcaagcccaactgctatacctttaagtgatgttgttcttcgagatcgaactgcacatgcagcccctgatggtttaagcagtacctctgaggctacaacattgcagctggagtacagttaccttagcacaatatcaggagatccaaagtatgacttagaggcaatgaaagtgttagagcatatgcgaacactcccaacagtggagggtttggttcctatttacatcaatccctcctctggtcaatttagtggagaaaatattcgattaggatctcgtggtgacagttactatgaatacctattgaaagtatgggttcagcaagaaagatatcgtgacactagtttgaagtatctatttgaaatgtatacagaagcaatgaaaggggtcaagcatcttcttgttcgaaaaactattccaaatgggctggtcttcgttggggagctcccctatggacgaaatagtggttttagccctaaaatggatcacctggtgtgttttcttcctggtacccttgctctgggtgcaacgaagggtataaccaagaaaaaagctcttgaaaatcatttattgactgcggaagacatagacaatctgcagcttgctgaagatttggccaaaacttgtgttgaaatgtactttgtgacatctactggacttgctcctgaaattgcttattttcacattgagggtaattctgagggaggacctgatggtgggaacaaaagttctcaatatgttaatgatatcataatcaaacctctggatcgtcacaatcttttacgcccagagactgtagaatcactatttgttttatatagaatcacagaggatccgaagtatagggaatggggttggcagatttttcaggcttttgagaagtatacaagagttgattctggtggctatacttcattggatgatgtcacaagcttgcccccacctaggagagacaaaatggaaactttcttccttggagaaacactgaaatacttgtatttgctgtttggtgaaagcaatattcttccattagataagtatgtattcaacacagaggcccatccacttccaatcattcagtctgcacaacagatctctcattcggtatag

SEQ ID NO: 58600 - protein, 701 aa, Oryza sativa (japonica cultivar-group)
MSGGGGGSGPLPYSMRDVDGRGAYNNAKFRHRSRLKVLLPPDPLPPLPFLSPRGDVEGVESGWLEGFMAPRSVGLAAAELVLGHVRGRLRLRMASQALFTNSSKYQCGKFTVGKFLSLLMVSGVIYLLVHKSSDGFVSGELHEKVGNTHTKKDFPKIRTFWRKPPRLPPRLPPNEIYRNNSLLLQSPQSEWTLRQKKVKEAFEHAWSGYRNYAMGYDELMPLTRRGIDGLGGLGATVVDSLDTAIIMGADDVVSEASKWIEDNLMKKLSEKGQVNLFETTIRVLGGLLSAYHLSGGDKARGDSGIPMTSKRANPERLLEVSKDLADRLLLAFTSSPTAIPLSDVVLRDRTAHAAPDGLSSTSEATTLQLEYSYLSTISGDPKYDLEAMKVLEHMRTLPTVEGLVPIYINPSSGQFSGENIRLGSRGDSYYEYLLKVWVQQERYRDTSLKYLFEMYTEAMKGVKHLLVRKTIPNGLVFVGELPYGRNSGFSPKMDHLVCFLPGTLALGATKGITKKKALENHLLTAEDIDNLQLAEDLAKTCVEMYFVTSTGLAPEIAYFHIEGNSEGGPDGGNKSSQYVNDIIIKPLDRHNLLRPETVESLFVLYRITEDPKYREWGWQIFQAFEKYTRVDSGGYTSLDDVTSLPPPRRDKMETFFLGETLKYLYLLFGESNILPLDKYVFNTEAHPLPIIQSAQQISHSV

SEQ ID NO: 58601 - DNA, 2067 bp, Yarrowia lipolytica CLIB99
  CDS (1)..(2067)
atgaaatggtggcttctgacgccggttctggcgtttgatttcagccgtgggtcgctccatgcgctgcgcaacgagagcgagacgctcttcgaccacgcctacaattcctacatgctccatgggttcccgcatgacgaggttcgaccaattgcatgcgagggggtcacgcgagacaaggacgagacgaatctgggtcgcaacgatcttatgggcgggtggccggtgactcttatcgacacgctggacacgctggcggtgatgggccgcaaagccgagttcgaacagggcgtttcgcaggttctgcaacacgtcaagaactttgactacgacgccacggtgcaggtgtttgaaacgaccatcagaacattgggaggtcttctggcggctcatacgtacgcctcatcaccggacctgggcatgcagatacaaaactacggcggagaactgctaactctggcgacagatctgggagatcgactgctgttggcgttcgaaggggtcgatcatggaatcccgcaccctcgagtcaacttgcgacgaggtatcagaccggtgggaggcaagtacatcaccgacgcctgtgcagccggaggagggtctttgctgctcgagtttggactactgtcaaagctgactcgagacccaaaatacattgatgcggcggagaaatccttcttcgccatctgggaactgcgatcggacagagacctgcttcctatgggcatagaccaggacacactgcgcattacctcggccatgagcggggtcggcgcctcggcagactcctactacgagtatgccctcaagtggtacctcatgtctggagacgagcggttctgggaggtgtactcgcgatcaagacgggccatcgatacctggaacacccatccggacacatggcatcattacaatgtgcactatgtgactggcgaaggcgtggcgccctggatcgattctctcagtgccttcttccctactctggacgtgcttaccggcaatctcaagcgggccatcaggacccatctcacccatatgaagctgtggaacacttatgccggcattcctgaacgctggcggttcacagacgcccaggtcgatctggagtggtaccctctacggcccgagctcatagagtcgacttactacctctaccgagctacccgagacgtcttctatctgcaatgtggacgtaagatcatgtccgatctcaatctgcgtaacaaggtggaatgtgggtatgcaggcacccagaacgtcaagaccggcgaactggcggaccggatggagtcgtttttcatgtctgaaactgcaaagtatctctacctgctgtttgacaccgacaacggcctcaacaacgactcgcgacagttcatctggagcaccgagggccatcctctttactttgacgatagggtgctttccaattcgtactctgagaagctccctcgtgagccctccaagggtctggaagacgtgaatggtacggctctcatctgtcccaaattcaaccatcccacaggccccttttctctcataggcgcatggccacacatgtacgatctcaatgctcggtataagtacgagaagccctggtatctgcgtcccattctaaaccggccgtggtcgactctgctgcgaaagctccgaaacgacggcacgtcagtcgtcaaaaagggcatgatggcagatgctgaaatggagcctgggttctacgagcgctatgtggctggcaccagacccacatgcgccgccattctcgacggagacatgcatgacgtgtcgtttggaagcgacaccaccagtgtttatcccccgctgtaccaggagcccgattccaagacgggctatctggagtttgagtctctggatggagtcaagttgacgcttgtggcgcgcgacaatcacttttggctgctcaacatcaatggagtgggctgttccggagccaacgtggactggtattacaatgtgcccaacaacgtgatcaacatcaacaaggctaccggcctgttgaactttcggggtcgcgatgtgcccaacatcaaaatcggcaagatcatttcgtga

SEQ ID NO: 58602 - protein, 688 aa, Yarrowia lipolytica CLIB99
MKWWLLTPVLAFDFSRGSLHALRNESETLFDHAYNSYMLHGFPHDEVRPIACEGVTRDKDETNLGRNDLMGGWPVTLIDTLDTLAVMGRKAEFEQGVSQVLQHVKNFDYDATVQVFETTIRTLGGLLAAHTYASSPDLGMQIQNYGGELLTLATDLGDRLLLAFEGVDHGIPHPRVNLRRGIRPVGGKYITDACAAGGGSLLLEFGLLSKLTRDPKYIDAAEKSFFAIWELRSDRDLLPMGIDQDTLRITSAMSGVGASADSYYEYALKWYLMSGDERFWEVYSRSRRAIDTWNTHPDTWHHYNVHYVTGEGVAPWIDSLSAFFPTLDVLTGNLKRAIRTHLTHMKLWNTYAGIPERWRFTDAQVDLEWYPLRPELIESTYYLYRATRDVFYLQCGRKIMSDLNLRNKVECGYAGTQNVKTGELADRMESFFMSETAKYLYLLFDTDNGLNNDSRQFIWSTEGHPLYFDDRVLSNSYSEKLPREPSKGLEDVNGTALICPKFNHPTGPFSLIGAWPHMYDLNARYKYEKPWYLRPILNRPWSTLLRKLRNDGTSVVKKGMMADAEMEPGFYERYVAGTRPTCAAILDGDMHDVSFGSDTTSVYPPLYQEPDSKTGYLEFESLDGVKLTLVARDNHFWLLNINGVGCSGANVDWYYNVPNNVININKATGLLNFRGRDVPNIKIGKIIS

SEQ ID NO: 58603 - DNA, 1890 bp, Yarrowia lipolytica CLIB99
  CDS (1)..(1890)
atgagcttcaacattcccaaaaccacgccgaatttctcagccaaagcgcggaaactcgaagatcaactgtggcaagctagtgggctcgaaaaatctaaggactccacgttgccgctatacaaagacaagccgtatggagaggggtttgtggcccggaccacctctggccgccgaagacgcaacatcatctacggagtggtggtaggtcttctgttctgggcgatctacaccttctcgcgctccctggacggaaatgtgtctctgaaggacggaatcaaggactatgagttcaagggatggaagggacgaggcaagcccaaaaccaattgggtagcggaacagaatgccgtgaagcaggcctttgtcgacagttggaacggctatcacaagtacgcctggggcaaggatgtgtacaagccccagaccaagactggcaagaacatgggacccaagcctctgggctggttcattgtggactctctggactctctgatgctcatggggctggagaaggaactggctgaagctcgatactgggtcgacaaggatctggactacaacatagactacgaagtcaacacttttgagacgacaattcggatgctgggaggtctgctttcggcacactacctctccaaggacgacttgtaccttgacaaggctgtgaatcttggaaaccgacttctaggtgcctttgacagcgaatctggagtgccttatgcttctgtcaacctcaagacccgaaagggagtcaaaagtcacgcagatggaggagcttccagtaccgccgaggcggccactgtccaactggagttcaagtacctctccaaactcaccggagaggctctgtactgggagactgctgagaaggtgatgaaggttatggaggctaacaaggctgaggagggtctggttcccattttcatccagccggatactggcaagttccagggcaaccagattcggctcggctcgcgcggcgactcgtactacgagtatctcatcaagcaatatctgcagaccgaaaagcgggaggaaatctaccgagacatgtacgaggaggctgtggacggaatcaagcaccatatggtgaaacagagcgtccctggcgatctggcgttcattggcgagcttgaccggggtattagtggccccttctccaccaaaatggaccatctggtctgttttgcaggcggtatgtttgctctgggtgccaccgaaggatacactcaaaaggaggtggagcgatctgagtcgtggactcagacccgacaggtgaacctgagacttggagttgagctcactcgaacctgttacgaaatgtaccaccagactgtcaccggtctgtctcctgaaatcgttttcttcaacgaccacaacactctcagcaaggacttttctgtcaagccccaggacgcccataacctgcagcgtcccgagacagttgagtcgctcttctacctctggcgaatcacccgaaaccccatctatcgagaatggggctgggagattttccaggcgttccaaaagtacaccaaggttcctggagacgccggttacgactccatcaacaacgtcgagtcgacagagccatcttggagaaacaatatggagtccttctggctgtccgaaaccctcaagtacctgtacctgctgtttgacgactccaaggaggaggtgctgcctcttaccgatattgtcttcaacaccgaggctcatcccttccccaagtttgatatggagcctctgtttaccactggttggactcgagctcctgtgcaggctgccaagaaggagccccaggtggagcagaaagtggagaagattcctgacgagcctgccgcggagtttaagcctgcgcaggttcctgctgatcctattaggggttga

SEQ ID NO: 58604 - protein, 629 aa, Yarrowia lipolytica CLIB99
MSFNIPKTTPNFSAKARKLEDQLWQASGLEKSKDSTLPLYKDKPYGEGFVARTTSGRRRRNIIYGVVVGLLFWAIYTFSRSLDGNVSLKDGIKDYEFKGWKGRGKPKTNWVAEQNAVKQAFVDSWNGYHKYAWGKDVYKPQTKTGKNMGPKPLGWFIVDSLDSLMLMGLEKELAEARYWVDKDLDYNIDYEVNTFETTIRMLGGLLSAHYLSKDDLYLDKAVNLGNRLLGAFDSESGVPYASVNLKTRKGVKSHADGGASSTAEAATVQLEFKYLSKLTGEALYWETAEKVMKVMEANKAEEGLVPIFIQPDTGKFQGNQIRLGSRGDSYYEYLIKQYLQTEKREEIYRDMYEEAVDGIKHHMVKQSVPGDLAFIGELDRGISGPFSTKMDHLVCFAGGMFALGATEGYTQKEVERSESWTQTRQVNLRLGVELTRTCYEMYHQTVTGLSPEIVFFNDHNTLSKDFSVKPQDAHNLQRPETVESLFYLWRITRNPIYREWGWEIFQAFQKYTKVPGDAGYDSINNVESTEPSWRNNMESFWLSETLKYLYLLFDDSKEEVLPLTDIVFNTEAHPFPKFDMEPLFTTGWTRAPVQAAKKEPQVEQKVEKIPDEPAAEFKPAQVPADPIRG

SEQ ID NO: 58605 - DNA, 1884 bp, Canis familiaris
  CDS (1)..(1884)
atgtcagcccggagagctcagatgctctcgcctcgcagcttctcgacgggggacttttgctcggaccgctgccgggcccccggggaacccccgccctgggtaacaggcgggaaggcgcgggagaagacacccgttgggagctaccccgcgcccgggagggccccgaccttccgcccgccgccgaccgcaagcccgggcccggggcgcgctccgaggaacgcggaggcggagggccgatcccggcgcggcgacggggaccccgcggccgccctggaggacaacttggcccggatccgcgagagccacgagcgggctctccgggaagccaaggagaccctgcagaagctgcccgaggagatccagagggacatcctgctggagaaggagaaggtggcccaggaccagctgcgcgacaaggcgctggcgaggcggctgccgccgctggacttcgtgcccccggtcggcgcggtggcccgggagccggccgacgccgccgtccgcgacaagagggcaaagatccgggagatgatgaaacatgcttggaataattataagcgttatgcctggggattaaatgaactgaaacctatatcaaaagaaggccattctagcagtttgtttggtagtattaaaggagcaacaatagtagatgccctggatactctttttataatggaaatgaaagatgaatttgaagaggcaaaatcatgggttgaagaaaatctagattttaatgtgaatgctgaagtttctgtctttgaagtaaacatacgctttgttggtggactactctcagcctactatctatctggagaagagatatttcgaaagaaagcagtggaacttggggtgaaattgttacctgcatttcatactccatctggaataccttgggcattgctgaatataaaaagtggaattggaaggaactggccctgggcctcaggaggcagcagtattttggcagaatttggaactctgcatttggagtttctccacctgagccacttatcaggaaaccccatctttgccgaaaaggtaatgaatattcgaacagtactgaacaacctggaaaaaccacaaggcctttatcctaactatctgaatcccagtagtggacagtggggtcaatatcatgtatcagttggagggctcggagacagcttttatgaatatttgctaaaggcgtggttaatgtctgacaagacagatctagaagctaagaagatgtattttgatgctgttcaggcaatcgagactcacttgatccgcaagtctagtacgggcctgacttacatcgcagagtggaaggggggcctcttggaacacaagatgggccacctgacctgctttgctggaggcatgtttgcactaggggctgatgacgctcctgcaggcctaacccaacactaccttcagctcggggctgaaattgcccggacctgttacgaatcttacaatcgcacatatatgaaactgggaccagaagctttcagattcgatggcggtgttgaagccattgctacaaggcaaaatgaaaaatactacatcctacggccagaggttgttgagacgtacatgtacatgtggcgactgactcatgatccaaagtacaggaaatgggcctgggaagccgtagaggccctggaaaatcactgccgcgtgaacggaggctattcaggcctaagggatgtttacctccgacacgagagttatgacgatgtacaacagagtttcttcttggcagagacactgaaatatttgtacttaatattttctgatgatgatctgcttccactggaacactggatcttcaataccgaggcacatcttctccctgtactctgtacgaataaaaaggaagtcgaagtcaatgcaaaataa

SEQ ID NO: 58606 - protein, 627 aa, Canis familiaris
MSARRAQMLSPRSFSTGDFCSDRCRAPGEPPPWVTGGKAREKTPVGSYPAPGRAPTFRPPPTASPGPGRAPRNAEAEGRSRRGDGDPAAALEDNLARIRESHERALREAKETLQKLPEEIQRDILLEKEKVAQDQLRDKALARRLPPLDFVPPVGAVAREPADAAVRDKRAKIREMMKHAWNNYKRYAWGLNELKPISKEGHSSSLFGSIKGATIVDALDTLFIMEMKDEFEEAKSWVEENLDFNVNAEVSVFEVNIRFVGGLLSAYYLSGEEIFRKKAVELGVKLLPAFHTPSGIPWALLNIKSGIGRNWPWASGGSSILAEFGTLHLEFLHLSHLSGNPIFAEKVMNIRTVLNNLEKPQGLYPNYLNPSSGQWGQYHVSVGGLGDSFYEYLLKAWLMSDKTDLEAKKMYFDAVQAIETHLIRKSSTGLTYIAEWKGGLLEHKMGHLTCFAGGMFALGADDAPAGLTQHYLQLGAEIARTCYESYNRTYMKLGPEAFRFDGGVEAIATRQNEKYYILRPEVVETYMYMWRLTHDPKYRKWAWEAVEALENHCRVNGGYSGLRDVYLRHESYDDVQQSFFLAETLKYLYLIFSDDDLLPLEHWIFNTEAHLLPVLCTNKKEVEVNAK

SEQ ID NO: 58607 - DNA, 2013 bp, Canis familiaris
  CDS (1)..(2013)
atgggtcttacaagcacagtgagcgatgcttacagattagggtgttctggtaaaaagagtagggttcaggatacctttttgcgccatccggaaccacaagctggcagcatccctaacccggggctggaggcgctctctccggccccggctaggcgggagacgcgcgctccccagggcccggcggcgagggggccgcgtcgcggtcgggtgtctgccggtgctcccgtgccgcgctcccattggctgcaagtttcctcgccagtagccggagcggcccctggtcgccacgccagcccacgggggcggccggggccggcggtgtgcggcccggcgcactggggctacgtgctgggcagccgcggccgcggcccggacgagtacgagcggcgctacagcggcgccttccctccgcagctgcgcgcccagatgcgcgacctggcgcggggcatgttcgtcttcggatacgacaactacatggcgcacgccttcccccaggacgagctcaaccccatccactgccgcggccgcgggcctgaccgcgtggacccttcaaatctgaacatcaatgatgtcctagggaattattcattgactcttgttgatgcgttggatactcttgcaataatgggaaattcatctgagttccagaaagcagtcaagttagtgatcaacacagtttcatttgacaaagattccaccgtccaagtctttgaggccacaataagggtcctaggaagcctcctttctgcccacagaataataactgactccaagcagccctttggtgacatgacaattaaggattatgataacgaattgttgcacatggctcacgatctggctgtgcgcctcctccctgcctttgaaaacaccaagacagggatcccctatcctcgggtgaatctaaagacaggtgttcctcctgacagcaataatgagacgtgcacagcaggagctggttccctcctggtggaatttgggattctgagccgactcctaggggactctacatttgagtgggtggccagacgtgctgtgaaagccctttggaacctgcggagcaatgatacgggattattaggcaacgtggtgaacattcagacaggccgctgggttggcaagcagagcggcttgggcgccggcctggactccttctatgaatacctcttgaaatcttacattctctttggagaaaaggaagacctagaaatgtttaatgcagcataccgaagtattcagaactacctgagaagaggtcgggaagcctgtaatgaaggagaaggagaccccccgctgtatgtcaatgtgaacatgttcagtgggcagctgatgaacacttggatcgactctctgcaggccttcttccccgggctgcaggttctgataggagatgtggaagatgccatctgcctccatgctttttactacgccatctggaaacgctacggggccctccctgagaggtataactggcagctccaggcccccgatgtgctcttctacccgctgagaccagagctagtggagtctacatatctcctctaccaggcaaccaagaatcccttctacctccatgtaggaatggatattctgcagagtctggaaaagtacacaaaagtcaagtgtgggtatgctacattgcatcatgtcatagacaaatccaaagaggaccggatggagagcttctttctcagtgagacctgtaaatacttgtatctgctatttgatgaggagaatccagtccacaaatctggaaccaaatacatgtttacaaccgagggacacattgtatctgtggacaaacatcttcgggaatctccttggaaggaattcttttctgaagagggagggcaggacccagaggggaagtctgtgcacgggcctaaatcacccgagataaaagtcatcaactccagctccaattgcaatcgtgttcctgacgagaggagatactccctgcccttaaagagcatctatatgcggcagattgaccagatggttggcttgatttga

SEQ ID NO: 58608 - protein, 670 aa, Canis familiaris
MGLTSTVSDAYRLGCSGKKSRVQDTFLRHPEPQAGSIPNPGLEALSPAPARRETRAPQGPAARGPRRGRVSAGAPVPRSHWLQVSSPVAGAAPGRHASPRGRPGPAVCGPAHWGYVLGSRGRGPDEYERRYSGAFPPQLRAQMRDLARGMFVFGYDNYMAHAFPQDELNPIHCRGRGPDRVDPSNLNINDVLGNYSLTLVDALDTLAIMGNSSEFQKAVKLVINTVSFDKDSTVQVFEATIRVLGSLLSAHRIITDSKQPFGDMTIKDYDNELLHMAHDLAVRLLPAFENTKTGIPYPRVNLKTGVPPDSNNETCTAGAGSLLVEFGILSRLLGDSTFEWVARRAVKALWNLRSNDTGLLGNVVNIQTGRWVGKQSGLGAGLDSFYEYLLKSYILFGEKEDLEMFNAAYRSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSKEDRMESFFLSETCKYLYLLFDEENPVHKSGTKYMFTTEGHIVSVDKHLRESPWKEFFSEEGGQDPEGKSVHGPKSPEIKVINSSSNCNRVPDERRYSLPLKSIYMRQIDQMVGLI

SEQ ID NO: 58609 - DNA, 1794 bp, Canis familiaris
  CDS (1)..(1794)
atgctcgtcaggaaagtgcctgtcttcgtcccggcctccccgtgggggctgcggctgccgcagaagttcgtcttccttctcttcctctcgggcctctttccctgtgcttcggggccctcttcctgctgcccaactcctcccgcctcaagcgcctcttcctggccccccggacccagcagcccggcctggagccaggccagtccccgccgccggaaagcgtggccgcggcgcacccaccccaccggggctcgggaggaggccacggcggcccggagcggcggcagcgcggccctcgggccccaggaggggggcgtcccgtttagctttgacttcagcgcgttccggagccgcctgcgccacccggtcctggggacgagggtggacgagagcaaggagccccagagcctggttcgggcccggcgggagaaaatcaaggagatgatgcagttcgcctggcagagctacaagctttacgcaatggggaaaaatgagctccggccactcacaagagacggctacgagggcaacatgtttggaggcctcagtggggcaaccatcattgactcccttgacaccctctacctcatggagctgcaggaggagttccaggaggccaaggcctgggttgaagagaacttccacctgaatgtgagtggagaagcatccttgtttgaggtgaacatccggtacatcggaggactcctctcagccttctacctgactggagaagaggtgttccgagtaaaggccatcaagctgggagagaaactcctaccagccttcaacacccccacgggaatcccaaaaggtgttgtaaacttcaaaagtggctccaacaggagctggggctgggccatggcagggagcagcagcatcctggctgagtttggatccctgcacttggagttcttacacctcaccgagctctctggcaaccaggtcttcgcagaaaaggtcaggaacatccgaaaggtcctcaggaagatcaacaagcccttcggcctctaccccaacttcctcagcccagtgagcgggaactggatgcaacaccacgtctcagttggaggacttggggacagtttttatgaatatttgatcaaatcctggttgatgtcagccaagacagatgtggaagctaaagagatgtactacgaagccttggaggcaatagagacctacttgctgaatgtctctcctggggggctgacctacattgctgagtggcgaggggggattctggaccacaagatggggcacctggcctgtttctctgggggcatgatcgccctcggcgctgaggatgccaaggaagaaaagagggcccactaccgagagctcgcagcccagatcaccaagacgtgccacgagtcgtacgcccgctcagataccaaactggggcccgaggccttctggtttaactccggcagagaggcagtggccacacagctgagcgagagctactatatcctgcggcccgaggtggtggagagctacatgtacctgtggcgacagacccacaaccccatctacagggagtggggctgggaagtggtgatggccttggagaaatactgtcgaacggaagctggtttctctggaatccaagacgtgtacagtagcatccccaaccacgacaacaagcagcagactttctttctcgcggagacactaaagtatctctatcttctgttctctgaagatgacatgctctccctggaagactgggtgttcaacacagaggcccaccccctccccgtgaaccactcggacagctccagcagggctgggggctga

SEQ ID NO: 58610 - protein, 597 aa, Canis familiaris
MLVRKVPVFVPASPWGLRLPQKFVFLLFLSGLFPCASGPSSCCPTPPASSASSWPPGPSSPAWSQASPRRRKAWPRRTHPTGAREEATAARSGGSAALGPQEGGVPFSFDFSAFRSRLRHPVLGTRVDESKEPQSLVRARREKIKEMMQFAWQSYKLYAMGKNELRPLTRDGYEGNMFGGLSGATIIDSLDTLYLMELQEEFQEAKAWVEENFHLNVSGEASLFEVNIRYIGGLLSAFYLTGEEVFRVKAIKLGEKLLPAFNTPTGIPKGVVNFKSGSNRSWGWAMAGSSSILAEFGSLHLEFLHLTELSGNQVFAEKVRNIRKVLRKINKPFGLYPNFLSPVSGNWMQHHVSVGGLGDSFYEYLIKSWLMSAKTDVEAKEMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVMALEKYCRTEAGFSGIQDVYSSIPNHDNKQQTFFLAETLKYLYLLFSEDDMLSLEDWVFNTEAHPLPVNHSDSSSRAGG

SEQ ID NO: 58611 - DNA, 1983 bp, Canis familiaris
  CDS (1)..(1983)
atgtatccgccgctgccgccgccggcgccgcatcgggacttcatctcggtgacgctgagcctcggccagagctacgacggaagcaaaagctggcggcggcgctcgtgctggaggaaatggaagcagctgtcgaggttgcagcggaacgtgatactcttctcgctcacgttcctgatgctctgtggcttcctgtcctacatcagcgtggctgaccagtggacagccgtggacggcaggtcagcggaagagcagaaaacgagaccagcagatccacccgtcttgccagctcctcagaaagcagatgcacatccagaaaacatgcagggggccttacctcagaagcctcagaggcatttccgacggggaccacccaacctgcatcttagagcccccggtaaagactccgaggacccgaggcagggagacaccaagcggagggatgaggcggtgggcgatgctcatcaggaggaaagcacgcagagaacggtggtcagctggaggggagcggtgattgagccgcagcccggcaccgaacttccttcgaggaaggcagaggcccccgccaggccttcctcccaggcccccaggattcagaacccagcagcctccccaaacgagcgtcagagagctgtgattgacgccttccgccacgcgtgggccggataccgcaaattcgcctggggccatgatgagctgaaacctgtgtccaggtccttcagtgagtggtttggcctgggcctgaccctgattgacgctctggacaccatgtggattttgggtctgaaaaaagagtttgaagaggccaggaagtgggtgtcgaagaagctacggtttcagaaagatgtggacgtcaacctgtttgagagcacaatccggatccttggtgggcttctgagcgcctaccacctgtcgggggacgagctcttcctgaggaaggctgaagattttgggaatcggctcatgcctgcgttccagacgccttccaagatcccgtactccgacgtcaacatcggcactggggccgcccacccgccccgctggacctcggacagcacggtggccgaggtcacgagcattcagctggagttccgggagctctcgcgcctcacgggaagtaagaagtttcaggaggctgcggaggaggtgacgcggcatgtccactccctgtcgggcaagaaggacgggctggtgcccatgttcatcaatacgcacagcggcctcttcacgcacatgggcgtgttcactctgggagccagggccgacagctactacgagtacctgctgaagcagtggatccagggtggaaagcaggagacgcagttgctagaagactacctggaagccatcgagggaatcagaaggcacctgctgcgcaggtctgagcccagaaagctcaccttcgtgggggagctggcccacggccgcttcagcgccaagatggaccacctggtatgcttcctgccagggacgctggctctgggcgcccaccacggcctgcccgccgaccacatggagctggcccgggcgctcatggacacctgctaccagatgaaccgtcagatggagacggggctgagccccgaaatcgtgcacttcaacctgtacccccagaacgaccacaaagacgtgcaagtcaagccggccgacaggcacaacctgctgcggcccgagacggtggagagcctgttctacttgtaccgcctcacgggggaccgcaagtaccaggactggggctgggaaattctgcagagcttcaacacgtacacgcgggtcccctcgggtggctactcctccatcagcaacgtccaggatcccctcaatccccagcccagggacaagatggagagcttttttctgggggagacgcttaagtacctgtatctgctcttctctgatgacccagacctgctcagcctggacacctatgtgttcaacacggaggctcaccccttgcccatctgggccccgcctagggaggtgtga

SEQ ID NO: 58612 - protein, 660 aa, Canis familiaris
MYPPLPPPAPHRDFISVTLSLGQSYDGSKSWRRRSCWRKWKQLSRLQRNVILFSLTFLMLCGFLSYISVADQWTAVDGRSAEEQKTRPADPPVLPAPQKADAHPENMQGALPQKPQRHFRRGPPNLHLRAPGKDSEDPRQGDTKRRDEAVGDAHQEESTQRTVVSWRGAVIEPQPGTELPSRKAEAPARPSSQAPRIQNPAASPNERQRAVIDAFRHAWAGYRKFAWGHDELKPVSRSFSEWFGLGLTLIDALDTMWILGLKKEFEEARKWVSKKLRFQKDVDVNLFESTIRILGGLLSAYHLSGDELFLRKAEDFGNRLMPAFQTPSKIPYSDVNIGTGAAHPPRWTSDSTVAEVTSIQLEFRELSRLTGSKKFQEAAEEVTRHVHSLSGKKDGLVPMFINTHSGLFTHMGVFTLGARADSYYEYLLKQWIQGGKQETQLLEDYLEAIEGIRRHLLRRSEPRKLTFVGELAHGRFSAKMDHLVCFLPGTLALGAHHGLPADHMELARALMDTCYQMNRQMETGLSPEIVHFNLYPQNDHKDVQVKPADRHNLLRPETVESLFYLYRLTGDRKYQDWGWEILQSFNTYTRVPSGGYSSISNVQDPLNPQPRDKMESFFLGETLKYLYLLFSDDPDLLSLDTYVFNTEAHPLPIWAPPREV

SEQ ID NO: 58613 - DNA, 1926 bp, Canis familiaris
  CDS (1)..(1926)
atgactaccccggccctgctgcccttatctggacgaaggataccacctctgaacctgggaccgccttccttcccgcaccacagggctaccttgagactttccgagaagtttatcctcctccttatcctaagtgccttcatcaccctgtgttttggagcattcttcttccttccagactcttcaaaacacaaacgctttgatctgggtttggaagatgtgttaattcctcacgtagatgccagcaaaggggctaaaaaccctggagtctttctgatccacggacccgatgaacacagacacagggaagaagaggaacgtttaagaaataaaattcgagctgatcacgagaaggccctggaggaagcaaaagaaaaattaaaaaagtcgagagaggaaattcgagcggaaattcagacagagaaaaataaggtagtccaagagatgaagacaaaagagaagaagccactgccaccagtccctataccaaatctaataggaataaatggtggagacccagaagataatgacatacgaaagaaaagggaaaaaattaaagagatgatgaaacatgcctgggataattataggatgtatggttggggacataatgaactcagacctattgcaaagaaaggacactccactaatatatttggaagttcacaaatgggtgctaccatagtagatgctttggataccctttatatcatgggacttcatgatgaatttggagatgggcaaaaatggattgaagagaaccttgatttcagtgtgaactcagaggtgtctgtgtttgaagtcaacattcgatttattggaggcctgcttgcagcttattacctttcaggagaagagatattcaagattaaagcagtccaactggctgagaaactccttccggcctttaacacacctactgggattccttgggcaatggtgaatctgaaaagtggagtagggcgaaactggggctgggcatctgcaggtagcagcattcttgctgaatttggtacactgcatatggagtttgtccacctcagctacttgacaggggacccagtttactacaaaaaggtaatgcacattcggaaactgcttcagaagatggatcgtccaaatggtctttatccaaattatttgaacccaagaacaggtcgctggggtcagtatcatacatcagttggcgggctgggagacagtttttacgaatacttactaaaagcatggttgatgtcagataaaacagaccatgaggcgagaaaaatgtatgatgatgctattgaggctatagagaaacatcttattaagaagtcccgaggaggtctcacctttattggagaatggaaaaatgggcacttggaaaagaagatggggcacttggcctgttttgctgggggaatgtttgcactgggagcagatggttccagaatggataaagctggtcattatttagagctaggggcagaaattgcacgtacatgtcatgagtcatatgacagaactgcattaaagctgggtcctgaatcattcaagtttgatggtgcagtagaggctgtggcagtccggcaggctgaaaagtattacatcctccgtccagaagtaattgaaacctattggtacctatggagattcactcatgatccaagatataggcaatggggctgggaagcagcactggctattgaaaagtattgccgagtaagtggtggattttctggggtgaaggatgtgtattcctctactcctacacatgatgatgtacagcagagcttctttcttgctgaaacattaaaatatttgtatctgctgttctccagtgatgatcttttacctttagaccactgggtattcaacacagaggctcatcctctgcctgtgttacatttagccaacaccacactttcaggaaatcctgctgttcgatga

SEQ ID NO: 58614 - protein, 641 aa, Canis familiaris
MTTPALLPLSGRRIPPLNLGPPSFPHHRATLRLSEKFILLLILSAFITLCFGAFFFLPDSSKHKRFDLGLEDVLIPHVDASKGAKNPGVFLIHGPDEHRHREEEERLRNKIRADHEKALEEAKEKLKKSREEIRAEIQTEKNKVVQEMKTKEKKPLPPVPIPNLIGINGGDPEDNDIRKKREKIKEMMKHAWDNYRMYGWGHNELRPIAKKGHSTNIFGSSQMGATIVDALDTLYIMGLHDEFGDGQKWIEENLDFSVNSEVSVFEVNIRFIGGLLAAYYLSGEEIFKIKAVQLAEKLLPAFNTPTGIPWAMVNLKSGVGRNWGWASAGSSILAEFGTLHMEFVHLSYLTGDPVYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRMDKAGHYLELGAEIARTCHESYDRTALKLGPESFKFDGAVEAVAVRQAEKYYILRPEVIETYWYLWRFTHDPRYRQWGWEAALAIEKYCRVSGGFSGVKDVYSSTPTHDDVQQSFFLAETLKYLYLLFSSDDLLPLDHWVFNTEAHPLPVLHLANTTLSGNPAVR

SEQ ID NO: 58615 - DNA, 1812 bp, Cryptococcus neoformans var. neoformans JEC21
  CDS (1)..(1812)
atgtcgcaagtacgctcaagagcctcccagggtgggaaaggcaaggatgagccccagaaaaggctggataagaaggacattgacagaaaagtcgagcaaatacaagcccttggcgtattaaggacgattctttcatgcttgggtcttgtagctgtcttgtggtttggctggaagaccgtggcacccatcttggagaaaaagacaagccctcctgtgattccgcaagcaaagcttcctggaagcaaattcggcaccatcaagccttcggatcttcctaaaatcaacctaagcaccaagcttgaagcagacattgaaaagagggaggcagtcaaggaagcttttgagtggagttggcatgcgtatgagaagcacgcttggggagccgacgaataccaacccttgacccagacaggctccaacttgacttctgccggtggcgttgggtacacaatcgtggattctattgattctttgctcatcatggacttgatcccagagtaccaaagggctcgagactgggtccgcgatcatcttaactttgacaaggatgcccagttcaacacatttgaaactaccattcgtctcctcggtggccttctctctgcgcactatctcagctctacccactcgtcccctgccatccaggccgatgctcctctttacctcgatctcgccatcgacctcggtgaacgtcttctcggcgccttcacctcccctaccggcatcccttggtcaggaatcaaccttgctactcgtcagggtattcctgatagagacaaccagggcgttgccagtttggctgaagccgctagtttgcaattggaactcaaatatcttagtcatttaacaggagactatgtgtactggaagaaggcagagaaggtgaccgagatcattcgagcgcaggcaatccatgatggtattgctcccatcttcatctctcccgtgaatgggcagtttgtggcttctgagatccgacttgggtccagaggtgattcttactacgaatacttgctcaagcaatggcttcaaactaaccgacaagagcccgtttaccgcgatatgtatgacgaagctatggtcggtattaagaggcacctcattggacaaactagcaaatccaacctcatcttcacccaggaactccatcctgctcgacacccgcgagatcaaagtgccacatggcaagtcgtccccaagcaagaccacctagtctgcttcttgggcggatcgttcctgctcggtatcacagaaggcggaaagagagatttagattgggagaatatggaagaaaaggacagggaggatttcctcgttggtcaggggatcatcgaaagttgtatgaagacccatgacactgcaaccggattggctcctgagattgccatgtttgtgcaatggagcgatgatcgagctaatgaggaggattggtacatcaaacctaaccacaacggcatcctcatcgatgggcgcaatatccttcgacccgagactgtcgagtctctctttctcgcctaccgagccaccggtgatgagaagtaccgccgatggggatggcaaatattcgaggctttccagaagtggtgtagggtcgaagacggcggttatgcgggtattgaggatgtgcaatctatgccgcccaagcagttggacagaatggagacgttttggctcggagaaacactgaagtatctgtacttgctcttcgatgatgcagatcacatcccacttgacaaaaacatcttcaacaccgaagcccatatccttcccgttttcacgcccgaatacgtctcttctttcgccctttcatag

SEQ ID NO: 58616 - protein, 603 aa, Cryptococcus neoformans var. neoformans JEC21
MSQVRSRASQGGKGKDEPQKRLDKKDIDRKVEQIQALGVLRTILSCLGLVAVLWFGWKTVAPILEKKTSPPVIPQAKLPGSKFGTIKPSDLPKINLSTKLEADIEKREAVKEAFEWSWHAYEKHAWGADEYQPLTQTGSNLTSAGGVGYTIVDSIDSLLIMDLIPEYQRARDWVRDHLNFDKDAQFNTFETTIRLLGGLLSAHYLSSTHSSPAIQADAPLYLDLAIDLGERLLGAFTSPTGIPWSGINLATRQGIPDRDNQGVASLAEAASLQLELKYLSHLTGDYVYWKKAEKVTEIIRAQAIHDGIAPIFISPVNGQFVASEIRLGSRGDSYYEYLLKQWLQTNRQEPVYRDMYDEAMVGIKRHLIGQTSKSNLIFTQELHPARHPRDQSATWQVVPKQDHLVCFLGGSFLLGITEGGKRDLDWENMEEKDREDFLVGQGIIESCMKTHDTATGLAPEIAMFVQWSDDRANEEDWYIKPNHNGILIDGRNILRPETVESLFLAYRATGDEKYRRWGWQIFEAFQKWCRVEDGGYAGIEDVQSMPPKQLDRMETFWLGETLKYLYLLFDDADHIPLDKNIFNTEAHILPVFTPEYVSSFALS

SEQ ID NO: 58617 - DNA, 2406 bp, Rattus norvegicus
  CDS (1)..(2406)
atggtcggggaaagggtcgttcccaggccggagcgactagaaagggcaggccgcggcctcagagcgcagagccaacccaggactcagcctcagcagggccgtcccttcttccggtcaggagttttgcgtttcaccttcaggcacgctagggtgacgcccgacctagctccccgagaccgagcgcagaattccggcaagggagatggtccgcaactcaaagcagacgttactgcaactaaggacacgtcttcaaaccgtagccagcccgcccccgtcagggagtctgcaggatgcctgcaagggtgccggtgcgcgcgattcagtgacaaatggaagcagctttcgaggttacagcggaatgtgattctcttcgtcctgggctttctgattctctgtggatttctgtattctcttcaggtgtctgaccagtggaaagctctgagtggcagccgtgcagaagtagagaagatgaagctagaagtcctgcctgtcttaccagctcctcagaaggaaagtgctgaaccagaagggtttgcagacatactctctcagaagcggcaaaggcatttgcggcggggccctccgcacctgcagatcagaccccccaacaccgtctccaaagatgggatgcaggatgatgctaaggagagggaagcagccctggggaaggctcagcaggaagaaaacacccagagaaccgtcatcagctggcggggagcagtaattgagcctgaacaggccactgaacctccttccaaaagagctgaagcctccatcaagcctctgtttttggcgtccaggatatggaaagagccagcatctgtactctgtccacatacctcacacaactttgtgactatcagtgacttctcagctgctctgatcttgtgcctgagcactgagcagccagaggatgctctgttggagaaggctggttcccattgctcatcagtgccaggttccccattcattatctgcagtgtagtggtagaccctcccccaaatgagcgccagaagggagtgattgaggcctttctccatgcttggaaaggttaccaaaagttcgcttggggccatgatgaactgaagcctgtgtccaaaaccttcagtgagtggtttggcctgggcctcaccctgatcgatgccttggataccatgtggattttgggtctgaagcaagaatttaaggaagccaggaagtgggtgtcggagaacttagactttcagaagaatgtcgatgtcaacctgtttgagagtactatccgaatcttagggggcctgctgagtgcctaccacctgtctggggacagcctcttcctgagcaaggccgaggattttggaaaccggttaatgcctgccttcaccacaccctccaagattccatactctgatgtgaacattggcactgggtttgcccactcgccccagtggacttcagacagcacggtggcagaagtgacgagcattcagttggagttccgagagctctcccgtcttaccgggattaagaaattccaggaggccgtggaggaagtgacaaagcacatccactccctgtctgggaagaaagacgggctggtgcctatgttcatcaacacgaacagcggcctcttcacccacccgggagtgttcaccttgggtgccagggctgacagctactacgaatacctgctgaaacagtggatccagggtggcaagaaggagacacagttgctggaagactatgttagagccatcgaggggatcaaagctcatctgcttcgacagtctcagcccagaaagctcaccttcgtgggagagcttgcccatggccgcttcagtgccaagatgcatgagtctaggcccgaatgtgaggagataatttgtttccaggaccacttggtgtgcttcctgccagggacgctggccttgggcgtccaccatggcctaccggctgaccacatggatctggctcgggcactcatggagacctgctaccagatgaaccaacagatggagacaggtctgagccctgagattgcacatttcaacatgtaccctcgagcagatcataaagacgtggaggtcaagccggctgataggcacaacctgctgcggccggagaccgtggaaagcctgttctatctgtaccgcgtcacaaaagaccgcaagtaccaagactggggctgggaaatcctgcagagcttcaataagtacacacgggttccctcgggtggctattcttctatcaacaacgtccagaattcccacaagcctgagcccagggacaagatggagagcttctttgtgggagaaacactgaagtacctctacctgctgttttctgatgacctggagctgctcggcctggacacctgtgtgtttaacacagaagctcatcccctgcccatctggtctcctgcctag

SEQ ID NO: 58618 - protein, 801 aa, Rattus norvegicus
MVGERVVPRPERLERAGRGLRAQSQPRTQPQQGRPFFRSGVLRFTFRHARVTPDLAPRDRAQNSGKGDGPQLKADVTATKDTSSNRSQPAPVRESAGCLQGCRCARFSDKWKQLSRLQRNVILFVLGFLILCGFLYSLQVSDQWKALSGSRAEVEKMKLEVLPVLPAPQKESAEPEGFADILSQKRQRHLRRGPPHLQIRPPNTVSKDGMQDDAKEREAALGKAQQEENTQRTVISWRGAVIEPEQATEPPSKRAEASIKPLFLASRIWKEPASVLCPHTSHNFVTISDFSAALILCLSTEQPEDALLEKAGSHCSSVPGSPFIICSVVVDPPPNERQKGVIEAFLHAWKGYQKFAWGHDELKPVSKTFSEWFGLGLTLIDALDTMWILGLKQEFKEARKWVSENLDFQKNVDVNLFESTIRILGGLLSAYHLSGDSLFLSKAEDFGNRLMPAFTTPSKIPYSDVNIGTGFAHSPQWTSDSTVAEVTSIQLEFRELSRLTGIKKFQEAVEEVTKHIHSLSGKKDGLVPMFINTNSGLFTHPGVFTLGARADSYYEYLLKQWIQGGKKETQLLEDYVRAIEGIKAHLLRQSQPRKLTFVGELAHGRFSAKMHESRPECEEIICFQDHLVCFLPGTLALGVHHGLPADHMDLARALMETCYQMNQQMETGLSPEIAHFNMYPRADHKDVEVKPADRHNLLRPETVESLFYLYRVTKDRKYQDWGWEILQSFNKYTRVPSGGYSSINNVQNSHKPEPRDKMESFFVGETLKYLYLLFSDDLELLGLDTCVFNTEAHPLPIWSPA

SEQ ID NO: 58619 - DNA, 1761 bp, Aspergillus nidulans FGSC A4
  CDS (1)..(1761)
atgccgagacggtggtcctccctcatcagcatcacagccatcttcttggtcctcttcttcctccttcataggaatacagacacaccacgcgccgccaatagggctacaaacggccctgccaacggctttgctaggcagcaaagcatatgtccatcaacaccccctcagcctccatataaccgaaccagcacgggagggttcaactggggtgaaatcccagtcagataccctgtatccgacttcatcccgctgtcaaccaactctcctgcaacacttccgcgcatccaacgctcttccttcccacttcaatcctcaatcactaaatcccgccaggcagcagtcaaaggtgcctttcagcgcgcatggacctcctacacaacccacgcctggaaggcggacgaggtacggcccatcacggccggatctcgaaacaactttggcggatggggagcgaccctagtcgacaatctcgacacactgctaatcatggggctggacgaggagttcgcagcggcagtcgacgcgctcgcagatatagaattcagcccgcactcgtccccatcctcctcccagagcacaatcaacatattcgaaacgacaatccggtatctgggcggcttgctcgcggcgtatgatctcactggctgtcgagagactcggctgctggacaaagcaatccagcttggggagatgatctacacctccttcgacacagagaaccgcatgcccgtaccacggtggaatctgcacaaagcaggcaacggagagcctcagcgcgcggcagtgcagggcgtgctcgctgaactcgccagcagcagtctcgagttcacgcggctgtcgcagctgacgggggatatgcggtatttcgatgcggcatcccgcattaccgatctgcttgactcccaagccggccatacccggatcccggggttgtggccagtcagcgtgaacctgcagaaaggcgatctgacccgtgggtcgacattcagttttggcgggatggccgatagcgcctacgagtatctcggcaagacgtatcggctcctcggtggtgtggggaaagggccacagtacgagcgtctggcgcgaaacgcactagatgccgggattcgacatctcctcttccgaccgatgacgcctgatcatgcagatatcctcctacccggggtcgcgcacgcaaccagctcttccgtgggactcgagccccggacagagcatctcgcctgttttgtgggtgggatgtacgcgctcgccgggaagcttttctcaaaccagacgtacctcgacaccggccggaagctgacagacggttgtatctggtactacgataattcaccgctaggtatcatgccggagatgttcaccgtgccggcttgtccgtcagtggctgaatgtccttgggacgaaacaaggggtggtatctacacctacgtgcgtgatgggcactactttctgcgtcctgaggcaatggagagtatcttctatatgtggcgcattacaggggacgaaaagtaccgcgaggctgcatggagaatgttcacggctatcgaagcggttacaaagacggagtttgggaatgcggcggtgcgggatgttatggttgaggaaggaaatgtaaagagagaagatagcatggagagtttctggatggcagagacgttgaagtatctgtatctgatatttggggagaccgatttggtcagcttggacgactgggtgttcaatacggaggcgcaccctttgaggggtgcagggagttga

SEQ ID NO: 58620 - protein, 586 aa, Aspergillus nidulans FGSC A4
MPRRWSSLISITAIFLVLFFLLHRNTDTPRAANRATNGPANGFARQQSICPSTPPQPPYNRTSTGGFNWGEIPVRYPVSDFIPLSTNSPATLPRIQRSSFPLQSSITKSRQAAVKGAFQRAWTSYTTHAWKADEVRPITAGSRNNFGGWGATLVDNLDTLLIMGLDEEFAAAVDALADIEFSPHSSPSSSQSTINIFETTIRYLGGLLAAYDLTGCRETRLLDKAIQLGEMIYTSFDTENRMPVPRWNLHKAGNGEPQRAAVQGVLAELASSSLEFTRLSQLTGDMRYFDAASRITDLLDSQAGHTRIPGLWPVSVNLQKGDLTRGSTFSFGGMADSAYEYLGKTYRLLGGVGKGPQYERLARNALDAGIRHLLFRPMTPDHADILLPGVAHATSSSVGLEPRTEHLACFVGGMYALAGKLFSNQTYLDTGRKLTDGCIWYYDNSPLGIMPEMFTVPACPSVAECPWDETRGGIYTYVRDGHYFLRPEAMESIFYMWRITGDEKYREAAWRMFTAIEAVTKTEFGNAAVRDVMVEEGNVKREDSMESFWMAETLKYLYLIFGETDLVSLDDWVFNTEAHPLRGAGS

SEQ ID NO: 58621 - DNA, 1899 bp, Danio rerio
  CDS (1)..(1899)
atgctgccatcaacaagaaaggattttgtatctctgactctcagtgaaagcggcagctacagtaacagcaagcagtggagacggcagtcttgctggaggaaatggaaacagctgtccagattgcagcgcagcctgattctgcttacgttgatgctgttgctggtttgtggaatcgccacatctcccaccctcataggacactggagaggaatgaatggggatgatgtaaaaaactcatttgttgttgacctgaaaaatgagtacaggtccattcttcccgagccgccctctgagagaaaagatttcgatagacgtggagcttttggtttggagaaacttttgcaaggcaaagtgaatgtttcgggtgtgttgggagaccaaaatcatggactggacctcaaaaatgcagataaaggatctgagggacaaaagcctataattagttggcgtggagctgtgatcgaagaagaacaagcctctgatactgacaccaaagacacagaaaaccaaggagacccagcttcattagcacttgccgagagtagactggaggctgtgagagaagcttttagacatgcctggaaaggttacaaggacttcgcttggggtcacgatgaactcaaaccaatctctaaatcatacggagagtggtttggacttgggctgaccctaattgatgctctagataccatgtggatcttgggtctacaagaagagtttgcagaggccagggagtgggtggccaaagagctctctttcgataagaatgtggatgttaatctgttcgagagcaccattcgtatcctgggtggcctactgagtacctaccatctcacaggagacaaccttttcctggataaagctaaagagattggcttcagactgatgcccgccttcagcactccctccaaaatcccctattctgatgtgaatattgggaagggcacagctcatcctccgcgatggacttcagacagcaccgtagccgaggtcactagcattcagctggagttcagagagctcagccgactcactggagaccccaaatacaagctggctgtgatggaggtgatgaagcaggtgcacaaactggatggaaagcaagatgggcttgtgccgatgtttatcaataccaacaatggactgttcacccatcagggcatttacacgctaggcgccagggctgacagctactatgagtatctgcttaagcagtggatacagggaggcagaatcgagcaggaattgctggaggactatctgcaggctgtggaaggagtgaagaagaacctgctgaagaaatcgacacctcttggccttacatttgtaggagagttgtcccatggacacttcagtcccaaaatggaccatttggtatgtttcctgcctggcacgttggcactgggggtgcattacggccttcccgctgatcatatggagcttgcgaaacagctgatagagacctgctaccagatgtatgcacagatggagaccggtctgagtccagaaatagcccatttcaacatgcacgatggtagcacacaggatgtagatgtgaagattgcggaccgccacaatcttctgcgtccagaaaccgtggagagcctcttctacctgtacagattgaccagggataagaagtaccagcagtggggctgggagatcctgcagaactttaacaagtacacaagggttccaaccggaggttacacatcaataaacaacgtccgtgacccttcctacaccagtcctcgagacaagatggagagcttcttcctgggggaaacgctcaaatacttctacctgctgttttcagaagaccccacccttatcagcttagacaagtacgtgttcaacactgaggctcatcctctgcctgtatggccacaagcagagtga
